United States Patent 11,098,302 (IDENTIFICATION OF POLYNUCLEOTIDES ASSOCIATED WITH A SAMPLE) - sequence listing, part 36

SEQ ID NO: 121311 - DNA, 752 bp, Homo sapiens
  misc_feature: GYAE6OF01EOY4N.41.2.A02.1.454.CMB.1.raw
  modified_base (191)..(191): a, c, t, g, unknown or other
  misc_feature (191)..(191): n is a, c, g, or t
tcagtctatactatcacgaccggtgctcgatttagactcatctacgagggggagcatcacccagcaaccacatctgtcctctagagagtcccctgagagctccgttcctcaccatggactggacctggaggatccttcttcgttggtggcagcagccacgaggacgccctactcctcgaggtgacagcgtnagtgctagtcgtgggctggaggtgaggacgtccgcgggctcgagtgacgctcctcgtacgactaacgtacttcgtacggaacgttaccgtaggttaccaacgtacttacgtaacttacgtacgtacggtcgggtgaccgtaccggaccggtacccggaggtaaccggaggtaccgtttagggaggtacggtaggtgggtagtacggtaacctaaccgtaaaccgtaggtaggtacggtacgaaccgtactacggtcctcgtacggaccgtaacgtacggtaccgggttacggacggtacggacgtacccgatacggtacggaggtacggaacgtaccgggaccgaccggacgacgtacccggtaacgtacccgatacggtaccgttaacgtacctagggtacgtaggttaaccgtgtaaccgggacgtaccgggttacccggtttaccgtttagtcgggtttcgaccgggtacccggaacccgggttccccgggtaaggggttacccgggggacccggttaacccgtagggttaccccggtacggttccgggtaaccgggg

SEQ ID NO: 121312 - DNA, 845 bp, Homo sapiens
  misc_feature: GYAE6OF01EPI4T.41.2.A02.1.454.CMB.1.raw
tcagtctatactatcacgaccggtgctcgatttagactcatctacagggggagcatcacccagacaaccacatctgtcctctagagacgtcccctgagagtcctccgttcctcaccatggactggacctggaggatcctctttcgttggtggcagcacgccacgaggacgcccactctcgaggtgcagctgatgcgagtcgtgggctggaggtggacggaagccgtggggacctcgagtgaacgtcctccgtaccgtggtacgaacgtaccgttcgtaggtacgtaacgtacggttaaccgtaacctaacgtttacttaacttaacgaactacggtacggtacggtacgaccgtaacccggtccgggaacccttaggggaaccttaggggaaccgttttcgggaacggttcggggaatttcggggaaacttacggaaaccgttacgaaacccggttaaggaacgtacggttacgaaccgtaccgtacgtaccgttacgtaacgtaccgaacggttacgaacggggttcccgtaaacggggtccaacggggtaaccgtaaccggtaacggttacgggaccgggttaccggtacgggaacccgaccgggaaccgacccggaaccgggtaccgaaccggggttaacccgaaccggtaacgttaaccgggaacgtttaacccgtaacgttaaccgttaacggttaacggtacggtaccggtacgtaccgttaccggttaccgtttacgttaccgtaccggtacgggaccccggtacgggtaccccgggtaccgggtaaccgggttaaccggggacccgttaaccgggttaaccgggtccggtaaccggg

SEQ ID NO: 121313 - DNA, 759 bp, Homo sapiens
  misc_feature: GYAE6OF01CK4T6.41.2.A02.1.454.CMB.1.raw
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctctttcttggtggcagcagccacgaggacgcccactctcgaggtcgcagtctgatgcgagtcgtgggcgtggaggtaggagggaacgccggtcggggcctcgaggtagacggtcctctccgtgactagtacttcgtaggtactacgtaggtacaacgtcttanatactacgtaggtcggtcgccgtacnccggccgtaggacgacgggtacttaggacggtggtaggtggagtacggactaacccgtaaacggtaaggtcggtacggtacgtaaccgacgtaccgtccgtacgtccgaacgtacggtaccgggtacgtaccgggacgggtacgtaaccgggtaccaacgtggtacgggttacggtagggtacgtaccggaccgggtccaaggccgtacccggtaacgtacccgtaagtacgggtaccgttaaacccttacggtaacgtacgggttacgtaaacttaccggggacggtaaccggtaccgttacccgggtttaccgttttacggtacgttccggggaaccggtacccgggtaacccgtccccgggggtagggtaacccgggggggttaaccccggtctttaaacggtccgggttaaacgggaccggtttcccggggg

SEQ ID NO: 121314 - DNA, 752 bp, Homo sapiens
  misc_feature: GYAE6OF01ATBK1.41.2.A02.1.454.CMB.1.raw
tcagtctatactatcacgaccggtgctcgatttagactcatctacagggggagcatcacccagcaaccacatcgtcgtcctcctagacgacgtcccctgaggagctccgttcctcaccagtggactggacctggaggtactcctcttcttggtggcagcagccacgaggacgcccctactcgtccgagggtcgcgagcgtgatcgcgtacggtcgtgggggcttggaggtcggaaggtacgccggtcggggcctcgaacggttgaacgccttctaccgttggactaacgtcttaccggaggtactacgtcgttaccaacggtacttctacgtacttaccgcgtacgggactccgaccgtacggcccttaggacgacgggttaccgtaggtacggtgtaacggtcggtacgacggtaacaccgtaaacccgtaaggtaggttcgacggacaggtaacccgtcctcgtacggacccgagtacgggtacgttaccggaggtacgtacggtaccgacgtaggtaccggtaggtacggaccggaacgttacccgggacccgacggtacgacccggtaacgaccgtagtaacggtcgtaacccgtgtaacgtaccggttacgtaacgtcggtaggactaccggtacccgggtttacttacgtaccggtgtacggtcccggaacccggttcccggaacgggtaccccggggtacgggttacccctaccggggttacgtccgggttaaggtacccccggg

SEQ ID NO: 121315 - DNA, 720 bp, Homo sapiens
  misc_feature: GYAE6OF01A0341.41.2.A02.1.454.CMB.1.raw
  modified_base (179)..(179): a, c, t, g, unknown or other
  misc_feature (179)..(179): n is a, c, g, or t
  modified_base (364)..(364): a, c, t, g, unknown or other
  misc_feature (364)..(364): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgtcccactctcagggtncgagctgatgacaggtcgtggggctggaggtgaaggacgccgtggggcctacaggtgacgcctcctccgtgacaagtactttcgtaggactacggtagttaccaacgtccttactatactacacgtgggtcgcgaccgcggtccccgtggacgtagggtacgttggtagggtggagttacggggnttagggaactaccgtaaaccggtagtacggttggacgacacgtacgtccctacgtcgacgaccggtagtacgggttaccggcggtacggacgggttaccaacggtagtaggtacggtcggaacgacccggaacggtcccgaagtaccgggacccgacggtaccgataacgggtaccgaacctttacggacgtttacgaagttacgtccggaggtaccggaaccggttccgtttacccgtttacggttaccgtgggtacggacccgggtcccggtaaccccgggtagggggtaacccgggggtaccggggaaccttttaccggggacggttaacccgggttcgggtaaccccggggg

SEQ ID NO: 121316 - DNA, 809 bp, Homo sapiens
  misc_feature: GYAE6OF01AY06Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgccccactctcaggtgcagctgatgcagtcgtggggctgaggtgaggacgccgtcggggcctcgagtgacgtccttctccgtgaccaaaggtacctttcgtagggtaacttacgtaacgggtttaccaaaccggtactttacgttaataactaccgtacggttggggtcgaccgaaccgaccggtccccgtaggacgagggtacttggaggttggagtgggtatacggactaaccggaaacctaggaggtcggtaccgaacgcgacgtcccgtcgtacggacgaacgacgggttacgggttaccggacggggtacgtacggggtacccaacgggtagtacgggttaggtaccgggttaacgaacccggaacggggacccaaacggggaccgtccggtaaaccccgggtaccaacgttaacgggttacccgttaaacgtttacccgtcggtaaccggttaagtaacggttcccggagggtacccggtaacccggttaaccgggttttcccggtttaacgtttccgggtagggtcccggaccgggtaacccccggttcccccggggtaggggttaaccgggggggggtaacccgggggttacccctaacccggggtttaccgggttaaccggtaccggggttacccggg

SEQ ID NO: 121317 - DNA, 873 bp, Homo sapiens
  misc_feature: GYAE6OF01CCLS4.41.2.A02.1.454.CMB.1.raw
  modified_base (53)..(53): a, c, t, g, unknown or other
  misc_feature (53)..(53): n is a, c, g, or t
tcagtctatactatcacgaccggtgctcgatttagactcatctacagggggancatcacccagcaaccacatctgtcctctagagagtcccctgagagctccgttcctcaccagtggactggacctgggagatccctcttcttggtggcagcagccacgaggacgcccactcctcgtaggtgccgagcgtgagtcggacgtggtcggtgggggcctaggggtagggtacggaacgggaacgggtcccggtccgggggtacccctaccggtaaggttacggaaccggtccttcccgttacccgaggtacgaacgttccttagtaggtaacgtacgtacggtacgtaaccgttacttataattactacggacggtcgggtccgaccggaccgaccccggggtcccaagggaccgaagggttcgtaaggtcggtaggagggtaggtacgtaggaacccttaaccgaaacggggttaggacggtacgggtacaaccgtaggtaccgtaccctgtaccgacccgtaacggtacggttaaccggggtacggacgggtacggaccgggtaccgtagtaggacggttacggtcggtaccgggaccgacccgggaacccgacggtaccggaaccccgtaacccggaacgtaacccggtacggtaaccgttaactaacccggtaccggttaacggttaggtacggttcggtaacccggtacgggtaccccggttacccggtttaccggtttacccgttaacggttcgggttaacccggacccgggtacccgggtacccccgggtaagggggtacccccggggtaaacccggggttccccgggtaaccgggttacccgggtacggtttaccgggtacccggggg

SEQ ID NO: 121318 - DNA, 830 bp, Homo sapiens
  misc_feature: GYAE6OF01C7LVN.41.2.A02.1.454.CMB.1.raw
  modified_base (134)..(134): a, c, t, g, unknown or other
  misc_feature (134)..(134): n is a, c, g, or t
tcagtctatactatcacgaccggtgctcgatttagactcatctacagggggagcatcacccagcaaccacatctgtcctctagagagtcccctgagagctccgttcctcaccatggactggactggagatcctnttcttggtggcagcacgaccacgaggacgcccactctcgaggtgcagctgatgcagtcggtgggcgtaggaggtacggagggtacgccggtcgggcctacgaggtagaacgccgttcctccgagaaccgtaagttaccttcggagtaacgtaccggtacgttaacctaacgtacttacttaagtacctacgtacgggtcgggtaacgcccggtaccggtaccccgggtcccgtagggaccggtaacgggttacgttagggtacggtgggtaaagggttcgggtagttaacgggtacctaaacccggtaaacggtaagggtaggttcggtaacgaaccgcgttaccggcttacgacgaccgtaaacgggtacgggttaccgggtaccggacgggtacggtaaccgtaccaaacggtggtacggtaagggtcaaccgggaccgtaccggggaaccgtacggaccggacccgttacggaacctaacggttaaccggtaaccgttaaccgtaaccggtgtcccggttaagtaaccggttacgggaccggtaacggtacccggtttaccggttacccggttttctcgggtaaccggtacccggttacccggtacccgggtaccgggtaccgggggttacggggggttaaacccccgggtactttaggggtaaaccccggtgggttaacggtacccgggggg

SEQ ID NO: 121319 - DNA, 968 bp, Homo sapiens
  misc_feature: GYAE6OF01AJ3SN.41.2.A02.1.454.CMB.1.raw
  modified_base (178)..(178): a, c, t, g, unknown or other
  misc_feature (178)..(178): n is a, c, g, or t
tcagtctatactatcacgaccggtgctcgatttagactcatctacagggggagcatcacccagcaaccacatctgtccctctagagagtcccctgagagctccgttcctcaccatggactggacctggaggatcctcttcttggtgcagcagccacaggacgccccactctcaggtcncagctgatcgcagtcgtggggctggagggtggacggacggtccgtggggccctacgaggtcgaacgccttcctaccgtaggaccgtaaagtaccttacgtaggtaactaaccgtacgggttaccaaacggttaccttacgttacgttaactaacccgtaacggttcggggttcgaccggaccgtaaccgggtcccccgttaggaaccggtacggggtacgttacggtagggttggtaacggttagggacgttagggaactaacccgaaaccccgtaaagggtacgggtacggtacggaaccgaaccggtaccggtcccttaccggttacgaccgtaaccggtacgggttaacggggttaccccgaagggggtaacccggtacgggggttaacccgtaacccgtacggttacgggttaacgggtacggggttaaccggaacccgggtaaccccgggtacccggaaaccgggtaccgacccgggttaaccccgggtaccctaaccgggtaaccggttaacccgggtaaacccgtttaccccggtaacgggttaccgtttaaccgggtaaccgttaaccgggttacccggggaaacggtaacccggttacccggggttttaaccccgtttaccgtttccggtaccgggtttacccgggtacccgggtaacccccgggttaccccccggggtaccggggtaacccggggggggttaaaccccggggggttacccccgttaaccccgggggttaacccggtttaacccggggttccggggttaaccccccggggg

SEQ ID NO: 121320 - DNA, 846 bp, Homo sapiens
  misc_feature: GYAE6OF01AQNVT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactgggacctggaggattcctcttcgttggtggctagcacgccacgaggacgcccactctcgaggtcgcagctaggactcgcgtacgtcggtggggcgtggtagggtggacggaacggtccggtggggcctcggtaggtacgaacgtccttccgtaccgtcgactaacgtaccttcggacggtaacgtacggtaacggttaccaaacgttcttactaactacgtaacgtcggtgggtaccgcgtacgaccggtacccgtaggaccggacggttaccgtagggtacggtaggtaggtacgggtacgtacggtaccttaaccgtaaaccggtaaggtacggtacgtacgaacgtaccgtaaccgtcccgtacgtacggaccgtaacggtaacgggtaccgggttaccggacgggtaccggtaccgggtaaccgttacggtaaccgggtaggtaaccgggttcggtaacccggtaacccgggtaccggacccggaacggtaccggaccggttaacccggacccgtaacggtaccgttaaccgggttaacccttaccgggaacgttacggttaacggtacgttacccgggtaaggaacccgtaacccgggtttccggttaccttacgggtccgttacgccgggtaacccggtcccggggtacccgttacggggtacccgggggtacccgggttacggtaacccggtttcggtaaccggttcggggtaccccggg

SEQ ID NO: 121321 - DNA, 505 bp, Homo sapiens
  misc_feature: GYAE6OF02GEQ91.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggcacgagcacggtccacatggaacttaccgagtctgaagtctgaggacacggccgtttacttcgtgtgcgacgacccgcgtcggacgggggcctacgtacggtcgtagtaccgg

SEQ ID NO: 121322 - DNA, 523 bp, Homo sapiens
  misc_feature: GYAE6OF02IJZUI.41.2.A02.1.454.CMB.1.raw
  modified_base (340)..(340): a, c, t, g, unknown or other
  misc_feature (340)..(340): n is a, c, g, or t
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagcctggggcctcagtgaagctctcctgcaagacttctggatacaggttcaacgacttctatatacactggtgcgacaggcccctggacagggacttgagtggatgggatggatcaacctaagagtggtgacanagacctctgcacagaggttccgagggcgagggtcaccgatcgagtggtagacgacggaccacgagcacggtccacagtcggaacgttaccagtctagtaagtctgagacgacggaccgttacgttcgtgtcgcggacgacccgcgtcggaaccgggggcctacggtacggtcgtagtaccggg

SEQ ID NO: 121323 - DNA, 511 bp, Homo sapiens
  misc_feature: GYAE6OF02IOSSZ.41.2.A02.1.454.CMB.1.raw
  modified_base (397)..(397): a, c, t, g, unknown or other
  misc_feature (397)..(397): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcaaacctaagagtggtgacacagcctctgcacagaggttccagggcagggtcaccatgagtggtgacacggccacgngcacggtccacatacggaacttacagtctagaacgtctagagacgacggtccgtttacttcgtgtgcgacgacccgtgtcgggaacgggggcctacgtacggtcgtagtaccgg

SEQ ID NO: 121324 - DNA, 517 bp, Homo sapiens
  misc_feature: GYAE6OF02HT2HK.41.2.A02.1.454.CMB.1.raw
  modified_base (480)..(480): a, c, t, g, unknown or other
  misc_feature (480)..(480): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacgagacggttcagggcagggtcaccgatgagtggtgacacggccacgacgcacggtccacagtggaacttaccagtctagaagtctagaggacgacggtccgtttacttcgtgtcgcgacgaccccgngtcgggacgggggcctacgtacggtcgtagtaccggg

SEQ ID NO: 121325 - DNA, 507 bp, Homo sapiens
  misc_feature: GYAE6OF02HC7JK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggccacgagcacggtccacatggaacttaccagtctagaagtctgagacacggccgtttactcgtgtgcgacgaccccgcgtcgggaacgggggtcctacgtacggtctagtaccgg

SEQ ID NO: 121326 - DNA, 515 bp, Homo sapiens
  misc_feature: GYAE6OF02HIIPL.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactggtgcgacaggcccctggacagggacttgagtggatgggatggatcaaccctaagagtggtgacacgagcctctgcacagaggttccagggcagggtcaccgatgagtggtgacgacggccacgagcgacgtccacgatcggaacttaccgagtctagagtcgtgagacacggccgtttacttcgtgtcgcggacgacccgcgtcgggaaccgggggcctacgtacggtcgtagtaccgg

SEQ ID NO: 121327 - DNA, 501 bp, Homo sapiens
  misc_feature: GYAE6OF02FXEPH.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggccacgagcacggtccacatggaacttaccagtctgaagtctgagacacggccgtttactcgtgtgcgagacccgcgtcggacgggggcctacgtacggtctagtaccgg

SEQ ID NO: 121328 - DNA, 519 bp, Homo sapiens
  misc_feature: GYAE6OF02GU9XP.41.2.A02.1.454.CMB.1.raw
  modified_base (236)..(236): a, c, t, g, unknown or other
  misc_feature (236)..(236): n is a, c, g, or t
tcagtctatactatcacgaccggtgctcgatttagactcatctacagggggggtctcaggaggcagcgctctcgggacgtctccaccatggcctgggctctgctattcctcaccctcctcactcagggcacagggtcctgggcccagtctgccctgactcagcctgcctccgtgtctggttctcctggacagtcgatcaccatctcctgcactgggtccagcaatgacattggganatataaccttgtctcctggtatcaacaacatccaggcaaagccccaaactcatacttttgagtccagtgagcggccgtcaggtgtttctaatcgcttctctggctccaagtctggccacacggcctccctgtcgatctctgggctccggcctgaggacgaggctgactattactgcggctcatttacaactcttgagtacttgggtgttcggcgggaggactcgacctgaccgtccgtaggtccagcccaaggcctggccccctggtccactcctgttccccg

SEQ ID NO: 121329 - DNA, 507 bp, Homo sapiens
  misc_feature: GYAE6OF02FI9DV.41.2.A02.1.454.CMB.1.raw
  modified_base (470)..(470): a, c, t, g, unknown or other
  misc_feature (470)..(470): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttggagtggatgggatggatcaaccctaagagtggtgacacagcctctgcacagacggttccagggcagggtcaccatgagtggtgacgacggcacgagcacggtccacatggaacttaccagtctgaagtctgagacacggtcgttactcgtgtcgcgacgacccgngtcgggacgggggcctacgtacggtcgtaggtaccgg

SEQ ID NO: 121330 - DNA, 615 bp, Homo sapiens
  misc_feature: GYAE6OF02I2IE3.41.2.A02.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggngaggagcgtcggcgcagngagctctctgacacgtactctggacgtagtagttacgtaacgtacttactatatactacgtggtgcgacgacgccgtacgacgaacggagtgtaggtggagtggtagtagagtactaaccgtaagtagtagtagacgacgacgcgtcgtcgacgacgacgtacggtacggtacggacggacggtacgtaccgacgtaggtaggtaggtacggacgaccggaccgacgacgacgaccggtaccgacgaacgtacggtaaccgtaaccgtacgtacgtacgtaacgtacgtacgtacgacgtaccgtaccgttacgttcgtcgttacggtaccggtaccggtacccggtaccggtacgggtaccggggtaccggtaccggttaccggtacggtacgg

SEQ ID NO: 121331 - DNA, 528 bp, Homo sapiens
  misc_feature: GYAE6OF02G5Z0E.41.2.A02.1.454.CMB.1.raw
  modified_base (349)..(349): a, c, t, g, unknown or other
  misc_feature (349)..(349): n is a, c, g, or t
  modified_base (401)..(401): a, c, t, g, unknown or other
  misc_feature (401)..(401): n is a, c, g, or t
  modified_base (487)..(487): a, c, t, g, unknown or other
  misc_feature (487)..(487): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacaggggacttgagtggatgggatggatcaaccctaagagtggtgacacagcctntgcacagaggttccgagggcagggtcaccatgagtggtgacgacggccacgngcacggtccaacgataggaaccttaccgagtcgtagaacgtcgtagacgacgaccggtcgtttactcgttgtcgacgacgacccgngtacgggacgggggtcctacggtaccggtcgtaggtaccgg

SEQ ID NO: 121332 - DNA, 520 bp, Homo sapiens
  misc_feature: GYAE6OF02G6UMP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggcccctggacagggacttgagtggatgggatggatcaaccctaagagtggtgacacagcctctgcacagaggttccagggcgagggtcacgatgagtggtgacacggccacgagcgacgccacatcggaacttaccagtctagaagtcgtgacggacacggtccgttcgttcgtggtgcggacgacccgcgtacgggacgggggtcctacggtaccggtcgtacggtaccggg

SEQ ID NO: 121333 - DNA, 514 bp, Homo sapiens
  misc_feature: GYAE6OF02F4SB4.41.2.A02.1.454.CMB.1.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggccctggacngggacttgagtggatgggatggatcaacctaagagtggtgacacagcctctgcacagagttccagggcagggtcaccatgagtggtgacgacggccgacgagcgacggtccacatggaacttaccagttctagaacgtctgaggacaccggtccgtttactcgtgtcgacgacgacccgcgtcgggacgggggcctacggtacggtccgtagtaccgg

SEQ ID NO: 121334 - DNA, 577 bp, Homo sapiens
  misc_feature: GYAE6OF02JD0J9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgacttctatatacactggtgcgacaggcccctggacagggacttgagtggatgggatggatcgaaccctaagagtggtgacacagcctctgcacgagaggttccgagggacagggtcaccgatggagtggtgacgacggccacggagccgacggtccaacgagtacggaaccttaccgagttaccgtacgtaacgttcgtagaacggactaccgggtaccgtttaaccgttcgtcggttacggcggtaaccggaccccggtacgtacggggtaaccggggggacccttaaccggtaccgggttacggtacgtaaccggg

SEQ ID NO: 121335 - DNA, 512 bp, Homo sapiens
  misc_feature: GYAE6OF02GEYND.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccgatgagtggtgacacggccacgagcacggtccacatggaacttaccagtctgaagtctgaggacacggccgtttacttcgtgtgcgacgaccccgcgtcgggaacggggggcctacgtacgggtcgtaggtaccgg

SEQ ID NO: 121336 - DNA, 578 bp, Homo sapiens
  misc_feature: GYAE6OF02H8LQB.41.2.A02.1.454.CMB.1.raw
  modified_base (355)..(355): a, c, t, g, unknown or other
  misc_feature (355)..(355): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttcgtggatacgaggttacaacgacttctatatacactgggtgcgacacggccctggacgagggtacttggagtggagtgggatggatctaaccgtaagagtaggtgacacgngcctcgtgacacgagtaggttaccgagggcgaagggtcaccgagtagaggtgggtgacgaccggccgacgagccgacggtccaacgagtacggaaccttaccgagttctagaacgtcgtagacggacgtaccggtaccgttttacgttcgtggtacgcggaccgtacccgtggtacggggaaccgggggccttaacgggtaccggttaccgtaggtacccggg

SEQ ID NO: 121337 - DNA, 506 bp, Homo sapiens
  misc_feature: GYAE6OF02F3EAL.41.2.A02.1.454.CMB.1.raw
  modified_base (472)..(472): a, c, t, g, unknown or other
  misc_feature (472)..(472): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacgacggccacgagcacggtccacatggaacttaccgagtctgaagtctgaggacacggtcgtttacttcgtgtgcgacgacccgngtcgggacgggggcctacgtacggtctgtaccgg

SEQ ID NO: 121338 - DNA, 572 bp, Homo sapiens
  misc_feature: GYAE6OF02IPX48.41.2.A02.1.454.CMB.1.raw
  modified_base (336)..(336): a, c, t, g, unknown or other
  misc_feature (336)..(336): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgaagctctcctgcaagaccttctggatacaggttcaacgacttctatatacactggggtgcgacaggcccctggacaggggacttggagtggatgggatggatcaacccgtaagnggtggtgacacagcctctgcacaggacggttccgaggggcagggtcaccgagtggaggtggtgaccgaccggaccgacggacgccgaccgggtccacgacgtcggaaccttaccgagttcctagaacgttcgtaggacggaccgtaccggtccgtttacttcgtggttacgcggacgtaccccggcgtacgggggaaccgggggtccttaacggtaccgggtacctaggtacccgg

SEQ ID NO: 121339 - DNA, 539 bp, Homo sapiens
  misc_feature: GYAE6OF02ISDOV.41.2.A02.1.454.CMB.1.raw
  modified_base (492)..(492): a, c, t, g, unknown or other
  misc_feature (492)..(492): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggccacgacgcaccggtccacgagtggaaccttaccgagttctagaagttctaggaaggaccacgggtcccgttttacgttcgtggtcgcgaacgaccccgngtcggggaacggggggtccctaacggtaccggtacgtagtacccggg

SEQ ID NO: 121340 - DNA, 519 bp, Homo sapiens
  misc_feature: GYAE6OF02ITFK6.41.2.A02.1.454.CMB.1.raw
  modified_base (481)..(481): a, c, t, g, unknown or other
  misc_feature (481)..(481): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcacgatgagtggtgacacggccacgagcgaccggtccacgatggaaccttaccgagtcgtagaacgtctgaggacacggtccgtttacttcgtgtcgcgtacgacccgngtcgggacgggggtcctacgtacggtcgtagtaccggg

SEQ ID NO: 121341 - DNA, 512 bp, Homo sapiens
  misc_feature: GYAE6OF02JEOWC.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacagcctctgcacagaggttccagggcagggtcaccatgagtggtgacacggccacgagcacggtccacgatggaacttaccgagtctgaagtctagagacacggtccgtttacttcgtgtcgcgacgaccccgcgtcgggaacgggggtcctacgtacggtctaggtaccgg

SEQ ID NO: 121342 - DNA, 545 bp, Homo sapiens
  misc_feature: GYAE6OF02JG39Z.41.2.A02.1.454.CMB.1.raw
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccgagggcagggtcacgatgagtggtgacacggcacgagccgacggtccacgatcggaacttaccgagtctagaagtcgtaggaggacgaccggtccgttttacctcgttggtcgtcggacggaccccggtcgtacggggaaccggggggtcccgttaccggtacgggttaccgtaggtacccggg

SEQ ID NO: 121343 - DNA, 524 bp, Homo sapiens
  misc_feature: GYAE6OF02HQFAP.41.2.A02.1.454.CMB.1.raw
  modified_base (484)..(484): a, c, t, g, unknown or other
  misc_feature (484)..(484): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgacttctatatacactgggtgcgacaggcccctggacagggacttgagtggatgggatggatcaaacctaagagtggtgacacagcctctgcacgagacggttccgagggcgagggtcaccgagtgagtggtgacgacggcacgagcacggtccacgatcggaacttaccgagtctagaagtctagagacacggtaccgtttacttcgtgtcgcggacgaccccgngtacgggacgggggcctacggtacggtacgtaggtaccgg

SEQ ID NO: 121344 - DNA, 540 bp, Homo sapiens
  misc_feature: GYAE6OF02HWIRP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacgaggttcaacgacttctatatacactgggtgcgacaggcccctggacagggacttgagtggatgggatggatcaaacctaagagtggtagacacagcctctgcacaggtacggtccgagggcgagggtcaccgatgaggtggtgacgaccggccacgacgccacggtaccacgagtacggaacttaccagtcgtagaagtcgtagaacggacacggtccgtttacgttcgtggttcgcgacgcccgcgtcgggaccgggggtcctaaccggtacggtcgtaggtaccgg

SEQ ID NO: 121345 - DNA, 528 bp, Homo sapiens
  misc_feature: GYAE6OF02I0T06.41.2.A02.1.454.CMB.1.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (490)..(490): a, c, t, g, unknown or other
  misc_feature (490)..(490): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttntatatacactgggtncgacaggcccctggacagggacttgagtggatgggatggatcaaccctaagagtggtgaacacagcctctgcacagtaggtccgagggcagggtcacagtgagtggtgacgacggccacgagccaccggtaccacgacgtaggaaccttaccgagtacgtgaacgttcagacggactacggtccgtttactcgtgtagcgacgtacccgngtacgggacgggggcctacggtacggtctaggtaccgg

SEQ ID NO: 121346 - DNA, 561 bp, Homo sapiens
  misc_feature: GYAE6OF02JYDW9.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacagggacttgagtggatgggatggatcaacctagagtggtgacacagcctctgcacagacggtccgagggcagggtcaccgagtcgagtggtgacgacggccgacggacggcgaccggtccacgtagtacggaaccttaccgacgttacgtaggtaacgttcgtaggacggaccgtacggtcccgtttacgttccgtggtacgcggtacgaccccggtcgtacggggaaccgggggtccttaaccggtacggtcgtacgtaccggg

SEQ ID NO: 121347 - DNA, 563 bp, Homo sapiens
  misc_feature: GYAE6OF02IWPTA.41.2.A02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (522)..(522): a, c, t, g, unknown or other
  misc_feature (522)..(522): n is a, c, g, or t
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgnggtgnggaagcctggggcctcagtgaagctctcctgcaagacttctggatacaggttcaacgacttctaatatacacgtggtgacgacagggcccctggacaggacttgagtggatggatggatcaacctaagagtggtagaacgacagcctcgtagcgacgagacggttccagggaccgtagggtaccaccgtatacggaggtcggtagacgaccggaccacgacgaccgaacgtccacagtacggaacttaccgacgtacgtcgtaacgtcgtagacgtacgaccggtccgtttaacttcgtggtacgacggacgtaccccgnggtaccgggacggggacctacggtacggtcgtaggtaccgg

SEQ ID NO: 121348 - DNA, 547 bp, Homo sapiens
  misc_feature: GYAE6OF02JFV3N.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatccccttcttggtggcagcagccacaggagcccactctcaggtgcagctgatgcagtctggggctgaggtgaggagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccgatgagtggtgacgacggccacgagcgaccggtccacgagtacggaacttaccgagtctaggaacgtcgtaggacggacgacggtcccgtttacttcgtggtcgccgacgaccccggtcgtcgggtaaccggggggccttaccggtaccgggtacgtacggtacgtaccggg

SEQ ID NO: 121349 - DNA, 557 bp, Homo sapiens
  misc_feature: GYAE6OF02FX5KC.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggcccctggacgagggacttgagtggagtgggatggatacaacctaagagtggtgacacagcctctcgcacgagacggtccgagggcgagggtcacgagtgacggtggtacgacgacggccacggacgccgaccggtccacgagtacggaaccttaccgacgtcgtagaagtcgtaggacggacgacggtccgtttacgttcgtgttcggcggtacgccccggtcgtacggggaccgggggtcctaccggtacggtacgtacggtaccggg

SEQ ID NO: 121350 - DNA, 593 bp, Homo sapiens
  misc_feature: GYAE6OF02IACJ6.41.2.A02.1.454.CMB.1.raw
  modified_base (252)..(252): a, c, t, g, unknown or other
  misc_feature (252)..(252): n is a, c, g, or t
  modified_base (546)..(546): a, c, t, g, unknown or other
  misc_feature (546)..(546): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggagggtgagggaagccgtggggcctcgagtgaagctcctctgcaagtacttcgnggatacgaggttcaacgtacttctatatacacgtggtcgcgacacggccctggacgagggtacttggagtggagtgggatggactaccgaaacctaaggagtgtagacacacgtcctcgtcgacacgacgtacggttaccgagggcgacgggtacaccgagtcggaggtggtacgacgaccggaccgacgacgaccgacggtccaacgagtacggtaaccttaccgagtctagtagtcgtaggaacgtacgtaccggtaccgtttacgttcgtggtcgacggaccgtaccccgnggtacggggaaccgggggtcctacggtaccggtacgtaggtaccggg

SEQ ID NO: 121351 - DNA, 587 bp, Homo sapiens
  misc_feature: GYAE6OF02JAGBI.41.2.A02.1.454.CMB.1.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccattctcaggtgcagctgatgcagtctggggctgaggtgaggagccgtggggcctcagtgaagctctcctgcaagacttctggatacaggttcaacgacttctatatacactgggtgcgacaggcccctggacagggacttgagtggatgggatggatacaaccgtaagagtggtagacanacgcctcngccagagacggtccgagggcgaggtcacagtggagtcggtgacgacggacccacggacgccgaccgggtccaacgtacgtacggtaaccttaccgacgttcgtagtaacgtcgtaggaacggaccgtaccgggtcccgttttacgttccgttacggtcggtacggtaaccggtaccccggcggttaccggggaccggggggtacccttacggtaccggtacgtacggtacccggg

SEQ ID NO: 121352 - DNA, 527 bp, Homo sapiens
  misc_feature: GYAE6OF02GO0I0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacactgggtgcgacaggcccctggacagggacttgagtggatgggatggatcgaaccctaagagtggtgacacgagcctctgcacagacggttccgagggcagggtcaccgatgagtggtgacgacggccacgagccgacggtccacagtacggaacttaccgagtcgtagaagtcgtagaggacacggtccgtttactcgtgtcgcgtaccgacccgcggtacgggaccggggcctacgtacggtctagtaccgg

SEQ ID NO: 121353 - DNA, 576 bp, Homo sapiens
  misc_feature: GYAE6OF02F1BR0.41.2.A02.1.454.CMB.1.raw
  modified_base (353)..(353): a, c, t, g, unknown or other
  misc_feature (353)..(353): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgaagctctcctgcaagacttctggatacaggttcaacgacttctatatacacgtgggtgcgacacggcccctggacagggacttgagtggatgggatggatcgaacctaagagtggtagacacagcctntgcacaggacggttccgagggcagggtcaccagtgagtggtacgacgacggaccacgacgccgacggtccacgagtacggaaccttaccgagtacgtaggaacgttcgtaggaacggtaccgaccgggttccgtttaccgttcgttggtacgaccggaccgaccccggtggtacggggaaccggggggtcccttaacggtaccggttacgtacggtacccggg

SEQ ID NO: 121354 - DNA, 534 bp, Homo sapiens
  misc_feature: GYAE6OF02F7GWU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacagcctctgcacgagaggttccgagggcagggtcaccatgagtggtgacgacggccacgagccgacggtccacgatacggaacttaccgagtctgtaacgtctgacggacgacggtccgtttacttccgttggtcgcggtacgaccccgtcgtcggggaaccgggggtcctacggtaccggtcgtaggtaccgg

SEQ ID NO: 121355 - DNA, 516 bp, Homo sapiens
  misc_feature: GYAE6OF02HN6NB.41.2.A02.1.454.CMB.1.raw
  modified_base (279)..(279): a, c, t, g, unknown or other
  misc_feature (279)..(279): n is a, c, g, or t
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacagggacttgagtggatgggatggatcaacctaagagtggtgacacagcctctgcaacagaggttccagggcagggtcaccgatgagtggtgacgacggccacgagcacggtccacatggaacttcgagtctagagtcgtgaggacacggtccgtttattccgtggtcgcgtacgacccgcgtacgggaaccgggggccgtacgtaccggtcgtagtaccgg

SEQ ID NO: 121356 - DNA, 508 bp, Homo sapiens
  misc_feature: GYAE6OF02GYJS4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccgatgagtggtgacacggccacgagcacggtccacatggaacttaccagtctgaagtcgtagacgacacggtccgtttactcgtgtcgcgacgcccgcgtcgggacgggggcctacgtacggtctagtaccgg

SEQ ID NO: 121357 - DNA, 595 bp, Homo sapiens
  misc_feature: GYAE6OF02GG86V.41.2.A02.1.454.CMB.1.raw
  modified_base (482)..(482): a, c, t, g, unknown or other
  misc_feature (482)..(482): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcagtgaagctctcctgcaagacttctggatacaggttcaacgtacttctatatacacgtgggtgcgacacggcccctggacgagggacttgagtggagtgggatggataccgaaacccgtaagagtggtgactacacgtcctctgacacgagtacggttccgagggcgagggtcaaccgagtgaggtggtagacacgggaccacggacgccgacggtccaacgtagtacggaaccttaccgagttccgtaggtaacgttcgnggaacggaccgaccgggttccgttttaccgttcgtcggtacggccggtaaccgaccccggtaggtacggggaaccgggggtccctaacggtaccggtccgtacggtacccggg

SEQ ID NO: 121358 - DNA, 515 bp, Homo sapiens
  misc_feature: GYAE6OF02HSNN8.41.2.A02.1.454.CMB.1.raw
  modified_base (353)..(353): a, c, t, g, unknown or other
  misc_feature (353)..(353): n is a, c, g, or t
  modified_base (476)..(476): a, c, t, g, unknown or other
  misc_feature (476)..(476): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcanagaggttccagggcagggtcaccatgagtggtgacacggccacgagccacggtccacatcggaacttaccgagtctgaagtcgtgagacacggaccgtttacttcgtgtcgcgacgaccccgngtacggacggggggcctacggtacggttcgtagtaccgg

SEQ ID NO: 121359 - DNA, 570 bp, Homo sapiens
  misc_feature: GYAE6OF02HYYI4.41.2.A02.1.454.CMB.1.raw
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (526)..(526): a, c, t, g, unknown or other
  misc_feature (526)..(526): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgtacttctatatacactgggtgcgacacggccctggacgagggacttggagtggagtggagtggatcaaccgtaagagtggtgacacngcctcgngcacgagtacggttccgaggggtcacggggtcaccgagtaggtaggtaggtcgacgaccggtccgacggacggccgaccgggtccaacgagtacggaaccttaccgagtcgtagtaacgttcgtgaaggaccgtacggtcccgttttactcgtgtcggacgacggaccccgngtacggggaccgggggtccctacggtacggttccgaggtaccgg

SEQ ID NO: 121360 - DNA, 512 bp, Homo sapiens
  misc_feature: GYAE6OF02GAREM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagacggttcagggcagggtcaccgatgagtggtgacacggccacgagcacggtccacatcggaacttaccgagtctagaagtcgtagagacacggtccgtttacttcgtgtgcgacgacccgcgtcgggacgggggcctacgtacggtcgtagtaccgg

SEQ ID NO: 121361 - DNA, 534 bp, Homo sapiens
  misc_feature: GYAE6OF02H7C1F.41.2.A02.1.454.CMB.1.raw
  modified_base (340)..(340): a, c, t, g, unknown or other
  misc_feature (340)..(340): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctctgcaagacttctggatacaggttcaacgacttctatatacactggtgcgacaggcccctggacagggacttgagtggatgggatggatcaacctaagagtggtgacacngcctctgcacagacggttcgagggcagggtcaccgagtgagtggtgacgacggccgacgagcgacggtccacgagtacggaaccttaccagtctagaagtcgtaggacggacgacggtaccgtttacgttcgtgtcgcgaccgtacccgcgtacgggaccgggggccgttaccggtacggtccgtaggtaccgg

SEQ ID NO: 121362 - DNA, 586 bp, Homo sapiens
  misc_feature: GYAE6OF02IYO3D.41.2.A02.1.454.CMB.1.raw
  modified_base (399)..(399): a, c, t, g, unknown or other
  misc_feature (399)..(399): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggaccgagggacttggagtggagtgggatggatcgaaccctaagagtggtgacacagcctctgcacgagtacggttccgagggcgagggtccaccgatggaggtggngacgacggccacgacgcgaccggtccacgagtacggaacttaccaagtctagtaacgttcgtacggacggaccgtaccgggtaccgttttaccgttccgttggtcggaccggaaccggtacccccggtcggttacggggaacccggggggtcccgtaaccggtaccggttaccgtacggtacccggg

SEQ ID NO: 121363 - DNA, 519 bp, Homo sapiens
  misc_feature: GYAE6OF02H2M2F.41.2.A02.1.454.CMB.1.raw
  modified_base (265)..(265): a, c, t, g, unknown or other
  misc_feature (265)..(265): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttntatatacactgggtgcgacaggcccctggacagggacttgagtggatgggatggatcaacctaagagtggtagacacagcctctgcacgagaggttccgagggcagggtcaccatgagtggtgacgacgccacgagcacggtccacagtggaacttaccgagtcgtagaagtctagagacacggtccgtttacttcgttgtcgcgacgacccgcgtcgggaacgggggtcctacggtacggtcgtaggtaccgg

SEQ ID NO: 121364 - DNA, 553 bp, Homo sapiens
  misc_feature: GYAE6OF02G40CW.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcgaacccgtaagagtggtgacacgagcctctgcacgagacggttccgagggcagggtcaccgatgagtggtgacgacggccacgacgcgacggtccacgactacggaaccttaccgagtcctagaacgttcgtacggaaggaccaccggtccgtttacgttcgtggtcgacggtacgaccccgcgtacggggaccgggggtacctacggtaccgggtacgtacggtaccggg

SEQ ID NO: 121365 - DNA, 636 bp, Homo sapiens
  misc_feature: GYAE6OF02IL6RG.41.2.A02.1.454.CMB.1.raw
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggctcagtgaagctctctgcaagacttctggatacaggttcaacgacttctatatacactggtgcgacaggcccctggacaggacttgagtggatgggatggatcgaacctaagagtggtgacgacgagcctacgtgacacgacgaggttccgagggtacgacgggtcaccgacgttaggacggttagggtcgaacgacgggacccaacggacgaccgaaccggtaccaaccgtagtacgggtaaaccttaccgaacgttacgtacgaacgttacgtacgaacgggaaccgtaacggacccgtttttacgttccgttaacgggttcggtacccggtaacggtaaccccccggtcggttaccgggggtaacccgggggggtcccttaaccgggttaacccggttaccggttaacggttaacccgggg

SEQ ID NO: 121366 - DNA, 604 bp, Homo sapiens
  misc_feature: GYAE6OF02JCL4H.41.2.A02.1.454.CMB.1.raw
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
tcagtctatactatcacgaccggtgctcgatttagactcatctacagggggagacatccacccagcaaccaccatctgtcctctagagagtcccctgagagctccgttcctcaccatggtactggacctggaggatcctcttcttggtcggcaggcagccacaggagccactctcaggtgcagctgatgcgagtctggggctgaggtgaggaagccgtggggcctcgagttgaacgctctccgtgcaagtacgttcnggatacaggttcaacgacttctanatacacgtgggtnacggacaggccctgacgagggacttgagtcggatgggatggataccaacccgtaaggngtacggtanaaccgagtagcccttgagaccaacgaggtaccgttaccgacgggtcgaacggtcgaaccgagtcggacggtaggttacgacgtacggaccgaacgtacgacgacggtccacgagtacggaaccttaccgacgttacgtaggtaacgttcgtaggacggacgacggtaccgttacgttccgttgtcgacggtaccgtacccgcgttacgggaccggggtctacggtcgtacggtacgtaccggg

SEQ ID NO: 121367 - DNA, 943 bp, Homo sapiens
  misc_feature: GYAE6OF02JHJ30.41.2.A02.1.454.CMB.1.raw
tcagtctatactatcacgaccggtgctcgatttagactcatctacagggagcatcacccagactaaccacgatcgtgtcctctagacgaggtcccctgacgagctaaccgttcctccaccatggactggacctggaggatccgtcttcttggtggcagcgacgccactaggagcccacgtcgtacgagggtcgcagccgttgagtcgcgagggtccgtagggggcctgggtacggtcggtacggtaaccggtccgttacgggggccccttaccgaacggttacgggaaaccggtcttcccggtttccccgtttcccggtaccggaaacggtaccccttttccggtacgggtaaccgttaaaccggaacgggtttaccccaaaacccggttacccgttttaaccggtaaacttaaccgttaaccctaaccggtttcggggggtccgttaccggggaacccgtaaccggggtcccccccgtttaggggaaccgtaaacgggggtaacccttttaacggtaccggttacgggtaacggttacgggggtaacgttacgggtaaccggttaccggtaaaacccccgggtttaaaggtaacggggtttaccggggttaacgggaacccgtaaccgtaaacggtacccgttacgtaccggacgtaaccgaggttaacgggtttccgaacggggtccgtaacgggggttaccaacccgtagttacgggaggttacggggtacgaccgaaccgggacccgtaacggacgaccgacggtcccaacgtacgtacgggaacctttaacgacgttcgtacggtaacgtcgtaggacggtaacgtaccggttaccgttttaccgtcgttacggttacggacgtaccggaccccggaggttaccgggggtaacccgggggtccttaaccggttaccgggttacgtacgggtacccggg

SEQ ID NO: 121368 - DNA, 592 bp, Homo sapiens
  misc_feature: GYAE6OF02HZ2X4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgaagctctcctgcaagacttctggatacaggttcaacgacttctatatacactggtgcgacaggcccctggacagggacttgagtggatgggatggatcgaaccctaagagtggtagacacagctctgcacagaggttcagggcgagggtcaccgagtagagtggtagacgaccggaccacgagaccgacggtcccacgagtaggaaccgtttaaccgagtaccgtacgaacgttccgtaggaagggaccgtacgggacccgtttttaccgtttcgttacggttcggtccggaacggtacccccgccggtacggggaacccgggggggtacccgttaaccggtaccgggttaccgtacggttaacccgggg

SEQ ID NO: 121369 - DNA, 542 bp, Homo sapiens
  misc_feature: GYAE6OF02GGGTF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcaacctaagagtggtgacacagcctctgcacagaggttccagggcagggtcaccgagtgagtggtgacgacgggccacggagccgacggtccacgacgtcggaaccttaccgacgtacgtacgtaagtctaggacgacgacggtccgtttacgtcgtggtcgccgacggtaccccgcgtacggggaccgggggtacctacggtacggttcgtaggtaccggg

SEQ ID NO: 121370 - DNA, 532 bp, Homo sapiens
  misc_feature: GYAE6OF02GHHQA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactggtgcgacaggccctggacagggacttgagtggagtgggatggatacgaacccgtaaggagtggtgaacacgagtccctcgtgcacgaggtacggttccgagggcagggtcaccgatggagtggtgacgacggccacgagcgacgccacagtcggaacttaccgagtctagaagtcgtagagacgaccggtccgtttacgtcgtggtcgcgtacgacccgcgtacgggacggggcctacggtcggtacgtagtacgg

SEQ ID NO: 121371 - DNA, 580 bp, Homo sapiens
  misc_feature: GYAE6OF02G3H1Q.41.2.A02.1.454.CMB.1.raw
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactgggtgcgacacggcccctggacgagggtacttggagtggatggggatggataccaacctaaggagttggtanaacacgagccctntcgcacgaggtacggttccgagggacgacgggtacaccgatggagtggtgacgaccggaccgacgagcgaccggtccacgacgtacggtaacctaccgtacgtctacgtaacgttcgaggaacggacgaccggtaccgtttacgttcgtcgttcgaccgcggaccccgtcggtacgggaccgggggtacctaccgggtacggtacgtacggtaccggg

SEQ ID NO: 121372 - DNA, 556 bp, Homo sapiens
  misc_feature: GYAE6OF02IVLYV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgtacttctatatacactgggtgcgacaggcccctggacagggacttgagtggagtggatggatcaacctaagagtggtagacacagtcctctcgcacgagtacggttccgagggcgagggtcaccgagtgagtggtagacgacggccacgacgaccgacggtccaacgagtacggaaccttaccgagttcgtagaacgttcgtaggacggaccgacggtaccgtttacttcgtggtcgacggacgtaccccggcgtcgggaaccgggggtcctacggtacggtaccgtaggtaccgg

SEQ ID NO: 121373 - DNA, 729 bp, Homo sapiens
  misc_feature: GYAE6OF02H8EEW.41.2.A02.1.454.CMB.1.raw
  modified_base (164)..(164): a, c, t, g, unknown or other
  misc_feature (164)..(164): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
tcagtctatactatcacgaccggtgctcgatttagactcatctacagggggaggcatcacccagcaaccacatctgtcctctagagagtcccctgagagctccgttcctcaccatggactggacctggaggatcctcttcgttggtggcagcagccacaggacnccctactctcaggtgcagctgatgcgagtcgtggggctggaggtgaggaagccgtggggcctnagtgaacgctctccgtgcaaaggtcttcgnggtaattacgacgggtttacaaacgtacctttactaattagtaaacctacgttaggggttcgccggaaccgtaacggtccccgtacgggaaaccgaagggggtaaaccgtttggaaaggttcgggaaggtttggggggaactttagggggaaccttaaaccgttaaaaccccgtaaaaggggtacgggttacgggtaacgaaccgtaaccgtaccgtaccgttaccgtacggaccgtaaccgggaacggtaccgggtaccggaacgggtacggaacgggtacctaacgtagtaggtagtacggacggaacgaacggacgacgacgacgacgacacgtagtacgtaactacgacgtacgtagtacgtacgacggaacgtacgtaccggtaccgttacgttcgtggtacgaccggaccgtaccggtacggtacgggaaccggggtaccgtacggtacggtacgttacggtacgg

SEQ ID NO: 121374 - DNA, 656 bp, Homo sapiens
  misc_feature: GYAE6OF02G3OHL.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacacgtgggtgcgacacggcccctaggacagggacttggagtggagtggggatggactacgaaacccgtaaggagttaggtagaacgtacgagtccctctacgccacgtaggacgggttacccgaggggccgaaggggttccaacgagttggaggtgggtacggtaccgaccgggtacccgacggacggaccgtaaccgggtaccaaccgtaagtcggtaaaccttaccgtaacgtaccgtaggaacgttaccgtaggaaacggtaaccgaccgggttacccgttttaacgttaccgtcggtcggacggtaaccggaccccggtacggtacgggggtaaccggggggtaccttaaccgggtacggttaccggtaggtaacccggg

SEQ ID NO: 121375 - DNA, 596 bp, Homo sapiens
  misc_feature: GYAE6OF02G0IME.41.2.A02.1.454.CMB.1.raw
  modified_base (355)..(355): a, c, t, g, unknown or other
  misc_feature (355)..(355): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttctggatacaggttacaacgtacttctatatacactgggtgcgacacggccctggacagggacttgagtggagtgggatggatcaaccgtaagagtggtgacgacagcctntcgcacgaggacggttccgagggcgagggtcaccgagtgaggtggtacggaaccgaccggaccgacgacggaccgaccggtccacgagtacggtaaccttaccgtaggtccgtagtaacgttcgtaggaacggacgaccgggtaccgtttacgtttcgtcgtcggaccggtacgaccccggtacggtacgggggtaaccggggggtccgttaaccgggtacggttacggtacggtaccggg

SEQ ID NO: 121376 - DNA, 521 bp, Homo sapiens
  misc_feature: GYAE6OF02H0WHG.41.2.A02.1.454.CMB.1.raw
  modified_base (480)..(480): a, c, t, g, unknown or other
  misc_feature (480)..(480): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgaagctctcctgcaagacttctggatacaggttcaacgacttctatatacactggtgcgacaggcccctggacagggacttgagtggatgggatggatcaaccctaagagtggtgacacagcctctgcacagaggttccgagggcagggtcaccatgagtggtgacacggccacggacgcgacggtccacagtggaacttaccagtcgtagaagtcgtgaggacacggtaccgtttacttcgtgtcgcgacgaccccgngtacgggacggggggccctacggtaccggtcgtagtaccgg

SEQ ID NO: 121377 - DNA, 517 bp, Homo sapiens
  misc_feature: GYAE6OF02FSUDE.41.2.A02.1.454.CMB.1.raw
  modified_base (478)..(478): a, c, t, g, unknown or other
  misc_feature (478)..(478): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacgacggccacggagcgacggtccacgatggaacttaccgagttctgaagtctagagacacggtccgtttactcgtgtcgcgacgaccccgngtcgggaccgggggtcctacggtacggtcgtagtaccgg

SEQ ID NO: 121378 - DNA, 559 bp, Homo sapiens
  misc_feature: GYAE6OF02HU3ZZ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgagctctctgcaagacttctggatacaggttcaacgacttctatatacactgggtgtcgacaggcccctggacagggacttgagtggagtgggatggatcaaccctaagagtggtagacacgagcctcgtgcacagacggttcgagggcgagggtacaccagtgagtggtggacgacggccacgagccgacggtccacacgtacggaacttacccgagttaccgtgaagttcgtagaggtaccacgggtccgttttacgttcgtggttcgtacgacgtaccccggcgtacggggaaccggggggtccgtaaccggtaccggttcgtacggtacccggg

SEQ ID NO: 121379 - DNA, 564 bp, Homo sapiens
  misc_feature: GYAE6OF02I1EWT.41.2.A02.1.454.CMB.1.raw
  modified_base (281)..(281): a, c, t, g, unknown or other
  misc_feature (281)..(281): n is a, c, g, or t
  modified_base (339)..(339): a, c, t, g, unknown or other
  misc_feature (339)..(339): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgagctctcctgcaagacttctggatacaggttcaacgtacttctatatacactgggtncggacacggcccctggacagggtacttggagtggagtgggatggatcaaaccgtaagngtggtgacacagcctcgtgacacgagacggttccgaggcgagggtcacgagtgagtggtcgacgaccggaccgacgacgccgacggtccacgagtacggtaacttaccgtagtacgtagtaacgtcgtaggaacgtaccgacggtccgttttactcgttgtcgacggacgaccccggtggtacgggaaccgggggtcctaacggtacggttacgtacggtaccgg

SEQ ID NO: 121380 - DNA, 510 bp, Homo sapiens
  misc_feature: GYAE6OF02HDTHD.41.2.A02.1.454.CMB.1.raw
  modified_base (470)..(470): a, c, t, g, unknown or other
  misc_feature (470)..(470): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagagtccgaggcagggtcaccatgagtggtgacgacggccacgagcgacggtccacagtgaacttaccagtctagaagtctgaggacacggccgtttacttcgtgtgcgacgcccgngtcgggaaccggggggcctacggtacggtcgtagtaccgg

SEQ ID NO: 121381 - DNA, 613 bp, Homo sapiens
  misc_feature: GYAE6OF02JIEQY.41.2.A02.1.454.CMB.1.raw
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccataggagcccactctcaggtgcagctgatgcagtcgtggggctgaggtgaggaagccgtggggcctcgagtgaagctctcctgcaagacttctggatacaggttacaacgtacttctatatacagtgggtncgacacggccctggaccgagggacttggagtggagtggatggatacgaacctagagtggtgacacagcctacgtgcacagtacggttccgagggcacgggtaccaccgagtagaggtggtacgacgaccggaccgacggacgaccgaccggtaccacgaacgtacggtaacttaccgagtactacggtaacgttcgtaaggaacggacgtaaccgggttccgttttaacgttacggttcggtacggaccgggtaccgacccccggtaggtaccggggggaaccgggggtcccttaaccgggtaccgggttaccgtacgggtacccggg

SEQ ID NO: 121382 - DNA, 535 bp, Homo sapiens
  misc_feature: GYAE6OF02HU5H9.41.2.A02.1.454.CMB.1.raw
  modified_base (336)..(336): a, c, t, g, unknown or other
  misc_feature (336)..(336): n is a, c, g, or t
  modified_base (386)..(386): a, c, t, g, unknown or other
  misc_feature (386)..(386): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggcctcagtgaagctctcctgcaagacttctggatacaggttcaacgacttctatatacactgggtgcgacaggccctggacagggactgagtggatgggatggatcaacccgtaagacgtggtnaacacagcctctgcacagacggttccagggcgagggtcacgatgagtggngacgacggccagagcgacggtccacgagtcggaacttaccgagtctagaacgtcgtagagacgacgtccgtttacttcgtggtcgtcggacgtaccccgtcggtacgggaaccgggggtccttaccggtacggtccgtaggtacccggg

SEQ ID NO: 121383 - DNA, 546 bp, Homo sapiens
  misc_feature: GYAE6OF02G474Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctagagtggtgacacagcctctgcacgagacggttccgagggcgagggtcaccgtagtgagtggtagacgacggccacggagcaccggtccacgagtaggaaccttaccgagttcctaggaatcgtagaggaccgacggtccgtttacttcgtggtcgcggacgaccccggtggtacgggaaccggggggtcctacggtaccggtacgtacggtacccggg

SEQ ID NO: 121384 - DNA, 692 bp, Homo sapiens
  misc_feature: GYAE6OF02G249F.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttcgtggatacaggttcaacgacttctatatacactggtgcgacacggccctggacagggacttgagtggagtgggatggatacccgaaaccgtaagaggtaggtagacacgagtccctgtagaccgacgaggtacggttaccgacgggcgtagggtaccaaccgtagtcggaggtcgggtacggaccgtaccgggaccgaacggacggtaccgaaccgggtacccaacgtaacgttacgggtaaaccctttaccggaacgttccgttaaggtaacgtttacccggtaggtaaacgggaaccgtaccgggttacccgtttttaaccgtttaccggttgggttaccggtacccggtaaccgggtaccccccggttacggggttaccgggggaacccgggggggttacccttaacccgggttaaccgggtttaccggtaacggttaccccggggg

SEQ ID NO: 121385 - DNA, 522 bp, Homo sapiens
  misc_feature: GYAE6OF02GJ3BZ.41.2.A02.1.454.CMB.1.raw
  modified_base (483)..(483): a, c, t, g, unknown or other
  misc_feature (483)..(483): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaagacttctatatacactggtgcgacaggcccctggacagggacttgagtggatgggatggatcaacccgtaagagtggtgacacagcctctgcacagaggttccagggacagggtcacatgagtggtgacgacggccgacgacgcacggtccacgatcggaacttaccgagtctagaagtctgaagacgaccggtaccgtttacgtcgtgtgtcggacgaccccgngtcgggaacgggggtcctacgtaccggtcgtagtaccgg

SEQ ID NO: 121386 - DNA, 516 bp, Homo sapiens
  misc_feature: GYAE6OF02FWOYE.41.2.A02.1.454.CMB.1.raw
  modified_base (280)..(280): a, c, t, g, unknown or other
  misc_feature (280)..(280): n is a, c, g, or t
  modified_base (480)..(480): a, c, t, g, unknown or other
  misc_feature (480)..(480): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtggggcctcgagtgaagctctcctgcaagacttctggatacaggttcaacgcttctatatacactgggtncgacaggcccctggacagggacttgagtggatgggatggatcaacctaagagtggtgacacagcctctcgcacagaggttccagggcagggtcaccgatgagtggtgacgacggccacgacgccgacggtccacgagtacggaacttaccgagtctgaagtctagagacacggtcctttactcgtgtcgcgacgacccgngtacgggacggggcctacgtacggtcgtagtaccgg

SEQ ID NO: 121387 - DNA, 752 bp, Homo sapiens
  misc_feature: GYAE6OF02HX33L.41.2.A02.1.454.CMB.1.raw
  modified_base (699)..(699): a, c, t, g, unknown or other
  misc_feature (699)..(699): n is a, c, g, or t
tcagtctatactatcacgaccggtgctcgatttagactcatctactagggggtagcgatcacccagcgaaccacctatcctggtcctcctaaggacgtacgtccccttggagagctccgttcctcaccatggactggaccgtggaggactcctcgttactttggggtggcgaggcctagggttcccctacgtagggacgtacccttaacgtacgttcgtacgggtgcgaggcgttggactggcaggtcgtggggtcttgggaggtgtagggaacgccgtcggggccggtccaggtgaacgtcttcctcgtgcaagaccttctgggattacacggtttacaaacgtacttcgtattatacgtacgtcgggtcgcggacaggccccgtgggacggtacgggacgttaggagggttcgggactagggattagggagtacgaacccgtaaggaaggtgggtagtaacacgtagtccgttcgtacgcgtacgtacggtaacgggtttccgagggtccgaacgggtactacccgtagtacggaacggtacggacggaaccgaacggaacccgtacgacgtaccgtaacggttacccaaacgtacgtaacggtaacgtacccgtaagtaccgacggtaacgtacgtagaacggtactaccggttaccgtttacgttacgtggttcggacggtaacgggtaccccgnggttcggggaaccgggggtcctaccggtacgggtccggtacggtaacccgggg

SEQ ID NO: 121388 - DNA, 540 bp, Homo sapiens
  misc_feature: GYAE6OF02F3R6I.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcgaacctaagagtggtgacacgagcctctgacacgagacggttccgagggcagggtcaccgatgagtggtgacgacggccacgacgcgacggtaccacagtcggaaccttaccgagtacctagaacgtcgtaggagaccgacggtcccgttacgttcgtgtcgacggacgaccccgcgtacgggaccgggggtacctacggtaccggtcgtaggtaccgg

SEQ ID NO: 121389 - DNA, 589 bp, Homo sapiens
  misc_feature: GYAE6OF02JKLXB.41.2.A02.1.454.CMB.1.raw
  modified_base (246)..(246): a, c, t, g, unknown or other
  misc_feature (246)..(246): n is a, c, g, or t
  modified_base (342)..(342): a, c, t, g, unknown or other
  misc_feature (342)..(342): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttcnggatacaggttcaacgtacttctatatacacgtgggtgcgacacggcccctggacagggtacttggagtggagtgggatggatacgaaccgtaagngtaggtagacacgagcctcgtgcacaggtacggttccgagggcgagggtcacgtagtggaggtggtacgacgacggccgacgacgccgacggtccacgacgtacggtaaaccttaccgagtacgtagtaacgtcgtaggaacggacgtaccgggtaccgtttacgttacgttcggtacgaccggtaccgaccccggtacgtacggggaccgggggtacctaccggtaccggtaccgtaggtacccgg

SEQ ID NO: 121390 - DNA, 514 bp, Homo sapiens
  misc_feature: GYAE6OF02FT29E.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcaaccctaagagtggtgacacagcctctgcacagaggttccagggcagggtcaccatcgagtggtgacgacggccacggagcacggtccacatcggaacttaccagtctagaagtctagagacgacggtccgtttacttcgtggtgccgacgaccccgtgtcgggacgggggcctacgtacggtctagtaccgg

SEQ ID NO: 121391 - DNA, 538 bp, Homo sapiens
  misc_feature: GYAE6OF02GC9GL.41.2.A02.1.454.CMB.1.raw
  modified_base (343)..(343): a, c, t, g, unknown or other
  misc_feature (343)..(343): n is a, c, g, or t
  modified_base (399)..(399): a, c, t, g, unknown or other
  misc_feature (399)..(399): n is a, c, g, or t
  modified_base (436)..(436): a, c, t, g, unknown or other
  misc_feature (436)..(436): n is a, c, g, or t
  modified_base (528)..(528): a, c, t, g, unknown or other
  misc_feature (528)..(528): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcgagtgaagctctcctgcaagacttctggatacgtaggttccaacgtacttctaatatacacgtgggtgcgacacggccctggacagggacttgagtggagtgggatggatacgaacctaagngtaggtgacacgacgcctcgtgacacgaagacggttccgagggcgagggtcaccgngtggagtggtgacgacggaccaggcgacgacgtccanacgtagaacttacacgtctagagtcgtgaacgtcacggtcttactcgtgtgcgaccgcccggtgtacggggaccggggtctacgtaccggtnacggtaccgg

SEQ ID NO: 121392 - DNA, 515 bp, Homo sapiens
  misc_feature: GYAE6OF02G12UR.41.2.A02.1.454.CMB.1.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtanacacagccctntgcacagaggttccagggtcagggtcaccgatgagtggtgacacggccacgagcacggtccacatagacttaccagtctgaagtctgaggacacggtccgttacttcgtgtcgcgacgaccccgcgtacgggaccgggggcctacgtacggtcgtaggtaccgg

SEQ ID NO: 121393 - DNA, 924 bp, Homo sapiens
  misc_feature: GYAE6OF02GTQ8L.41.2.A02.1.454.CMB.1.raw
tcagtctatactatcacgaccggtgctcgatttagactcatctacagggggagcatcacccgagccaaccaccagtcttgtccgtcttagagtagtccctgagagctccgtctcacatggactgacctggaggatcgtcttctggtgcgagtctagcactagtaagcccactctcgaggtgcagcgtgatgctagtcggtgggcttggaggtaggacggtacgggtcccgtggggcctacgtacggttacgaagtcgtcctccgtcgacctaaggtaactttccgtacggttaacgtaacgtaacggtttaccgaacgtaccgttcggttaacgttacgttaacccgtacggttacggggtcgtaccggaacgggaaccgggtccccggttagggaaccggtacggggtacttacggtaacgttagggtaggtacggggtaagttggggtaactaacccgtaaaccgtaaaggtacggttaggacgaacacgtaccgtcgtaccgtacgaccgtaacgacggttaacgttcccgaacggggtaccgaacggggtaacctaacccgtaacgttaacggtaacggttagggttacggtaaaccggttaccgggtaacccgtaacggtaaacggtacccggaaacccggtcccaaacggttaccgttaacggggtaaaccgtttacccggaacgggttaccggtaaccgggttaaaccggttcgtaaacgggttaaccgggttaaccttacccgggggtttaaccgttttaaccggttacgggtttaccgggttaacggttacccggggtaaacccggttcccccgggttaacgggttaacccgggggggttaacccggggggtaaccctttaacccggggttaaccgggggttaccccgggtaaacgggtttaaccccccgggggg

SEQ ID NO: 121394 - DNA, 561 bp, Homo sapiens
  misc_feature: GYAE6OF02ILSDP.41.2.A02.1.454.CMB.1.raw
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgtacttctaatatacactggggtgcgacaggcccctggacagggacttgagtggatgggatggatcaacctaagagtggnacacagcctncgcacgagagttccgagggcgagggtccaccgagtggaggtggtagacgacgggccacggagccgacggtaccacagtacggaacttaccgagttcagagttcgtaggacggacgtacggtccgtttaagttccgtagtcggaccgtacggtaccccgtcggtacggggaaccggggggtaccttaccggtaccggttcgtaggtacccggg

SEQ ID NO: 121395 - DNA, 584 bp, Homo sapiens
  misc_feature: GYAE6OF02IYTYQ.41.2.A02.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtccctgagagctccgttcctcaccatggactggacctggaggatcctcttcttggtggcagcagccacaggagcccatctcaggtgcagctgatgcagtctgggctgaggtgaggaagccgtggggcctgagtgaagctcncctgcaagcttcgngatacaggttcaacgtcttctatattaacactgggtncgaacacggccctggacgngggaccttggagtggatgggatggatcgaaaccgtagagtggtagactaancgcctagtggacctaagacggtacgttaccgagggtccgagggtaccaaccgagtacgaggtaggtcgaacgaccggacacggacgaccgacgtaccgagagtacgtaacttaccgaacgtcgtagtaacgtcgtagaagcgtaacggtaccgtttacgtacggtgttagccgaccgtacccgtcggtacgggaaccggggtacccgtacgtaccgggttactacgggtaaccgg

SEQ ID NO: 121396 - DNA, 560 bp, Homo sapiens
  misc_feature: GYAE6OF02G9N1K.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacactgggtgcgacaggcccctggaccagggacttgagtggagtgggatggatcgaaccctaagagtggtgacacgagcctcgtgcacagacggtaccgagggcgagggtcaccgtagtgagtggtgacgacggccacgacgccacggtccacacgtacggaaccttaccgacgttcgtagaacgttctaggaacggaccgaccggtccgtttacgttcgttgtcgtacggaccgaccccgcgtaccggggaccgggggtcctaccggtaccggtacgtacggtaccgg

SEQ ID NO: 121397 - DNA, 564 bp, Homo sapiens
  misc_feature: GYAE6OF02IP05S.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcgaaaccctaagagtggtagacacagcctctgcacgagacggttccgagggcgagggtcaccagtgagtggtgacgacggccacgacgcaccggtccacgacgtacggtaaccttacccgagttactaggaacgttccgtaggaacggaccgtaccgggtccgttttacgtttcgtggttacggcggtacgaccccggcgttacggggaccgggggtcctaccggtacggtccgtaggtaccgg

SEQ ID NO: 121398 - DNA, 543 bp, Homo sapiens
  misc_feature: GYAE6OF02HBMW6.41.2.A02.1.454.CMB.1.raw
  modified_base (350)..(350): a, c, t, g, unknown or other
  misc_feature (350)..(350): n is a, c, g, or t
  modified_base (396)..(396): a, c, t, g, unknown or other
  misc_feature (396)..(396): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcgaaccctaagagtggtagacacgagcctntgcacgagtacggttccgagggcagggtcgccgtagtcggagtggngacgacggaccacgacgcgacggccacgatcgggaacttaccgagtactgaagtcgtagagacgaccggtccgtttactcgtggtcgccggtacgcccggcgtacgggggaccgggggtccttaccggtacggtcgtaggtacccgg

SEQ ID NO: 121399 - DNA, 562 bp, Homo sapiens
  misc_feature: GYAE6OF02JEAUS.41.2.A02.1.454.CMB.1.raw
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
  modified_base (340)..(340): a, c, t, g, unknown or other
  misc_feature (340)..(340): n is a, c, g, or t
  modified_base (522)..(522): a, c, t, g, unknown or other
  misc_feature (522)..(522): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcttggggcctcagtgaagctctcctgcaagacttcnggatacgaggttcaacgacttctatatacacgtgggtncgacacggcccctaggacagggtacttgaggtggagtgggatggactacgaaccgtaagngtggtagacacagcctcgtgacacgagacggtcgacgggcgacgggtcaccgagtcgaggtggtacgacgaccggtccacggacgaccgaccggtaccaacgtagtacggtaaccttaccgacgtcgtagtaacgtcgtaggacgacgtaccggtcgtttactcgtgtacgcgacgacccgnggtacgggaccggggtcctacggtacgtacgtacgtacgg

SEQ ID NO: 121400 - DNA, 520 bp, Homo sapiens
  misc_feature: GYAE6OF02FK7G0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgacttctatatacactgggtgcgacaggcccctggacagggacttgagtggatgggatggatcaaccctaagagtggtgacacagcctctgcacagacggttcagggcagggtcaccagtgagtggtgacgacggccacgagccgacggtccacatggaaccttaccgagtcgtagaacgtctaggagacgacggtccgtttacttcgtgtgcgacgacccgcgtacgggacgggggcctacgtcggtacgtagtaccgg

SEQ ID NO: 121401 - DNA, 539 bp, Homo sapiens
  misc_feature: GYAE6OF02HF632.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagctggggcctcagtgaagctctcctgcaagacttctggatacaggttcaacgacttctatatacactgggtgcgacaggccctggacagggacttgagtggatgggatggatcgaaacctaagagtggtgacacagcctctgcacagtacggttccgagggcagggtcaaccgagtgaggtggtgacgacggcccaggacgcgacgtccacagtacggaacttaccagtctcgaagttcgaggaggacgtacggtccgtttacttcgtgtcgacggacgaccccgcgttcggggaaccgggggtcctacggtaccggtacgtaggtaccggg

SEQ ID NO: 121402 - DNA, 621 bp, Homo sapiens
  misc_feature: GYAE6OF02JNU14.41.2.A02.1.454.CMB.1.raw
  modified_base (386)..(386): a, c, t, g, unknown or other
  misc_feature (386)..(386): n is a, c, g, or t
tcagtctatactatcacgaccggtgctcgatttagactcatctacaggggagcatcacccagcaaccacatctgtcctctagagagtcccctgagagctccgttcctccaccatggactggacctggaggatcctcttcttggtggcagcagccacaggacgcccactctcaggtgcagctgatgcagtcgtgggctgaggtgaggaagccgtggggccttcgagtgaagcgtctccgtgcaagtacttcgtaggtatcaggttcaacgtacttcgtaactatacaacgttgggtagcgacgacggcccgtaggacgacgggtagtgaggtggagttggagtggatacgaaaccgtaggacgtggtacgaacgtacgaagcccgtntacggctacgaggacggttcgacggacgtacgggtacacgaagtgagtggtacgtacgacggccgtacggacgtaccgacgtaccgacgacgtacggtaacttaccgacgttacgtacgtaacgttcgacggtaagaccgtacggtacgtttaccgttacgtggttacgacggtaccgacccgtacggttacgggaaccgggggtcctacgggtaccggtacgtacggtaccggg

SEQ ID NO: 121403 - DNA, 641 bp, Homo sapiens
  misc_feature: GYAE6OF02JMJC5.41.2.A02.1.454.CMB.1.raw
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (416)..(416): a, c, t, g, unknown or other
  misc_feature (416)..(416): n is a, c, g, or t
tcagtctatactatcacgaccggtgctcgatttagactcatctacagggggagcatcacccagcaaccacactctgtcctctagagagtccctgagagctccgttcctcaccatggactggacctggaggactcctcttcttggtggcagcagccacgaggagcccactctcaggtgcagctgatgcagtcgtgggctggagtgaggagctgggcctcagtgagctcgtcctgcaagtcttcgtggactacaggttcaacgtacttactatatactacgtgggtancgtacgacgcccgtggaccgnggtactgaggtgagtggatggactacgaaccgtagacgtggtagacagacgacctcgtacgacgaacgacgtacggttccgacgggctaacgggtacacgtagtacggnggtacggtacgacgtaccggaccgtaagacggaccgacgggtaccacgaagtaccgaacttacccgtacgttacgtaacgtaacgtcgttaacggacggtaaccgtaccgggtttaccgttacgtttacgtcgggtaccgtaccggtaacccggaccccggttacggtaaccgggggtacccggggtaccttaaccgggtaaccggttacgtaccggtaaccggg

SEQ ID NO: 121404 - DNA, 592 bp, Homo sapiens
  misc_feature: GYAE6OF02FN8IV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccgatgagtggtcgacgacggccgacgagccgacggtccacgaagtcggaaacttacccgagttcctaggaacgttctacggaagggtaaccaccggggtcccgttttaacgtttccgttcggttcggtacccggacggtaccccccggtggttaccgggggaacccggggggggtccccttaaccggtacccgggttacgttaccgggtaacccggg

SEQ ID NO: 121405 - DNA, 507 bp, Homo sapiens
  misc_feature: GYAE6OF02GM8PR.41.2.A02.1.454.CMB.1.raw
  modified_base (385)..(385): a, c, t, g, unknown or other
  misc_feature (385)..(385): n is a, c, g, or t
  modified_base (467)..(467): a, c, t, g, unknown or other
  misc_feature (467)..(467): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggngacacggcacgagcacggtccacatggaacttaccagtctgaagtctgagacacggcgtttactcgtgtgcgacgaccccgngtcgggacggggggtcctacggtacggtcgtaggtaccgg

SEQ ID NO: 121406 - DNA, 515 bp, Homo sapiens
  misc_feature: GYAE6OF02GPNO2.41.2.A02.1.454.CMB.1.raw
  modified_base (398)..(398): a, c, t, g, unknown or other
  misc_feature (398)..(398): n is a, c, g, or t
  modified_base (476)..(476): a, c, t, g, unknown or other
  misc_feature (476)..(476): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcttggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccgatgagtggtgacgacggccacgngcgacgtccacgagtggaacttaccgagtctagtaagtctgaacggacacggtcgtttactcgtgtcgcgacgcccgngtacgggacgggggtcctacggtacggtcgtagtaccgg

SEQ ID NO: 121407 - DNA, 568 bp, Homo sapiens
  misc_feature: GYAE6OF02I41G8.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcagacttctggatacaggttaccaacgtacttactatatactaacgtgggtgcgtacgacggcccctaggacgagggacttgacggtggagtcgggatggactacgaacccgtaagacgtggtagacacgacgtcctcgtacgacaccgagtacgggtttaccgacgggcgacgggtaccaccgagtggtaggtgggtagaccgaccggacacggcgaccgacggtccacgacgacgtacgtacacgtcgtagacgtctgagacgacggtaccgttatcgtgtcgacgacgacacggcggtacgggaccggggtccgtacgtacggtcgtacgg

SEQ ID NO: 121408 - DNA, 671 bp, Homo sapiens
  misc_feature: GYAE6OF02IXWGM.41.2.A02.1.454.CMB.1.raw
tcagtctatactatcacgaccggtgctcgatttagactcatctacagggggagcatcacccagcaaccacatctgtcctctagagacgtccctgagagctccgttcctcaccatggactcggacctgggaggatccttcttcgttggtggcagcacgccacgaggacgcccactctcgaggtgcagctgatgcagtcgtgggctggaggtgaggagccgtgggcctcgagtagagctctcctgacaagtcttcgtggactacgtaggttccaacggtactttctaatataaccacgttaggggtcgacggacgaccgggtcccctagggacgagggtacgttagaggtgggagtgggaatgggactccaaaacccgtaaggacgttgggtagaccaacgacgtccctcgtgaccacggaaggtacggttaccaggggccaggggtacccaacgtgtaggagttcgggtagaacccgtacggacccgaggtacgccgaacccggtaccaagtacggtaacggttaaacccttaccgtaacggttcgtaacgtaagttccgttaggaacgggccgttaaccggttcctttttaactcggtgtccgaaggaccgtaacccgacgcgggtaccggggggaaccgggttccctaacgttacgggtactaaccgggg

SEQ ID NO: 121409 - DNA, 545 bp, Homo sapiens
  misc_feature: GYAE6OF02HQPLA.41.2.A02.1.454.CMB.1.raw
  modified_base (503)..(503): a, c, t, g, unknown or other
  misc_feature (503)..(503): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgtacttctatatacacgtgggtgcgacacggcccctggacagggacttgagtggatgggatggatcaacctaagagtggtagacacagcctctgcacgaggtacggttccgagggcgagggtcaccgatggaggtggtgaccgacggaccacgagccgacgtccacgagtcggaaacttaccgagtctagaacgtcgtagaacgacgacggtccgtttacttcgtggtcgcggacgtaccccgngtacgggaaccgggggtcctacggtacggtcgtaggtaccgg

SEQ ID NO: 121410 - DNA, 640 bp, Homo sapiens
  misc_feature: GYAE6OF02GVU2T.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttctggatacaggttcaacgtacttctatatacacgtgggtgcgacacggcccctggacgagggacttggagtggagtgggagtggataccgaaaccgtaaggacgtggtacgacgacgacgtccctcgtcgacaacgaggtacggttccggagggacgacgggtcaccgagtaggtagtgggtacgacgaccggccgacggacgccgaccgggtacccaacgtacgtacggtaaccttaccgagttccgtagtaacgtcgtaggaacggaccgtacccgggttaccgtttacgttcgttggtaccgacgggtaacccgacccccggtacggtaccgggggaacccggggggtacccgttaccgggttaccgggttaccggtaccggttacccgggg

SEQ ID NO: 121411 - DNA, 772 bp, Homo sapiens
  misc_feature: GYAE6OF02I0VY4.41.2.A02.1.454.CMB.1.raw
  modified_base (284)..(284): a, c, t, g, unknown or other
  misc_feature (284)..(284): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtgggcctcagtgaagctctctgacaagacttctggatacgaggttaccaacgtacttctatatacacgtgggtcncgacgcggccctggacagggtcttggagtggagtgggataggactaccgaaacccgtaaggacggttagggtacgaaccgtaacgacggtccctacgtggacccgtaacgagggtaacgggtttacccggaacgggggtccgtaacgggggttacccaacccggtaaggttacgggaacgggttcggggttaccggaacccggtacccgggggaacccgtaaaccggggaacccggacccggtaacccgggttacccgaaccgtaacgggttaaccggggtaaaacccctttaacccggtaacggtttacccggtaaggttaaccgtttacggtaacgggtaaaccgggtaccgtaccggggtttacccttttacggttacggttcgggtacggtaccggaacccggtacccccgggtagggtaaccgggggtaacccggggggtacccttaaccgggtacccggttacggtaaccgggttacccggg

SEQ ID NO: 121412 - DNA, 529 bp, Homo sapiens
  misc_feature: GYAE6OF02HIM9F.41.2.A02.1.454.CMB.1.raw
  modified_base (280)..(280): a, c, t, g, unknown or other
  misc_feature (280)..(280): n is a, c, g, or t
  modified_base (487)..(487): a, c, t, g, unknown or other
  misc_feature (487)..(487): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacagggacttgagtggatgggatggatcaaccctaagagtggtgacacagcctctgcacagacggttccgagggcagggtcaccgagtgagtgggtgacgacggccacggacgcacggtccacgacgtggaaaccttaccgagtctagaagtcgtgagacgacggtcgtttacttcgtgtgcgacgaccccgngtacgggaccgggggtcctacggtaccggtcgtaggtaccgg

SEQ ID NO: 121413 - DNA, 517 bp, Homo sapiens
  misc_feature: GYAE6OF02H74BU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcaacctaagagtggtgacacagcctctgcacagtaggttccgagggcagggtcaccgagtgagtggtgacgacggccacgagcgaccggtccacagtggaaccttaccgagtctgaagtctgacggacgacggtccgtttacttcgtgtgcgacgcccgcgtcgggacgggggcctacggtacggtcgtagtaccgg

SEQ ID NO: 121414 - DNA, 613 bp, Homo sapiens
  misc_feature: GYAE6OF02H15A0.41.2.A02.1.454.CMB.1.raw
  modified_base (241)..(241): a, c, t, g, unknown or other
  misc_feature (241)..(241): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtgggcctcagtgaagctctcctgcaagtcttntggatacgagttcaacgtacttctatatacacgtgggtgcgacaggcccctggacagggacttgaggtggatgggatggataccgaaccgtaaggagtggtagacacagtccctactgcacgaggacggttccgagggcgagggtaccacgagtagtaggtaggtacgtacgaccggaccgacggacgaccgaaccggtccaacgtagtacggtaaccgttacccgagttccgtaggtaagttcgtacggaacggaacgtaccgggttacccgttttacgttacggtcgttcggaccgtacggtacccccggtacggtacgggggaacccggggggtacctaccgggttaaccggtcgtaacggtacccggg

SEQ ID NO: 121415 - DNA, 645 bp, Homo sapiens
  misc_feature: GYAE6OF02I3PHK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtggggcctcagtgaagctctcctgcaagacttctggatacaggttcaacgacttcatatacacgtgggtgcgacgacggccctggacgagggacttggagtggagtgggatggataccgaacccgtaaggaggtggtagaacacgacgtcctcgtcgacacgagtacggttccgagggcgagggccaccgagtgaggtggtgaccgacggaccacggacgccgaccggtaccaacgacgtacggtaaccgttaccgacgttacgtacgtaacggttacgtaggaacgggtaccgtaaccgggttacccgtttttaaccgtttccgttacggttacggtacccggaaccggtacccccggtaccgggttaaccgggggaacccgggggggttacccttaaccgggttaccgggttacccggtaacggtacccgggg

SEQ ID NO: 121416 - DNA, 692 bp, Homo sapiens
  misc_feature: GYAE6OF02F8X0Y.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctctgacaagtacttcgtggtaatacgtaggttaccaacgtacttactatatactagtgggtgcgacgacgcccgtggacgaggtactagaggtggtagtgggtagtggactaccaaaccgtaggacggtggtagacacgacgtcctcgtcgacacgaacggtacggttacggagggacggtacgggtacgaccgtagtacggagggttacgggtcggaaccggtaccgggaccgaacggacggaccggtacccgggtaaccaacgtaacggtaaccggtaaaccgttacccgtaacggtttacgtaacggtaacgttcggtacggaaccgggaaccgtacccgggtttacccgtttacgttccggttggtaccggtaccgggaacccggtaccccggtacggtacgggggggtaccccggggggtaccttaaccgggtcccggttacggtacgggtacccggg

SEQ ID NO: 121417 - DNA, 585 bp, Homo sapiens
  misc_feature: GYAE6OF02GX9RV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgacttctatatacactgggtgcgacaggccctggacagggacttgagtggatgggatggatcaacctaagagtggtgacacagtcctctgcacgagacggttccagggcagggtcacccgagtgagtgggtgacgacgggccacggacgccgacggtccaacgagtaggaaccttaccgaagtaccgttagaacgttcgtcggaacggtaccgaccgggtaccgttttaccgttcgttcggtcggtacggtaccggacccccggtcgtacgggggtaaccgggggggtcccttaacggtaccgggttaccgtacgggtacccggg

SEQ ID NO: 121418 - DNA, 526 bp, Homo sapiens
  misc_feature: GYAE6OF02F8NWU.41.2.A02.1.454.CMB.1.raw
  modified_base (350)..(350): a, c, t, g, unknown or other
  misc_feature (350)..(350): n is a, c, g, or t
  modified_base (486)..(486): a, c, t, g, unknown or other
  misc_feature (486)..(486): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacactgggtgcgacaggcccctggacagggacttggagtggatgggatggatacaacctaagagtggtgacacagcctntgcacgagaggttccgagggcagggtacacgatgagtggtgacgacggccacgagccgacggtccacgtagtacggaacttaccagtctagaagtctaggagacacggtccgtttactcgtgtgccgacgacccgngtcgggaccgggggtcctacggtaccggtctaggtaccgg

SEQ ID NO: 121419 - DNA, 543 bp, Homo sapiens
  misc_feature: GYAE6OF02GTIK8.41.2.A02.1.454.CMB.1.raw
  modified_base (437)..(437): a, c, t, g, unknown or other
  misc_feature (437)..(437): n is a, c, g, or t
  modified_base (502)..(502): a, c, t, g, unknown or other
  misc_feature (502)..(502): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagtacttgtggatacaggttcaacgacttactatatacacgtgggtgcgacacggcccctggacgagggacttggagtggagtgggagtggatcaaaccctaggagtggtagacacacgcctctgccacagacggttaccgagggacgacgggtcacgagtggaggttaggagacgacggccgacggagccgacgtccanagtgaacttcgagtctagtagtctagagacgacggtccgtttagttcgtggtcgcgacgccccgnggtacggggaccggggtcctaacggtcgtcgtaggtaccgg

SEQ ID NO: 121420 - DNA, 541 bp, Homo sapiens
  misc_feature: GYAE6OF02HAP0D.41.2.A02.1.454.CMB.1.raw
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacactgggtgcgacaggcccctggacagggacttgagtggagtgggatggatcaaccctaagagtggtgacacgagcctctgcacaagacggttccgagggcgagggtcaccgatgagtggtgacncggcacgagcacggtccacacgtagaactacagtcgngtaagtcgtagaggacgaccggtccgtttacttcgttggtcgtcggaccgtaccccgcggtcggggtaaccgggggccgttacggtaccgggttcgtaggtaccggg

SEQ ID NO: 121421 - DNA, 624 bp, Homo sapiens
  misc_feature: GYAE6OF02IFT27.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcgagtgaagctctcctgcaagacttctggatacgaggttcaacgtacttctatactacacgtgggtgcgacgacggccccgtggacgagggacttggaggtggagtggggatgggaactacaacccgtaaggtaggtggtagacacgacgccctgtacgcaacaggtacggttaccgaggggcgacgggtccaaccgtagtaggtaggtggtaggaccgaccggaccgacggacggaccgaaccggtccgaacgacgtaacggtaaccttaccgacgtcgtagacgttacgtaggaacggacgtaccggtcccgttttacgttcgtcggtcggtaccggtaaccggaccccgtacggtacggggaaccggggggtcccgtaccggtacggttaccgtaggtaccggg

SEQ ID NO: 121422 - DNA, 565 bp, Homo sapiens
  misc_feature: GYAE6OF02FR49X.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgacttctatatacactgggtgcgacacggcccctggacagggacttggagtggatgggagtggatcaaccctaagagtggtgacacagcctctgcacgagacggttccgagggcgagggtcaccgatgagtggtgacacggccacgacgcacggtccacgagtacggaacttaccgagtcgtagtaacgtcgtaggaggaccgaccgggtccgtttaacgttcgtcggtcggaccggaacgaccccgtacggtcggggaaccggggggtcccttaaccggtacgggttaccgtacggtacccggg

SEQ ID NO: 121423 - DNA, 705 bp, Homo sapiens
  misc_feature: GYAE6OF02H7I7X.41.2.A02.1.454.CMB.1.raw
  modified_base (245)..(245): a, c, t, g, unknown or other
  misc_feature (245)..(245): n is a, c, g, or t
tcagtctatactatcacgaccggtgctcgatttagactcatctacagggggagcatcacccagcaaccacatctgtcctctagagagtccctgagagctccgttcctcaccatggactggacctggaggatcctcttcttggtggcagcagccacaggagcccactctcaggtgcagctgatgcagtctggggctgaggtgaggaagccgtggggcctcgagtgaacgctctctgcaagacttcngatacgaggttacaacgtacttctatatacacgtggtgacgacacggcccctggacgagggtacttggagtggagtgggatggaactccgaaaccgttaagaggttggtacgaacgtaaccgagtacccttcgtagccgaacgtaaggtaccgggttaccgaacgggtacgtaacggggtaccaaccgaggttacggaacggttcgggttacggaaccggtaaccgggacccgtaacggaacggtacccgtaacgggtacccgaacgtaacgttaaccggtaaacccgttaccgaacggttaccgtaaggttaacgtccgtaaggaaccggtaacgtacccgggttaccgtttaccgtttacgttcggtaccggtacgacccggttaaccccggcgggttaaccgggggtaacccggggggtcccttaaccgggtacggttaccggtacggttacccggg

SEQ ID NO: 121424 - DNA, 516 bp, Homo sapiens
  misc_feature: GYAE6OF02FPHBQ.41.2.A02.1.454.CMB.1.raw
  modified_base (280)..(280): a, c, t, g, unknown or other
  misc_feature (280)..(280): n is a, c, g, or t
  modified_base (475)..(475): a, c, t, g, unknown or other
  misc_feature (475)..(475): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacaggggacttgagtggatgggatggatcaaccctaagagtggtgacacagcctctgcacagaggttccagggcagggtcaccatgagtggtagacacggccacgagcgacggtccacgatggaacttacgagtctagaagtctagagacacggtcgtttactcgtgtgcgacgaccccgngtacgggacgggggtcctacggtacggtacgtaggtaccgg

SEQ ID NO: 121425 - DNA, 570 bp, Homo sapiens
  misc_feature: GYAE6OF02GG9PU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctcgcacagacggttccagggcagggtcaccagtgagtggtgacgacggccgacgagcgacggtaccacagtacggaacttaccgacgtacctaggtaacgtctaggaacggaccgaacgggtccgttttaccttcgttggtacgaccggacgacccccggtacggtacggggaaccgggggggtaccctaaccggttaccgggttccgtaggtaacccggg

SEQ ID NO: 121426 - DNA, 594 bp, Homo sapiens
  misc_feature: GYAE6OF02GJHWF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttctggatacaggttcaacgcttctatatacacgtgggtgcgacacggccctggacagggacttggagtggagtgggatggatcgaaacctaagaggtggtagacacgacgcctctgaccacgaggtacggttccgagggcgtacgggtcaaccgagtaggaggtggtacgacgaccggaccgacggacgaccgacgggtaccaacgacgtaggtaaccttaccgagtactagaacgtcgtaggaacggacgtacgggtaccgtttacgtacgtcgttcggaccggtacggaccccgtaggtacgggggaaccgggggtacctacggtaccggtacgtacggtaacccggg

SEQ ID NO: 121427 - DNA, 516 bp, Homo sapiens
  misc_feature: GYAE6OF02F1HP5.41.2.A02.1.454.CMB.1.raw
  modified_base (476)..(476): a, c, t, g, unknown or other
  misc_feature (476)..(476): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacagcctctgcacagaggttccagggcagggtcaccatgagtggtgacgacggccacgagcacggtccacacgtggaaccttaccgagtccgtagaacgtctaggagacacggccgtttactcgtgtgcgacgcccgngtcgggaccgggggtctaccggtacggtcgtagtaccggg

SEQ ID NO: 121428 - DNA, 642 bp, Homo sapiens
  misc_feature: GYAE6OF02HDF9U.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcgagtgagctctccgtgcaagtcttcgtggatacgaggttacaacgtacttctatatacacgtgggtcgacgacgacggtccccgaggacgacgggtacttggacgtggagtgggagtggactacgtaaaccgtaaggagttggtacgacacgacgtcctcgtcgacgacgaggtacggttaccgaagggtcgtaacgggtccaccgtagtggaggtcggtacgaccgacgggaccacggacggccgaaccggtaccacgtacgtaccggtaaaccttaccgacgtacgtacgtaacggtcgtacggaacggtaccgtaaccggttcccgtttacgttcgttggtccggaccggtaccgaccccggtgggtaccggggggtaaccggggtccgttaccggtacggttccgtaggtacccggg

SEQ ID NO: 121429 - DNA, 714 bp, Homo sapiens
  misc_feature: GYAE6OF02HITRQ.41.2.A02.1.454.CMB.1.raw
  modified_base (240)..(240): a, c, t, g, unknown or other
  misc_feature (240)..(240): n is a, c, g, or t
tcagtctatactatcacgaccggtgctcgatttagactcatctacagggggtaggcatcacccaagcaaccacatctgtcctctagagagtccccctgagagctccgttcctcgaccatggactggacctggaggatcctcttcttggtggcagcagccacaggagcccactctcaggtgcacgctgatgcagtcgtggggctgagggtgaggaacgcgtggggcctcgagtgaagctcnctgcaagcttcgtaggtatacgtaggttacaaccgtacttactaataactaccgaacgtggggttaccgacggaccacgggtacccccgtaggaccgaacggggtacttggaacgggtgggtacgttaggggtagtgggtacgtaccaaaacccgtaaggacggttcgggttagacgtacgacggtccgtacgtcggacctaacgaaggttacgggtttacccaacggggtaccgtaaacgggtacccaaccgtaacgtgggaacggttcgggaacgaccgaccggtacccaggaccggaccgacgggttaccaccgttagtaccggttaaactaccgtagtaccgtagtaaacgttccacggaacgtaccgtaccgggttccctttaagttccgtaggtacgacccggtaccgacccggtagtaccggggggtaaccgggtcctaacggttaccggtacgtacggtaaccggg

SEQ ID NO: 121430 - DNA, 652 bp, Homo sapiens
  misc_feature: GYAE6OF02GZQSY.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgagctctctgcaagcttcgtggatacgtaggtacaacgtacttctaatactaacacgttggggtgacgacgacggtccccgtaggaccgtagggtacttggagtggagtgggagtggactacgtaaaccgtaggtacggtggtacgacacgacgtcccgtacgtacggacctaacggacgttacgggtaccgaaggggtccgtaacgggtaccaccgagtacgggtagtgggtacgaccgacgggcccgaacggacgaccgaccggtaccacgacgtacggtaaccttaccgagttacgtgaacgttcgaggacggaccgtaccggttcgtttacgttcgtaggtcggaccgtaccggtaccccggtgggtaccgggggtaacccgggggacccgttaccggtaaccgggtaccgtacgggtacccggg

SEQ ID NO: 121431 - DNA, 534 bp, Homo sapiens
  misc_feature: GYAE6OF02FJ730.41.2.A02.1.454.CMB.1.raw
  modified_base (278)..(278): a, c, t, g, unknown or other
  misc_feature (278)..(278): n is a, c, g, or t
  modified_base (495)..(495): a, c, t, g, unknown or other
  misc_feature (495)..(495): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggcctcagtgagctctcctgcaagacttctggatacaggttcaacgtacttctatatacactgggtncgacaggcccctggacagggacttgagtggatgggatggatcaacctagagtggtgacacgagcctcgtgcacagacggttccgagggcagggtcaccgtatggagtggtcgacgacggccacggacgccgacggtccacgagtacggaaccttaccgagtctagtaagtctaggacgacgacggttccgtttaactcgtgtcgacgcgtaccccgngtcggggacgggggtcctacggtacggtctaggtaccgg

SEQ ID NO: 121432 - DNA, 609 bp, Homo sapiens
  misc_feature: GYAE6OF02IA3GM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcgagtgaagctctcctgcaagtacttctggatacgaggttcaacgtacttctatatacacgtggtgcgacacggccctggacgagggtacttggagtggagtgggagtggactaccaaaccgtaaggagtggtagacgacacgtccctcgtgacctacgacggtacggttccgacgggacgtacgggtaccaccgagtgagggtggtacggacgaccggccgacggacgacgacccggtaccacgtagtacggtaaccttaccgacgttaccgtagtaacgtcgtagacggtaccgaccggttaccgtttacgttcgtcggtcggccggaccggacccgacggtcggggaccgggggtaccgtaccggtaccggtaccgtaggtaccgg

SEQ ID NO: 121433 - DNA, 636 bp, Homo sapiens
  misc_feature: GYAE6OF02JEAPN.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagcttcgtggatacgaggttcaacgtcttactatatacacgtgggtgcgacgacggccccgtggacgagggacttcggagtggagtgggatggactacgaaccctaagaggttggacgacacgacgcctactcgaccaacgaggtacggtttacccgagggtcgtacgggtaccaaccgtagtggaagttgggacgtaaccgaccgggccaacgacgccgaaccggtaccaacgagtacggaaccttaccgagttaccgtagaagttcgtaggaacggaccgtaccgggtaccgttttaaccgcgtttacggtacgaccggtaaccggacccccggtacggtaccggggggaacccggggttcccgtaaccggttacgggtaccgtacggtacccggg

SEQ ID NO: 121434 - DNA, 543 bp, Homo sapiens
  misc_feature: GYAE6OF02GIZFM.41.2.A02.1.454.CMB.1.raw
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (493)..(493): a, c, t, g, unknown or other
  misc_feature (493)..(493): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctctgcaagacttctggatacagttcaacgacttntatatacactgggtncgacaggcccctggacagggacttgagtggatgggatggatcaaacctaaggagtggngacanacgcctcngcacgagtacggttccgagggcgagggtcaccagtgaggtggtgacacggccacgagcgacgtccaacagtcggaacttaccgagttctagagtcgtgaacggacacggtccgtttactcgtgtcgtacggaccgtaccccgnggtacggggaaccgggggtccttaacggtaccgggttcgtacggtccggg

SEQ ID NO: 121435 - DNA, 561 bp, Homo sapiens
  misc_feature: GYAE6OF02IX18D.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacagggacttgagtggatgggatggatcaaccgtaagagtggtgacacagtcctctggccacgaggtacggttccgaagggcgagggtcaccgtagtggaggtgggtagacgaccggaccacggacgccgacggtccacgacgtacggtaaccttaccgagtcgtaggaacgtcgtaggaacggacgtacggtaccgtttacgtcgtggtcgacggacgtacccgcggtacgggaccgggggtcctacggtacggtcgtagtaccgg

SEQ ID NO: 121436 - DNA, 752 bp, Homo sapiens
  misc_feature: GYAE6OF02I4B4V.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgtacttctatatacacgtgggtgcgacgacggcccgtaggacgagggactggtagtggagtggggatggtactaccgtaaaccgtaaaggacggttgggtacgaacaacgacgacccttcgtacgacgtaaccaagggtaacggttcccggaaggggtccgtaacggggtacccgtaaccgtaacgtcgggtacgggttacgggtagacccggaacccgggaccgtaaacccgggacggacccgaacccgggtacccgtaaaccgtacgttaacgggtaaccgttttaaacccaacggttaaccgtacggtaaaccggtttacgtacggtaaccgggtaaccggtacccgggttacccggtttttacctttaccgggttacggttccggaccggtaacccggtaccccccgggtacggggtaccgggggtaacccggggggggtaccccttaacccgggtaaccgggtttaccggtaacggtaaccccgggg

SEQ ID NO: 121437 - DNA, 645 bp, Homo sapiens
  misc_feature: GYAE6OF02IJM7R.41.2.A02.1.454.CMB.1.raw
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctggtggcagcagccacaggagcccactctcaggtgcagctgatgcagtcgtggggctgaggtgaggaagccgtggggcctgaggtgaaggntccgtcctgacaaggtacttcgtggataccgaggttacaaacgtacttcgtataatacgtactggggtacncgtaacgacggccctaggacaggggtaccttggacggtggatggggatgggactaccgaaaaccgtagaggtaggtacgacgaagcgtcctatcggacacgaggtacggttaccgagggtacgacgggtacaaccgtagtacgaggtcggtagaaccgcggaccgacgacggaccgaccgggtacaacccgtagtaccggaactttaaccgagttacgtacgtaagtccgtaggacgtaccgtacggtaccgttttactcggtacggtacggtccggaaaccgtccccggacggtacggggtaaccggggccttaacgggtaccggttaccgaggttacccggg

SEQ ID NO: 121438 - DNA, 591 bp, Homo sapiens
  misc_feature: GYAE6OF02IVDJE.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcgagtgaagctctcctgcaagacttcgtggatacgaggttcaacgtacttctatatacacgtgggtgcgacgacggccctggacagggtaccttgagtggagtggatggatacgaaccgtaagagtggtagacacgagacctgtacgacgacaaggtacggttaccgaagggtcgagggtaccacgagtaggagtggtacgacgacggccgaacgacgacgaccggtcccagagtacggtaaccttaccgagtacgtacgaacgttcgacggtacggaacgtaccggtaccgttttacgttcggtcgtcggacgaccggtacccgtacggtacggggaccgggggtcctacggtacggtacgtacggtaccggg

SEQ ID NO: 121439 - DNA, 633 bp, Homo sapiens
  misc_feature: GYAE6OF02HKORG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgagctctcctgcaagacttctggatacaggttcaacgtacttctatactacacgtgggtcgcgacacggcccctggacagggacttgagtggatgggatggactcgaacctagagtggtagacacacgtcctctcgcacgaggtacggttccgagggtcgagggtccaccgtagtaggacgtagggtacgacgaccggaccgaacggacgccgacggtaccacgtacgtacgggtaaccttaccgagttaccgtacggtaacgttcgtacggtaacggtaccgtaccgggttaccgttttacgtttccgttacggttcggtacggtaacccggtaccccggtaccggttaaccgggggtaccgggggggtacccttaccgggttacccgggttaccgttacggtaacccggg

SEQ ID NO: 121440 - DNA, 674 bp, Homo sapiens
  misc_feature: GYAE6OF02J10YD.41.2.A02.1.454.CMB.1.raw
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaacgcgtctccgtgcaagacttcgtggatacgaggttcaacgtacttactatatacacgtgggtgcgacgacggcccctgggaccgaggggtacttaggacgtcgggtagtggggacttagggactaccgaaacccgtaaggacggttagggtcgaacgacgacgtccttcgtagcctaacgaggtaacgggttccgacgggacgtacgggtccaaccgtagtacgtagtagggtaggaccgaccggtacgaccgggtagacccgtaccggtacaaccgtacgtaccggtaacgttaccgagtaccgtaggtacgtacggacgaacggtacgtaccggttccggtttactttaccggtgttaccggacggtaacccggtccccggtagggttaccgggggaaccgggggtcccttaaccgggtaccggttaccggtaggtaccccgggg

SEQ ID NO: 121441 - DNA, 583 bp, Homo sapiens
  misc_feature: GYAE6OF02HINMU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaacgacttctggatacaggttacaacgtacttctatatacagtgggtgcgacacggccctggacagggtacttggagtggagtgggatggactacgaaaccgtagaggtggtagacacgacgcctcgtcgacacgaggtacggttccgagggcgacgggtaccacgtagtggaggtgggtacgacgaccggaccgacggagaccgacggtaccacgaagtacggtaaccttacgacgtcgtagtaacgtcgtacggaacggacctacggtccgtttagtcgtcgtcggaccgacggacccgtaggtcggggaccggggtccttacggacggttcgtacggtaccgg

SEQ ID NO: 121442 - DNA, 565 bp, Homo sapiens
  misc_feature: GYAE6OF02HTE6L.41.2.A02.1.454.CMB.1.raw
  modified_base (286)..(286): a, c, t, g, unknown or other
  misc_feature (286)..(286): n is a, c, g, or t
tcagtctatactatcacgaccggtgctcgatttagactcatctacagggggagcatcacccagcaaccacatctgtcctctggagagtcccctgagagctccgttcctcaccatggactggacctggaggatcctcttcttggtggcagcagccacaggagcccactctcaggtgcagctgatgcagtctgggctgaggtgaggaagccgtggggcctcgagtgaagctctcctgcaagacttctggatacaggttcaacgacttctatatacactgggtgcgacncggcccctggacagggacttgagtggatgggatggatcaacctagagtgtgacacagcctctgcacgagtacggttcgagggcgagggtcaccgagtgagtggtgacgacggaccacggacgccgacggtccaacgacgtacggaaccttaccgagtcgtaggaacgttcgtagacggaccgtacggttaccgtttacgttcgtcggtcgacggaccgtaccccgtaggtacggggaacccggggggtcctaccggtacggtaccgtacggtacccggg

SEQ ID NO: 121443 - DNA, 594 bp, Homo sapiens
  misc_feature: GYAE6OF02FMQJM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcagtgaagctctcctgcaagacttctggatactaggttcaacgtacttctatatacacgtgggtgcgacgacggcccctggacgagggacttggaggtggagtgggatggatacaaccgtaagagtggtgacacgacgcctctcgacacgaggtacggttccgagggcgagggtccaacgagtggaggtggtacggacgaccgggaccgacggacggccgaaccgggtcccaacgacgtacggaacttaccgagttcgtagtaacgtcgtacggacggacgtaccggtaccgtttacgtcgtcggtacgcggtaccgaccccgcggttacggggaaccggggggtcctacggtaccggtacgtacggtaccggg

SEQ ID NO: 121444 - DNA, 718 bp, Homo sapiens
  misc_feature: GYAE6OF02J1G1C.41.2.A02.1.454.CMB.1.raw
tcagtctatactatcacgaccggtgctcgatttagactcatctacaggggggagcatcacccagcaaccacatctgtcctctagagagtcccctgagagctccgttcctcaccatggacctggaccctggaggatcctcttcttggtggcagcaggccacgaggagcccactctcaggtgcagctgatgcagtcgtcggggctggaggtgaggaagcctggggcctcgagtgaagctctcctgcaagacttctggatacaggttcaacgacttctaatatacgacgtgggtcacgacacggccctggacgagggacttgaagtggagtgggatggacttcaaacccgtaggacgttgggtacgacacgacgtcctacgtgaccaacgacggtaccggtttccgacgggcgaacgggttaccacccggtagtacgggtacggttagggtacggtaaccgaccgggacccgaacgggtaacggacccgtaaccgggttcccgtaacgtaacggttaacgggaaacccgtttaacccgaacgggttacccgttaggtaaaaccgttccgtacgggaaaccgggtaccgtaccgggtacccgttttacggttaccgttacgggttaggacccgggttacgggacccccggttaggtaacccgggggtaacccggggggtacccttaccgggtaacccgggttacggtacgggtaaccccggg

SEQ ID NO: 121445 - DNA, 542 bp, Homo sapiens
  misc_feature: GYAE6OF02HHVH7.41.2.A02.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactggtcncgacaggcccctggacagggacttgagtggatgggatggatcaaaccctaaggagtggtgaacacgagcctctgcacagtaggtccagggcagggtcaccatgagtggtgacgacggccagacgcgacggtccacgngtacggaacttaccgagtcctagaacgtcgtagacgacacgggttccttacgttcgtgtcgtaccgacggaccccgtcggtacggggaaccgggggccttaacggtccggtacgtagtacccggg

SEQ ID NO: 121446 - DNA, 641 bp, Homo sapiens
  misc_feature: GYAE6OF02G99V0.41.2.A02.1.454.CMB.1.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgcaagcttcnggatacaggttcaacgtacttctatatacacgtgggtncgacacggcccctggacgagggacttggagtggatggggatggactacaaaccgtaagaggtggtacgacacgacgccctctcgccacgaggtacggttaccgaggggccgtaacgggtccaaccgagttaggacggttgggtaccgaaccggaccgggtacccgaacgggaaccggccgaaccgggtcccaacgtacgtacggtaaaccttaccgacgttacgtagtaacgtcgtacggaacggaccgtacggttacccgttttacgttcgtcggtccggaccgtaccggtaccccggtcggtaccgggggaccgggggtaccgtaaccggtaccgggtaccgtacggtcccggg

SEQ ID NO: 121447 - DNA, 718 bp, Homo sapiens
  misc_feature: GYAE6OF02JCAN4.41.2.A02.1.454.CMB.1.raw
  modified_base (315)..(315): a, c, t, g, unknown or other
  misc_feature (315)..(315): n is a, c, g, or t
tcagtctatactatcacgaccggtgctcgatttagactcatctacagggggagcatcacccagcaacccacatacctgtcctctacgagagtcccctgagagctccgttcctcaccatgactggacctggagatcctcttcttaggtggcagcagccgacaggagcccactctcaggtgcagcgtagatcgccagtcctggggctggaggtgaggaagccgtggggcctcgagtgaagctcctcctgcaagacttactggactacaggttcaacgacttctatatacactgggtgcgacacggcccctggaccgnggacttggaacgtcggagtcgggatggatcaacccgtaaggagtggtagacacgacgtcctctcgacacgagtacggttaccgacgggcgacgggttaccaccgtagtcggtaggtacgggtcgtaaccggaccgggtacccgtaacggtacggtacccgtaaccgggttaccccaacgttacggttaaccgggtaaaccgtttacccggtaacggtttccgttaacgggttaaccgttaccggtacggaacgggtaacccgtaaccggggtacccgtttttacggtaccggttacggttaccgggtaccggtaacccggtacccccggtagggttccggggggaaacccggggggtccccttaaccgggttacccggttaccggttaccggttaaccccggg

SEQ ID NO: 121448 - DNA, 583 bp, Homo sapiens
  misc_feature: GYAE6OF02IJ7OG.41.2.A02.1.454.CMB.1.raw
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactgggtgcgacncggccctggacagggacttgagtggatgggatggatcaacccgtaagagtggtgacacagcctctgcacgngaggttccgagggcagggtcaccgatgagtggtgacgacggccacgagccgacgtccacagtacggaacttacccgagttaccgtaggaagttccgtaggaacgggaccgtaccgggtcccgttttacgtttccgtggtccggtccggtaaccggaccccggtcggtacgggggaacccgggggggtccctaaccgggttacccgggtaccgtacggtacccggg

SEQ ID NO: 121449 - DNA, 601 bp, Homo sapiens
  misc_feature: GYAE6OF02FL0YS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcagacttctggatacaggttcaacgacttctatatacacgtgggtgcgacaggcccctggacagggacttggagtgggatgggatggactaccaacctaagcgttggtagacacagcctctgcacgaggtacgttccgagggcgagggtcaccgatcgaggtggtagacgacggaccacggacgaccgacgggtacccaacgacgtacggaaaccgttacccgagttaccgtagtaacgtccgtacggaacggtacgtaccgggttaccgtttacgttccgttcggtcggtaccggtaccggaccccgtcggtaccggggaccggggggtcccttaaccggtaccgggttaccgtacggtaacccggg

SEQ ID NO: 121450 - DNA, 616 bp, Homo sapiens
  misc_feature: GYAE6OF02JSO5T.41.2.A02.1.454.CMB.1.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
tcagtctatactatcacgaccggtgctcgatttagactcatctacaggggagcatcacccagcaaccacatctgtcctctagagagtcccctgagagctccgttcctcaccatggactggacctggagatcctcttcttggtggcagcagccataggacgcccactcctcaggtgcagctgatgcagtctgggctgaggtgaggaagccgtggggcctcgagtgaagctctctgcaagacttcnggatacagttacaacgtacttctatatacacgtggtgcgacacggccctggacngggtactgagtggagtggatggatacaaaccgtagagtggtagaacgacgacgcctcgtacgcgaacgaggtacggttccgagggcgacgggttaccgacgtcgtaggagtcgggtacgacggtaccggccgaacggacggaccgtaccgggaccaacgtacgtacggtaaaccgttaccgaacggttcgtaagacgttaccgtaggaccgtagtacccggttcgttttaaccgtcggttcgtacggccgtaaccggaccccgtacggtacggggaacccggggtccgtaaccgtccgggttacgtaccggtaccggg

SEQ ID NO: 121451 - DNA, 596 bp, Homo sapiens
  misc_feature: GYAE6OF02I3TEY.41.2.A02.1.454.CMB.1.raw
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
  modified_base (527)..(527): a, c, t, g, unknown or other
  misc_feature (527)..(527): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgaagctctcctgcagacttcgtggatacaggttacaacgtactttcatactacacgtgggtncgacacggccctggacgagggtacttggagtggagtgggatggataccgaaaccgtaaggagtggtagaacacgacgcctcngaccacgtaggacggtttacccgaggggccgtagggtacctaaccgagtaggtaggtcgggtacgacccggacggcccgacgacgccgaccggtccaagacgtacggtaaccttaccgagttccgtagacgttcgaggaacgacaccggttacgtttacgtntacggtcggaccgaccgtcccggtaggtaccggggaccggggtcctacggtcggtacgtacggtaccgg

SEQ ID NO: 121452 - DNA, 574 bp, Homo sapiens
  misc_feature: GYAE6OF02GWQ4H.41.2.A02.1.454.CMB.1.raw
  modified_base (217)..(217): a, c, t, g, unknown or other
  misc_feature (217)..(217): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggcctnagtgaagctctcctgtaagtacttctggatacaggttcaacgacttctatactacactgggtgcgacacggcccctggacgagggcttggaggtggacgtggggactggactcgaacccgtaagagtggtagaacacgacgcctcgtgacacgagtacggttccgagggcgagggtcaccgagtggaggtggtacgaacgacggaccaacggacgcgaccggtccacgacgtgaaaccgttaccagtactagaacgtctagacgacgtacgtccgttttacgtcgtggtcgacgtacgacccggtcggtacggggaaccgggggcttaccggtacggttcgtacggtacggtacggg

SEQ ID NO: 121453 - DNA, 605 bp, Homo sapiens
  misc_feature: GYAE6OF02FOI81.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcagacttctggatacaggttcaacgacttctatatacactgggtgcgacacggtcccctggacgaggggacttggacggttgggagtggggatgggactacgaaacccgttaagaggtgggtagtacacgtaagcctctcgacacgagtacggttccgagggcgacgggtcacgagtggaggtgggtagtacgacggtccgacggtacgccgacggtccacgacgtacgaacttacccgagtcgtagtaagtcgtacgacggacgacggttaccgtttacgttcgttggtcggtaccggtaccggtaccccgtacggtacggggaacccggggggtaccgttaccggtacgggtacgtacggtaccggg

SEQ ID NO: 121454 - DNA, 668 bp, Homo sapiens
  misc_feature: GYAE6OF02IOLVU.41.2.A02.1.454.CMB.1.raw
  modified_base (372)..(372): a, c, t, g, unknown or other
  misc_feature (372)..(372): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgaggaagccgtgggcctcgagtgaagctctcctgcaagtacttcgtggatacgaggttacaacgtacttctataactacacgtggggtgcgacgacggccccgtaggacgagggtacttggagtggagtggagtggatacaaccgtaagagtggtagacacgacgcctntcgacaacgtaggtacggtttaccgacggggacgaacggggttaccaaccgtagttagggaagggttgggtacgaccggaccggacccgaacggacgccgaaccggtaccacgtacgtacggtaaccttaaccgtagttactaggtaacgttcgtaggaaccgtacgtaccgggttcccgttttacgtttacggtcggttaccgggaccgtacccggtaccccggtacgggtaaccgggggtaaccgggggtaccccgttaaccgggttaccgggttaccggtaacgggtcccggg

SEQ ID NO: 121455 - DNA, 596 bp, Homo sapiens
  misc_feature: GYAE6OF02G74IV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgacttctatatacactgggtgcgacaggccctggacagggacttggagtggatgggatggatcaaccgtagagtggtgacacagcctctgcacgagtacggttaccgagggcgagggtccacgatgtagtgggtacgacgacggccgaacggagccgacggtccaacgacgtacgggaactttaccgagttcgtagtaaacgttcgtaggaacggtaccgtaccgggtccgttttaacgttcggttacggttcggtaccggtaccgacccccgggtacgtaccgggggtaaccgggggggtacccttaccgggtaccgggttccgtacggtacccggg

SEQ ID NO: 121456 - DNA, 641 bp, Homo sapiens
  misc_feature: GYAE6OF02GFMZE.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctgggatacaggttacaacgacttctatatacactgggtgcgacgacggcccctggacagggacttgagtggatgggatggactcgaaacccgtaagacgtggtgacacgacgcctctcgccgacaggtacggttaccgacgggcgagggttaccaccgtagtggagtgggtagaccgacggtaccgacggtacggaccgaccggtaccaacgacgtacgggtaaaccttaccgtaacggttccgtagtaaacgttcgtaggaaccgggtacacccgggttaccgttttaccgttcggttcggtacggtccgggtaaccggtaccccggtacggtacccgggggaaccggggggttacccgttaaccggtaccgggttaccggtacgggttaacccggg

SEQ ID NO: 121457 - DNA, 705 bp, Homo sapiens
  misc_feature: GYAE6OF02FSQWF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccacgtctcgaggtgcagctgatgcagtctgggctgaggtgaggaaggccgtggggccctcgagtgaagcctctcctgccaagaccttcgtcggataccgtacggtttccaaccggactttcctattactaaccgacgttggggtcaccgtacaccggccccgtagggaaccaggggacctttcggaggttcgggtagtggggtaatcgggacttaccaaacccgttaaaggaggttacggtaggaaccacgacggtaccctcggtcggaccacgaaggtacgggttacccgaagggaccgtagggtcctaaccgagtcggaaggtggtacgaccgaccggcccgtaacgacggaccgtaccggtaccaacgagttaccggaaaccttaccgagttacctacggtaacgtcgtacggaacgtaccgaccggttaccgttttacttacggttcgtaccggacggtacccggtaccccggtacggtaccgggggtaaccggggggtacccttaacgggtaacccggttacgtaccggtacccggg

SEQ ID NO: 121458 - DNA, 582 bp, Homo sapiens
  misc_feature: GYAE6OF02HZZKI.41.2.A02.1.454.CMB.1.raw
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagcgtggggctcgagtgagctctctgcaagtcttctggatacgaggttacaacgtcttactatactactacgtggtacgcgacgacgccccgtaggacgaggtacttggagtggagtgggatggataccgaaccgtaaggnggtgtagactagacgccttgngcacgaggacgtcgagggcgtacgggtacaccgagtgaggtggtgacgacgccgacgagccgacgtccacgagtacggaaccttaccgagtacgtagacgtcggtagacggtacgaccggttaccgtttacttcggtacgtggccgaaccggtccccggtaggaccggggtacccgggggtccttaacgggtcggttaccgtaggtacccggg

SEQ ID NO: 121459 - DNA, 608 bp, Homo sapiens
  misc_feature: GYAE6OF02GTLH4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctccgtgacagtacttctggatacgaggttacaacgtacttctatatacacgtgggtcgcgacgacggccccgtaggaccgagggtacttggaggtggagtgggagtggatacctaaaccgtaaggaggtggtacgacgacgacgtccgtcgtcgaccgaacgaggtaacgggtccgagggaccgagggtaccaccgagtggaggtggtacgacggaccggacgacggacgaccgaccggtacacgagtacgtaacttaccgagtctagacgtgacgacggacgtcggttccgtttacgttcgttggcgtaccggaccgtacccggcggtaccggggaccggggtccctaacggtacggtaccgtaggtacccggg

SEQ ID NO: 121460 - DNA, 609 bp, Homo sapiens
  misc_feature: GYAE6OF02F0ZHO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgaagctctcctgcaagacttctggatacaggttcaacgtacttctatatacacgtgggtgcgacacggccctggacagggacttgagtggagtgggatggatcgaacctaagagtggtagacacagcctctgcacgagtacggttccgagggcgagggtcaccgtagtggagtggtagaccgacggaccacggacgccgaccggtccaacgacgtacggaaccttaccgacgttacgtagtaacgtcgttacggaacgggaccgtaccgggttacccgttttacgttccgttgggttaccgtaccgggtaccggacccccggtcggttacgggggaacccgggggggtacccttaaccggtacccgggttacgtacgggtaacccggg

SEQ ID NO: 121461 - DNA, 652 bp, Homo sapiens
  misc_feature: GYAE6OF02G5VGD.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtggaggaagccgtggggcctcgagtgaacgctcctcctgacaagtacttgtaggactacgtacggttacaacgtacttactataatacacgtgggtcgacgtacgacggtccccgtaggaacgtacggggtaccttggaggtagggtacgtagggtagtggtaactaccgaaacccgtaaggtaggtaggtacgaacgtacacgcccttagcgtacgacgtaggtacggtccggaacgggccggtagggtaccaccgagtacggtaggtacgggtacgaccggacgggaccgacggacgaccgtacgaccaacgtcgtaacggtaacgttacgagttacgaaggtacgtcgaggaacgtaccgtacgttaccgttacgttcgtggtccgacgaccggtccccgagggtaccgggaccggggttcctacgggtaccggtacgtaggtcccggg

SEQ ID NO: 121462 - DNA, 847 bp, Homo sapiens
  misc_feature: GYAE6OF02JG8BN.41.2.A02.1.454.CMB.1.raw
  modified_base (192)..(192): a, c, t, g, unknown or other
  misc_feature (192)..(192): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgnggggctgaggtgaggaagccgtggggcctcagtgaagctctccgtgacaagtaccttcgtaggtataacgaggttcaaaccggtacttacgtaattaacgttaacacggttggggtacgcggaaccgtacgggtccccgtagggaaccgaagggggtaccgttaggacgggttgggtaaggtcgggggaagttacgggaacttaaccgtaaaccccgttaaagggtcggtacgggttacgaacccgtagtaaccggtccccgttactcggacccaaccggtaacgggtaccggggtttacccgggacgggggtacccggtaacggggtacccctaaccggtacggttagggaacgggtttacgggtaaccggtaacccggtaaccgggtaccccggtaaaccgggaaccggtcccggaaaccgggttaacccgaaccgtaacggttaaccgggtaaacccgttttaaccgacgggttttacccgtaaggtaacgggttacgtaaacgggaacgggtacccgtaccgggtttaccgttttaacccgtcggtttaccggtacgggaccggtaacccggtaccccgggtacgggtacccgggggtaacggggggtcccctttaacgggtaccgggttaccggtacggttaacccgggg

SEQ ID NO: 121463 - DNA, 769 bp, Homo sapiens
  misc_feature: GYAE6OF02JEYQ1.41.2.A02.1.454.CMB.1.raw
  modified_base (175)..(175): a, c, t, g, unknown or other
  misc_feature (175)..(175): n is a, c, g, or t
  modified_base (190)..(190): a, c, t, g, unknown or other
  misc_feature (190)..(190): n is a, c, g, or t
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacaggacgcccactctcaggtncagctgatgcagtcngggctgaggtgaggagccgtggggcctcgaggtgaacgtctctccgtgcaagtacttcgtggtactacgtaggttcaacgtactttactataactaacgtacgttcgggtacgtacgaaccgcggtacccctagggaccgtacggggtaccttaggaagttcgggaagttacggggtagtagggtacgttaccgaaacccggttaaaggtacggttaggtacgtaaacgaccgtaaggtcccttacgtacgaccgtacgacggtacgggttacccgacgggtacgacggggttacaccgatacgggaggtacgggtcgaaccggtaccggaccgacggaccggtaccggtaaccgggtccccgtaacggaacgttacgggtaaacccgttaccgtaacggtttaccgtaaccgggttacgtaccgtacggaacggggtaaccgtaacccgggttaccggttttaacgttcggttcgggttacggacccgggtaaccgtaccccgggtaacggttcccgggggtaaccggggggttaccctaacgggttacccggggttacgtaccgggttaacccgggg

SEQ ID NO: 121464 - DNA, 584 bp, Homo sapiens
  misc_feature: GYAE6OF02I18E0.41.2.A02.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
  modified_base (538)..(538): a, c, t, g, unknown or other
  misc_feature (538)..(538): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtggggcctcgagtgaagctctcctgacagacttcnggatacgaggttcaacgcttctatatacacgtgggtncgacacggccctggacgagggtacttggagtggatcgggatggactacaaccgtaaggacggtggtagacgacgacgcctntcgctacgaggtacggttccgagggacgagggtcaacgtagtggaggtggtcggacgacggacgacggacgtcgaccggtccacgagtacggtaacttaccgagttcgtagtacgtcgtagaacggacgtaccggttccgtttacgttccgtggttccgaccgtacggtaccccgnggtacgggaccgggggtaccgtacgtacgggtcgttacgtaccggg

SEQ ID NO: 121465 - DNA, 512 bp, Homo sapiens
  misc_feature: GYAE6OF02FIGPJ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctagagtggtgacacagcctctgcacagaggttccagggcagggtcacatgagtggtgacacggccacgacgccgacggtccacgattacggaacttaccgagtctgaagtctgaggcacggtcttacttcgtgtgcgtacgacccgcgtcgggacgggggtcctacggtacggtcgtaggtaccgg

SEQ ID NO: 121466 - DNA, 641 bp, Homo sapiens
  misc_feature: GYAE6OF02HH14E.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaacgccgtggggcctcgagtagaagctctcctgacaagacttcgtggatacgaggttcaacgtcttactatatacacgtgggtcgcgacgacggccccgtaggaccgagggtacttgagtggagtgggatggactaccaaacccgtaagcggtggtacgacacgagccctctgccagagtacggttccgagggcgagggtccaacgagtggacggtggtacggaccgaccggaccgaacggacgccgaccgggtccaacgagtacggtaaacccttaccgacgttcaggtaacgttcgtacggaacgggaccgaccgggttaccgttttaaccgtttccggtggttacggaccggtaacccggtacccccggtcggtaccgggggaaccggggggtcccgttaaccgggtaccgggttacgtaacggtacccggg

SEQ ID NO: 121467 - DNA, 612 bp, Homo sapiens
  misc_feature: GYAE6OF02H1K5V.41.2.A02.1.454.CMB.1.raw
  modified_base (392)..(392): a, c, t, g, unknown or other
  misc_feature (392)..(392): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactggtgcgacaggcccctggacagggacttgagtggatgggatggactcaaaccctaagagtggtagacacgacgcctctgcacagacggttccgagggcagggtcaccagtgagtggngacgacgccacgagccgacggtccaacgagtacggaaacttacccgagttaccgtaggtaaacgttcgtaggtacggaaccgtaaccgggttcccgtttttaaccgtttccgttaggttacggaccggtaacccggtaacccccggccggttacggggggtaacccggggggggtacccttaaccgggttaacccgggttaccgttaagggtaacccggg

SEQ ID NO: 121468 - DNA, 696 bp, Homo sapiens
  misc_feature: GYAE6OF02JL0DB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtcgaggaacgccgtggggcctcgaggtgaagctctcctgcaagtacttcgtggactactaggttacaacgtcttactaatatacgtacgtgggtcgtacgacgacggcccctagggaccgaaggggtaccttaggagtgggacgtagggatagggactacgaaacccgtaaggtggtacggtagaacacgtaagtcccgttactacggacgaacgacggtacgggttacccgaagggtaccggtacgggtaccgtaaccgaggtacggtaaggtacgggtacgaccgaccgggaccgtaacgggacgtacgaccgggtacctaacggacgtacggtaaacccttacgacgttaccgtagtaacgtcggtaagacggtaacgtacccggttacgtttaccttggtcggttacggtaaccgtaccggtaccccggtaggaaccggggtacccgggggtaccttaccgggttaacggttacccgtaacgggtcccggg

SEQ ID NO: 121469 - DNA, 531 bp, Homo sapiens
  misc_feature: GYAE6OF02FZGNZ.41.2.A02.1.454.CMB.1.raw
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgtacttctatatacacgtgggtgcgacacggcccctggacagggacttgagtggagtggatggatccaaccgtagagtgganacagagcctngcacgagtcgtcgagggcagggtcacgatgagtgtacgacgacggccacgacgcacggtccacgagtacgaacttaccgagtctagagtctagacggactaccggtcgtttactcgtggtcgcgtaccgacccgtgtaccggggaccggggtcctaccggtacggtcgtacggtaccgg

SEQ ID NO: 121470 - DNA, 669 bp, Homo sapiens
  misc_feature: GYAE6OF02JIHUB.41.2.A02.1.454.CMB.1.raw
  modified_base (338)..(338): a, c, t, g, unknown or other
  misc_feature (338)..(338): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtggggcctcgagtgaagcgtctcctgacagtactcgtggatacgtagttacaacgtacttactatataacgtacgtgggtcgcgacgacgccctaggacgaggacgttgaggtggagtagggtatgganaccgtaaaccgtaaggaggtggtacgaacgtacaacgtccctagtacgccgtaacgcggtaacggtttccgaagggtcgtaaccgggttccgaacccgtagttagaacgggtttagggacgaaccggaaccgggaccgtacggtaacgaccgtaaccgggtaccacgtaacggtaccgtaacgttaaccgaggtccgttaagggaaacgttcgtaaacggaagaccgtaccggttaccgttttaccgtcgttccggtaaggaccgtaaccggtcccggtaggtacggggaacccggggtccttacggtaaccggtcgtaagggtacccggg

SEQ ID NO: 121471 - DNA, 645 bp, Homo sapiens
  misc_feature: GYAE6OF02GUWO9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctcgagtgaagctctcctgacaagtaccttcgtaggtatacgtaggttacaacgtactttacgtattactacctacgtggggtcgcggacgacggccccgtaggaccgtagggacttggacggtggagtgggatgggactaccgaaaccgtagaggtggtacgacgacgacgtccctgcgacacgaggtacggttccgaagggtcgacgggtaccacgtagtggaggtaggtcgacgaccggccgaacggacgaccgacgtaccacgacgtacggtaaccttacgacgttcgtaagacgttcgtaggaacggtaccgtaccggttacccgtttcgtccgtggtaccggaccggtaccggtaccccggtggtaccgggggtaaccgggggtacccttaaccgggtaccgggttaccgtacgggtacccggg

SEQ ID NO: 121472 - DNA, 575 bp, Homo sapiens
  misc_feature: GYAE6OF02IPU2J.41.2.A02.1.454.CMB.1.raw
  modified_base (287)..(287): a, c, t, g, unknown or other
  misc_feature (287)..(287): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgtacttctatatacactgggtgcgacncggccctggacagggacttgagtggatgggatggatcaaccgtaagaggtgggtagacacgagccctcgtgacacgagtacgggttccgagggaccgacgggtccgaaccagtacggaggtggtcggacgaccggacctacggacgccgacgtccgactacgtcggtaaccttaaccgagttcgtagtacgtcgtacggacggacgtaccggtccgtttactcgtcggttgacgtacgacccgtaggtacgggaccgggggtacctacggtacggtccgtagtaccgg

SEQ ID NO: 121473 - DNA, 579 bp, Homo sapiens
  misc_feature: GYAE6OF02G9C2A.41.2.A02.1.454.CMB.1.raw
  modified_base (425)..(425): a, c, t, g, unknown or other
  misc_feature (425)..(425): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcgaacctaagagtggtgacacagtcctctgacacgagtacgttccgagggcgaagggtcaccgagtggaggtggtcgacgacggccaacgagccgacggtccanagtacggaaccttaccgagttctacggaagttcgtaggaacggtaccgaccgggttccgtttaacgttcgttcggttacgccggtaacggtaccccggcgtacgggggaaccggggggtcccttaaccggtaccggttccgtacggtacccggg

SEQ ID NO: 121474 - DNA, 625 bp, Homo sapiens
  misc_feature: GYAE6OF02GS3E8.41.2.A02.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (474)..(474): a, c, t, g, unknown or other
  misc_feature (474)..(474): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaacgccgtggggcctcngtgagctctcctgacaagaccttntggatactaggttacaacgtacttctataactacacgtgggtgaccgacgacggccccgtaggaccgagggtacttaggaggttggagtggggataggactaccgaaacccgtaaggaggtagggtactaacgacgtacgtcctctcgacctacgaacggtacggtaccgagggcgacgggtcacgtatgtaggtgtcgacgaccggcgacgacgccgacgccaacngtacgtaaccttacgagtacgtaggtaagtcgtaggaacgaccgtacggttaccgttttacgtcggtgtacggtaccggaccgtaccccggtacgggtaccggggtaacgggggtcccttaaccgggtacggtaccggtacggtacccggg

SEQ ID NO: 121475 - DNA, 519 bp, Homo sapiens
  misc_feature: GYAE6OF02FLUOW.41.2.A02.1.454.CMB.1.raw
  modified_base (332)..(332): a, c, t, g, unknown or other
  misc_feature (332)..(332): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagngtggtgacacagctctgcacagagttccgagggcgagggtcaccgatgagtggtgacgacggaccacggacgcgacgtccacagtcggaacttaccagtcgtgaagtcgtgagacgacggtccgtttacttcgtgtgacgacgacccgcgtcgggaccgggggcctacgtacggtacgtagtaccgg

SEQ ID NO: 121476 - DNA, 610 bp, Homo sapiens
  misc_feature: GYAE6OF02H00VG.41.2.A02.1.454.CMB.1.raw
  modified_base (206)..(206): a, c, t, g, unknown or other
  misc_feature (206)..(206): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
tcagtctatactatcacgaccggtgctcgatttagactcatctacagggggagcatcgacccagcaaccacatctgtcctctagagagtccctgagagctccgttcctcaccatggactggacctggaggatcctcttcttggtggcagcagccacaggacacccactctcaggtgacaggctgatgcagtcgtggggctggaggnggaggaacggccgtggggccctacgaggtggaaagtctccgttccgtggacaacgtacgttccgttggactaaacgcggttacaacgtactctaatacttacacgttggcgacgactacgcccgtacgganaacggggtcttaggagtcgganaggctggataccaacgtagaagtggtagacaacngtcctcgtgacacaggtcgtaccgaggnacggtcacagtgagtagtgacaagccgagcgacgttacncacagtacggtaaacttacgacgttcgataacgtcgtagaacgggtactaacgggtcccgtttttaacgtacgtcggttaacgcgtaccggaccccgagggttaccggggaccgggggtaccttaacggtcccggtaggtagtaacccgg

SEQ ID NO: 121477 - DNA, 616 bp, Homo sapiens
  misc_feature: GYAE6OF02IROVV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgacaagacttctggatacaggttcaacgacttctatatacacgtgggtgcgacgacggcccctggaccagggtacttgagtggagtgggatggatacaacctaagagtggtagacgacacgcctcgtgcgacgagtacggttaccgagggcgagggtaccacgtagtggagtgggtacgacgacggaccgacggacgaccgacggtccacgtactacggtaaccttaccgagttcctaggaagttaccgtaggtaacggaccgtaccggttaccgttttaaccgtttccggtggttacggaccggtaacccggaccccggttacggtaccgggggtaccgggggtaccctaacggttacccgggtacgttacggtaacccggg

SEQ ID NO: 121478 - DNA, 677 bp, Homo sapiens
  misc_feature: GYAE6OF02GHXKI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagcctggggcctcgagtgaagctctcctgcaagactttctggatacgaggttccaacgtacttctatatacacgtgggtcgcgacgacggcccctggacgagggacttggagtggagtgggatggactacctaaaccgtaagacggttggtacgacgacgacgtcctcgtcgacacgaggtacggttcccgagggtccgaacggggtccaaccgagtggaggttggtacgaccgaccggtacccgaacggacgtccggaccgggtacccacgtaagtaccggaacctttacccgaggttcgttacggaacgttccgtacggaacgggtaacccgtaccgggtttacccgtttttacgtttaccgtgggttaccggaccggttaacccgggacccccggttacggtaccggggggtaacccggggggtacccttaaccgggttaccggttaccgtaccggtaacccgggg

SEQ ID NO: 121479 - DNA, 635 bp, Homo sapiens
  misc_feature: GYAE6OF02HQ515.41.2.A02.1.454.CMB.1.raw
  modified_base (214)..(214): a, c, t, g, unknown or other
  misc_feature (214)..(214): n is a, c, g, or t
tcagtctatactatcacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccggnaagtcagagcattaggaacttctttaaattggtatcagcagaggccgaaggaacgcccctacaactcctgatctatgctgcgttcctattttgacaaaggtcggggtacccagtactaaggttcaggttcggactaggtgacgttcgtagggactagtagtttaccacttcctacaccatcagctagttctacgactaaccgtgtaagtacgtttccgctagttacctttagttacttacgtacctaacgtaagtagttacgaaaccttaaacgtacccgttacccgtaccgttacttaacccgggtttttacccgggaccggggttaacggggtaacccttaaacgggttttacggttaaggggtaacgttaacgttaaccgtaaaaaccggtaaccgtttagggtaccggttaacccgg

SEQ ID NO: 121480 - DNA, 539 bp, Homo sapiens
  misc_feature: GYAE6OF02HMERC.41.2.A02.1.454.CMB.1.raw
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (492)..(492): a, c, t, g, unknown or other
  misc_feature (492)..(492): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgtacttctatatacactggggtgcgacacggccctggacagggacttgagtggatgggatggatcaacctaagngtggtgacacagcctntgcacgagtagtccgagggcgagggtcacagtgagtggtcgacgacggcacgagcacggtccacagtacggaacttaccgagtctagacgtcgtagacggacacggttccgtttacgttcgtgtcgacggtacgtccccggngtacggggaaccgggggtccgtaccggtacggtaccgtaggtaccgg

SEQ ID NO: 121481 - DNA, 664 bp, Homo sapiens
  misc_feature: GYAE6OF02G2WL5.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagccgtggggcctcgagtgaagctctcctgacaagtacttcgtggatacgaggttacaacgtacttactatactacacgtgggtcgcgacgacggccccgtaggaccgaggggtacttggaggtggaggtggggatgggtaactaccgaaacccgtaaggtaggtgggtacgacacgacgtcctacgacgcgaacgaggtacggttccgacgggtcgacgggtaccaccgtagtcggaggttcgggacgacgaccggtaccgacggacggaccgtaaccgggtccaacgtacgtacgggtaacccttacccgagttcgtagtacgtcgtaggaacggtaccgacggttacccgttttacgtcggttacggtcggaccggtaaccggtccccggtacgggtaccggggggtaccgggggtacccttacgggttaccgggtacgttaccgggtaccggg

SEQ ID NO: 121482 - DNA, 508 bp, Homo sapiens
  misc_feature: GYAE6OF02HNPMK.41.2.A02.1.454.CMB.1.raw
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtgatgggatggatcaaccctaagagtggtnacacagcctntgcacagagttccagggcagggtcaccgatgagtggtgacgacggcacgagccacggtccacatgaacttaccagtctgaagtctgagacacggccgtttacttcgtgtcgcgacgacccgcgtcgggaccggggggcctaccgtacggtacgtagtacgg

SEQ ID NO: 121483 - DNA, 667 bp, Homo sapiens
  misc_feature: GYAE6OF02HD7WA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgacaagtacttcgtggatacgaggttacaacgtacttctatactacacgtgggtgcgacgacggcccgtggacgagggtacttggagtggagtgggatggactaccgaaaccgtaggagtaggtagaacacgacgccttcgcgacacgtacggtacggtaccgagggcgtaacgggtaccaccgtaggtacggtagggtacggtacgaccgtaccggaccgaacggacgaccgaccggtaccaacgtacgtacggtaacccttacgtacgttacgtaacggtacgttcgtaggaacgtaccgtaccggttaccgttttaacgttccggtggtaccggtaccggtaacccggtaccccgggttaggggttaacccggggggacccgggggttacccttaacgggttaccgggttaccggtacggttacccgggg

SEQ ID NO: 121484 - DNA, 721 bp, Homo sapiens
  misc_feature: GYAE6OF02IQWPJ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcgagtgaagcctctcctgcaagtacttcgtggattacgaggttccaacgtacttctatatacacgtgggtcgcgaccgacggccccgtggaccgtagggtacttggacgttgggagtggggtatgggtactaccgaaacccgtaaggtacgtaggtacgaacacgacgtccgtcgtcgaccgaaccgtaggtacgggttaccgacggggtacgtacggggtccaaccggtagttcggtaggttacggacggtaacccgaccggggaccgtaaccggacggacccgtaacccgggtacccaacgtacggttaccggtaaacccgttaccgtaacgttacgttaacggtaacgttacgtacgggtaaaccgggaccgttaccgggtttacccttttaacggtttcgtcgggttaccggtccggaacccggttccccgggagggttaccggggggtaacccggggttcctacccgggttaccgggttaccgtacggttacccgggg

SEQ ID NO: 121485 - DNA, 576 bp, Homo sapiens
  misc_feature: GYAE6OF02FRH00.41.2.A02.1.454.CMB.1.raw
  modified_base (277)..(277): a, c, t, g, unknown or other
  misc_feature (277)..(277): n is a, c, g, or t
tcagtctatactatcacgaccggtgctcgatttagactcatctacagggggagcatcacccagcaatcacatctgtcctctagagagtcccctgagagctccgttcctcaccatggactggacctggaggatcctcttcttggtggcagcagccacaggagcccactctcaggtgcagctgatgcagtctgggctgaggtgaggagcctgggcctcagtgaagctctcctgcaagacttctggatacaggttcaacgacttctatatacactgggtnacgacaggcccctggacagggacttggagtggagtgggatggatcaaacccgtaagagtggtgacacgacgcctctgccacgagtacggttccgagggcacggggtccacgatagagtggtgacgacggccgacgacgacgaccggtccacgacgtaggaaccttaccgaacgtccgttagaacgttccgtaggaacggaccgtaccgggtaccgttttaccgttcgtagtcggacgtaccggacccccgtcggtacgggggaacccggggggtccctacggttaccggtcgtaaccgg

SEQ ID NO: 121486 - DNA, 592 bp, Homo sapiens
  misc_feature: GYAE6OF02GAVGO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttactatatacactgggtgcgacaggccctggacagggacttgagtggagtgggatggatcaaccctaagagtggtgacacagcctctgcacagacggttccgagggcagggtcacagtgagtggtgacgacggccaacggtacgaccgacgggtacccaacgacgttacggaaaccttaccgaagttccgtaggaaacgttcctaggacggtaacgaccgggttcccggttttaactccggttggtacggccggtaaccggaccccggtcgtacgggggtaaccggggggtcccttaacggttaccgggttacctacgggtaacccggg

SEQ ID NO: 121487 - DNA, 596 bp, Homo sapiens
  misc_feature: GYAE6OF02IN3RV.41.2.A02.1.454.CMB.1.raw
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggacgccgtggggccctgagtgaagcctctcctgacaagtcttcgngactacgtaggttacaacgtacttactatactacgtacgtggtcgacgacgacggcccgtaggacgaggtacgttggaggtggagtggatggactaccgaaaccgtaagaggtaggacgacacgacgtcctcgtcgacacgaggtacggtacgagggacgacggtacacgtagtagagtggtacgaccgaccggaccgaacgacggaccgaccggtaccaacgacgtacgtaaccgttaccgagttaccgtagacgttcgtaggaacgacgtaccggttctttacgttcgtggtacgcgaccgtcccgacggtacgggaccgggtacctacggtacgtacgtagtacg

SEQ ID NO: 121488 - DNA, 631 bp, Homo sapiens
  misc_feature: GYAE6OF02HP5BA.41.2.A02.1.454.CMB.1.raw
  modified_base (192)..(192): a, c, t, g, unknown or other
  misc_feature (192)..(192): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (437)..(437): a, c, t, g, unknown or other
  misc_feature (437)..(437): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagccacaggacgcccacgtctcaggtgcagctgatgcagtcgnggggctggaggtgaggaacgccgtgggcctcgagtgaacgctcctccgtagctaaacggtcttcgtaggactacgtaggttacaaacgtacttctaatactaacgtacgttgggtcncgtaacgcggtccctgacgagggtcttgagtggagtggagtgactacgaaaccgtaggagttggacanacgngaccttcgagccgaagaggtaacgttccgagggtaccgtacgggacaccggtaagngggtacggttcgggacgaacgacgggacccaacggacggttacccaacgggaccaactaaggacgtaaaccttacgacgtccgtaagacgtacgtagaacgaccgtacggttcctttactttgcgtcgacgacccggtccgtacggtgggggaacccggggttcctaacggttaccggagttaccggtaccggg

SEQ ID NO: 121489 - DNA, 543 bp, Homo sapiens
  misc_feature: GYAE6OF02HXT6I.41.2.A02.1.454.CMB.1.raw
  modified_base (286)..(286): a, c, t, g, unknown or other
  misc_feature (286)..(286): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacactgggtgcgacnggcccctggacagggcttggagtggatgggatggatcaacctaagagtggtagacacgagcctctgcacgagtaggttccagggcagggtcacgagtgagtggtagacgacggccacgacgcgacggtccacagtacggaacttaccgagtcgtagaacgtcgtagacggacgaccgggtaccgttttacttcgtcgtggcgtaccgacccgtcggtacggggaccgggggccctacggtacggtcgtaggtaccgg

SEQ ID NO: 121490 - DNA, 712 bp, Homo sapiens
  misc_feature: GYAE6OF02FINDE.41.2.A02.1.454.CMB.1.raw
  modified_base (195)..(195): a, c, t, g, unknown or other
  misc_feature (195)..(195): n is a, c, g, or t
tcagtctatactatcacgaccggtgctcgatttagactcatctacagggggagcatcacccagcaaccacatctgtcctctagagacgtcccctgagagctccgttcctcacctatggactggacctggaggatcctcttcgttggtcggcagcagccacaggagcccactctcaggtgcagctgactgcagtcnggggctggaggtgacggagccgtggggcctgagtagagctactctgcagacttgtggatacgacggttcaacgaccttacgtatactacctacgttgggtgcgactacggccccgtaggacagggtacttaggacgtcggagtgggacgtggacgtacgaaacccgtaagtagtgggtacgacaacgaacgtccgttacgtacgccaacgacggtacgggtttaccgaggggcctaagggggtccaacccggtagtacggagggttagggtacggaaccgtaccgggcccaacggacgacccgtaccggtacccaacgtagttaccgggtaaaccttacccgaagttaccgtacgtaacgtaccgttaggaaccgggtaaccgtacggggttacccgttttaccgttccggtacggttccggaaccggtacccggtacccccggtacgggttaccggggggaacccggggggtacccgttaaccgggtaccgggttaccgttaccgggtaacccggg

SEQ ID NO: 121491 - DNA, 533 bp, Homo sapiens
  misc_feature: GYAE6OF02F0NIC.41.2.A02.1.454.CMB.1.raw
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggccctggacagggacttgagtggatgggatggatacaaccctagagtggtgacacagcctcngcacagaggttccagggcgagggtcacgatgagtggtcgacacggccacggacgccgaccggtccacgagtcggaaccttacgacgtctagaacgttcgtagaaggaccgaccggtacgtttacttcgtcgtcggcgacgacccgcgtgggaccgggggtcctacgtacggtcgtacgtaccgg

SEQ ID NO: 121492 - DNA, 596 bp, Homo sapiens
  misc_feature: GYAE6OF02GNB9T.41.2.A02.1.454.CMB.1.raw
  modified_base (283)..(283): a, c, t, g, unknown or other
  misc_feature (283)..(283): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgtacttctatatacactgggtcncgacgaggccctggacagggacttgacgtggagtgggatggatacaaccgtaagaggtggtagacacgcgtcctctgacacgagtacggtccgagggcacggggtcaccgtagtcggaggttggtacgaccgtacggccaacggtagaccgacgggtacccacgtagtacggaaccttaccgagtaccgtacggtaagttctaggaacggaccgtaccgggttccgtttacgttcgtcggtacgtccggaaccgtacccggtcgtacgggggaacccggggtccttacggtaccgggtactacggtacccggg

SEQ ID NO: 121493 - DNA, 526 bp, Homo sapiens
  misc_feature: GYAE6OF02GGI8E.41.2.A02.1.454.CMB.1.raw
  modified_base (301)..(301): a, c, t, g, unknown or other
  misc_feature (301)..(301): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
  modified_base (488)..(488): a, c, t, g, unknown or other
  misc_feature (488)..(488): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatactaggttcaacgacttctatatacacgtgggtgcgacaggcccctggacngggacttgagtggatgggatggactcaaacccgtagagtggtagacacagcctcgtgcacagacggttccagggcagggtcaccgagtgaggtggtgacgacggccagacgcgacgccanagtagacttaccgngtactgaagtctgacggacacgtcccgtttattcgtcgtcgcgaccgacccgngtacgggaccggggccgtacgcgggtactaggtaccgg

SEQ ID NO: 121494 - DNA, 723 bp, Homo sapiens
  misc_feature: GYAE6OF02JA0BW.41.2.A02.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
tcagtctatactatcacgaccggtgctcgatttagactcatctacagggggagcagtcacccagcaaccacatcgtgtcctctagagagtcccctgagacgctccgttcctccaccatggactggacctggaggatcctcttcttggtcggcagcagccacaggacgcccacctctcgaggtgcagcctagatgcgagtcgngggctgaggtgaggagccgtgggctcgaggtgaagctctactgacaacgacttcnggatacaggtcaacgcttctatatacagtaggtcgacgacgacggccccgtagggaccgagggtacttcggacgtgggaagtgggattgggaactaccgaaacccgttaaggacggttacgggtacgaaccgaacgacggtacccttagttccggaaccgacggtacgggtacgggtttaccccggaacggggtaccggaacggggttaccaccggtaacggttagggtacggttacggggttaccgaacggtacccggaccggtaaccgtacggacccgtacggtacccgacgtacgtaacgggtaccttaaccgacgttacgtagtacgttcgtacgggtaacgaaccgtaccggtaccgttttacgttaccggtaggttaccggacgtacccggaccccgtccggtaacgggggacccgggggtacccttacccgggtaccgggttaccgtaggttaccccgg

SEQ ID NO: 121495 - DNA, 673 bp, Homo sapiens
  misc_feature: GYAE6OF02JA0FE.41.2.A02.1.454.CMB.1.raw
  modified_base (191)..(191): a, c, t, g, unknown or other
  misc_feature (191)..(191): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgnggggctgaggtgaggagccgtcggggcctcagtgaagctctcgtgacaagtaccttgacgggtatacacggtttacaaaccgtactttactaataataccgtacgtggggtcgacggtaaccgacgggtccccctagggaccgagggtaccttggaggtaggaggttacgggagtgggactaccgtaaacccgtaaggtaggtacggtagaaccgtactacggtacccttcgacgtaccagtaacgggtacgggttacccgaacggggtaccgtacgggttacccaacccgtagtacgggtaacggttgggaccgtaccgacggacccgtaaggacggtaccgtacccgggtaccaacgtagtaccggtaaccttacggagtacgtagagtacctaggacgacgtacggtcctttatcgtcgagccgaccgtcccgtaggtccgggtaccgggtacctacggtacggtacgtacggtacggg

SEQ ID NO: 121496 - DNA, 627 bp, Homo sapiens
  misc_feature: GYAE6OF02JDLJM.41.2.A02.1.454.CMB.1.raw
  modified_base (190)..(190): a, c, t, g, unknown or other
  misc_feature (190)..(190): n is a, c, g, or t
  modified_base (285)..(285): a, c, t, g, unknown or other
  misc_feature (285)..(285): n is a, c, g, or t
  modified_base (363)..(363): a, c, t, g, unknown or other
  misc_feature (363)..(363): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcnggggctgaggtgaggaagccgtggggcctcgagtgaagctctcctgcaagacttcgtggatacgaggttcaacgtacttctatatacactgggtncgacacggccctggacagggtacttgagtggagtgggatggactacgaaacccgtaagagtggtcgaacacgagcctntcgacacgagtacggttaccgagggcgtaacgggtccaaccgtataggaggttggtacgacgaccggcctaacggacgtaccgaccggtaccacgtaacgtacggtaaaccttaccgagttaccgtaggtaacgttcgtaggaacggaccgtaccgggttaccgttttaacgtccgttaggtccggaccggaccggtaccccggtacggtaccgggggtaaccgggggtccttaaccgggtaccgggttcgtaacggtaccggg

SEQ ID NO: 121497 - DNA, 854 bp, Homo sapiens
  misc_feature: GYAE6OF02HDRLW.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagccgtggggcctcgagtgagctctcctgacaagcttcgtggaatacgtacggtaccaacgtactttctaacttataacgtacgtcgggtacgacgtaacgtaccggccccgttagggaacggtacgggtacgttaggagggttagggtaacgtggggtacgtacggtaaacgtaccgtaaaaaccccgttaaggtaaccgggttgggtacgtaaaccgtaaccggtacggtaacccttcgttacggacccgaacgttaacgggttaaccggttaccggacggggtaccgttaaccgggggtaacccaacccgtaaggtacgggtaacgggttacgggtacggtaaccgaaccggggtacccgtaaacgggtaaccgaccgtaacccgggtacccgtaaccgtaacgggttaacccgggtaaaccgttttaacccggacggtttaaccggtaccggttaaacggtaccggttacgggaaaccgggttaccgtaaccccgggttttaccgttttaaccggttaccggttacgggtacccgggtacccgggtaacccgtaccccccggggtaaacggttcccgggggggtaaacccgggggttccggttaaacccgggttacggggtacccggttaaggtaccccggggg

SEQ ID NO: 121498 - DNA, 914 bp, Homo sapiens
  misc_feature: GYAE6OF02GZMTO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagcgtagatgctagtcggtgggtactggaggtaggaggaacggccggtcgggtcctacgtaggacgtaacgtccgttaccgtccgtagaaccgtaacggttaccgtttccggtaggtaacgttaaccggttacggttaacccgtaaaccggttaccttttaaccgttaattaacgttaaccgtacgggttcggggtacgaacccggtaacccggtacccgggtacccccggttaggggaacccggtaacggggttaccggtttacggaagggttcggggaggttaggggtacgttacgggaacttaaccccggtaaaaccgtagggtacggtttacgggtaacgaaccgtacggtaccgtccgttacgtacggaaccgtacggtaacgggttaccggtacccgggaagggaccggttaaccgggtaccaacgttaaggtacgggttacgggtccgggtaacgaccgggtaacccggaaccgtaaacgggccgtaaccgggtaacccgtccgtaaacggtaaggtaacccgttaaacccgttaaccggacgtttaaccgttaacgggtaacgttaccggtaacgggaaaccggttaccggttacccgttttacccgttttacggtacggttccgtaacgggacccgtaaccgggaccccggtttacggggaacccgggggggtaaccccgggttactttaaccggggtacccggttaacggttaccgggtaacccgggg

SEQ ID NO: 121499 - DNA, 630 bp, Homo sapiens
  misc_feature: GYAE6OF02HK5MR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggaaggccgtgggcctcgagtgaagctctcctgcaagacttctggactacgaggttcaacgtacttctatatacacgtggtgacgacgacggcccgtaggacgagggtactggaggtggtagtgggagtggtactaccgtaaccgtaggtaggtggtacgacacgacgtccgtacgcgtacgacgtacggtacgggttaccgaggggtaccgagggtaccaccgtaggtggaggttcggtaggaccgaccggccgacggacgaccgacgtccacggtatacggtaaccttacgacgtcgtacgtagtcgtagacgaccgtacggttaccgtttacgtccgttaggtcggaccgtaccggtaccccggagggtaccgggggaccgggggtacccttaaccgggtaccggtacgtacggtaccggg

SEQ ID NO: 121500 - DNA, 699 bp, Homo sapiens
  misc_feature: GYAE6OF02G2L78.41.2.A02.1.454.CMB.1.raw
  modified_base (610)..(610): a, c, t, g, unknown or other
  misc_feature (610)..(610): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggacgccgtgggcctcgagtgagctctctgacaagtacttcgtggactacgtaggttacaacgtacttctatactacgtacgtgggtcgcgtaccgaccgggtcccctagggaccgtaggggtaccttaggaggttaggaggtgggataggacttaccgaaacccggtaaaggtggtgggtacgaacgacggaatcccgtatcggaccgtaaccgtagggttacgtacccggacggggtaccgtacgggtaccctaaccgaggtaggacgggttacggtagaacccggacgggcccaaacggcgaccggaccggtaccaacgtacgttaacggaccgttaccgacggttacacggtacgtaccgtaggaccgggaactacccggggtttacctttacgtttaccggnggttacgggacccgtaaccgggacccccgtagggaacccggggggtacggggtaccccttacgggtaaccggtcgtaccgggtaccggg

SEQ ID NO: 121501 - DNA, 508 bp, Homo sapiens
  misc_feature: GYAE6OF02F7SDL.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatacaacctaagagtggtgacacagcctctgcacagaggtccaggcgaggtcacatgagtggtgacacggccacgagcacgtccacagtggaacttacgagtctagagtctggacgacgacggtcgttacgtcgtggtcgcgacgacccgcgtcgggacgggggtcctacggtacggtctaggtaccgg

SEQ ID NO: 121502 - DNA, 557 bp, Homo sapiens
  misc_feature: GYAE6OF02FIXE9.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgagctctcctgcaagacttctggatactaggttcaacgtacttctatatacacgtggtncgacaggcccctggacagggacttgagtggatgggatggatcaaccctagagtggtgacacagcctcgtgcacgagacggttaccgagggcagggtcaccatgagtggtgacgacggccacgacgccgacgtccacgactacggaacttaccgagttactagaacgtctagacggaccgacggttaccgtttacttcgtcggtggaccggtaccggtacccccgcggttacggggaaccggggggtcccttacggtaccggtccgtaggtacccggg

SEQ ID NO: 121503 - DNA, 671 bp, Homo sapiens
  misc_feature: GYAE6OF02F3UP6.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggggctggaggtgaggaagccgtggggcctcgaggtgaagctctcctgacaagcttgtggatacgtaggttcaacgtacttactatatacacgtgggtgcgacgacggccctaggacgagggtacttggaggtggagtgggagtggactaccgaaccgtaaggaggtagggtagactacgacgtccgtacgtcgacgtaacgaggtacgggtccgaggggacgtaacgggtccaccgtagtcggaggttcgggtacggaccgtaccggaccgaacggacgtaccgaccgggtaccaacggtacgtaacggaaccttaccgtacgtacgtacgtaagtcgtaggaacggtaccgtaaccgggttcgttttaccgttcggtcggtacggtaccggtacccggtaccccggtcgggttaaccgggggaacccgggggttacccgttaacgggttacccgggtaccggtacgggtaaccgggg

SEQ ID NO: 121504 - DNA, 745 bp, Homo sapiens
  misc_feature: GYAE6OF02GMWPY.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgcaagacttcgtggatacgaggttcaacgtcttctatatacacgtgggtgcgacgacggcccctggacgagggacttgagtggagtgggatggactaccgaaaccgtaaggagtagggtgaaccacgacgcccttcgtacgaccgaaccgaggtaccgggttacccgaacggggaccgtaacggggttacccaaccggtaagttacgggaacgggttgggtacggaaccggaccgggacccgaacgggtaacgacccgtaaccgggtacccaacggtacggttaaccgggtaaaccctttacccggaacggttaccgttaacgggtaaacgttaccgtagggtaaacgggtacccgtaaccgggttttaccccgttttaaccgtttaccgggttcgggttaccggtacccgggtaacccggttaacccccgggcgggttaaccggggggaacccggggggttaccccttaacggggttacccgggtttacgtaacgggtaccccgggg

SEQ ID NO: 121505 - DNA, 643 bp, Homo sapiens
  misc_feature: GYAE6OF02GSFJA.41.2.A02.1.454.CMB.1.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (397)..(397): a, c, t, g, unknown or other
  misc_feature (397)..(397): n is a, c, g, or t
tcagtctatactatcacgaccggtgctcgatttagactcatctacagggggagcatcacccagcaaccacatctgtcctctagagagtcccctgagagctccgttcctccaccatggactggacctgggaggatcctcttcttggtggcagcagccacaggagcccactctcaggtgcagctgatgcagtcgnggggtctgaggtgaggaagccgtggggccctagagtaggaacgtcgtctccgtggcaagactttcnggtaatacgtaggtaccaagactttactaatatacaacgtgggtgcggacaacggcccctaggaacgagggtaccttaggagtcggagtagggatggataccgaaacctaggacgtggtacgacaactagtccccgtnttaacgccgtaacgaacgggtacggtttaccggagggtaccgtaacgggtccgaaccgtagtacgtaggtcgggttagaccgtaccggaccgaacgacgacccgtaccggaccaacgtacgtacgtaacgttaccgtagtactacgaacgttcgaggaacgtacgaccggttaccgttactacggtgtagcgaaccggaccgtcgggaacgggtccgggggaccttacggcggtacgtacgtacgg

SEQ ID NO: 121506 - DNA, 612 bp, Homo sapiens
  misc_feature: GYAE6OF02G33M2.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacatgggtncgacacggcccctggacaggggacttggagtggagtgggatggactacaaccgtagagtggtagacgacagcctctcgcacgagacggttaccgagggcgacggtcaccgagtaggaggtggtcgaacgtaccggacctacggacgaccgaccggtccacgtagtacggtaaccttaaccgacgttacgtacggaacgttcgtacggacggtaccgtaccgggttccgtttaccttacggttcggtcggtaccggaccggtaccccggtacggtaccgggggtacccggggggtacccgttaccggtaccgggttaccgtacggtacccggg

SEQ ID NO: 121507 - DNA, 610 bp, Homo sapiens
  misc_feature: GYAE6OF02GYIRE.41.2.A02.1.454.CMB.1.raw
tcagtctatactatcacgaccggtgctcgatttagactcatctacagggggagcatcccccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggagccgtggggcctcgagtggaagctcctcctgcaagaccttctggatacgaggttcaacgacttctatatacactgggtgcgacacggcccctggacgagggacttggaggtggagtggggatggattacaacccgtaagaggtggtagacacagccgtctacgccaacgcgtacgggttccgaggggcgacggggtaccaccgagtcggaggtgggtagaaccgccgggtaccgacggacgccgaccggtccactagtacggtaacgtacctacggtctaggaacgtcgtaggacggtacgtaccgggtcctttacgttcgtcggtcgaccggaccggtaccccggtggtaccgggggaaccgggggttcctacggtaccgggtcgtacggacggttccgggg

SEQ ID NO: 121508 - DNA, 738 bp, Homo sapiens
  misc_feature: GYAE6OF02I8A4W.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtggggctgaggtgaggaagccgtggggcctcgagtgaagcctctcctgacaagtacttcgtaggacttaacgacggtttaccaaacggtactttactaattaacgtaaccgtacggttagggtcgaccggtaactaccggtccccgtaggacgagggtacttaggagtacggtgtaggagtggactaccgaaaccgtaaggtagttacggtacgaacgaaccgtagtacccttacgtcggaccaacgtaacggttacggtacccggtaagggtacgtaacgggtaccgaaccgtaaggttacggtaaggtcgggtacgaccgaccggaccgacgtacggccgaaccggtaccacgtacgtaaccggtaaccgttaaccgacgttacggtaacggtaacgtcggtaacggtaacggtaccgttaaccggttcccgtttaacggttacggtccggttaccggaccggtacccggtaccccggtcgggtaaccgggggtacccgggggtaccttaaccgggtaccggttacggttaccggtaacccggg

SEQ ID NO: 121509 - DNA, 638 bp, Homo sapiens
  misc_feature: GYAE6OF02JMW12.41.2.A02.1.454.CMB.1.raw
  modified_base (249)..(249): a, c, t, g, unknown or other
  misc_feature (249)..(249): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtagaggaacgccgtggggcctcaggtgaagctctcctgcaagacttcnggactacaggttcaacgacgttctatatacacgtgggtgtacgacgaccggccccttagggaccgtaggggtaccttggaggtcgggtagtcggggagtgggataccgaaacccgttaaaggacggtggtacgaaccgaacgagtaccctcgtacgcacgaggtacggtaccgagggtcgaggtacgaccgatggagtggtcgacgtacggaccgacggacgcaccggtccacacgtagaaccgtaaccgagtcgtacgaacgttcgtaacgacgggacctaacggtccgttttaccgtcgttcggtaccgtacgaacccggtaccccgtagggtacccggggaacgggggtacccgttacccggttacgggtaccgtacggtaccggg

SEQ ID NO: 121510 - DNA, 581 bp, Homo sapiens
  misc_feature: GYAE6OF02F35BR.41.2.A02.1.454.CMB.1.raw
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgaagctctcctgcaagacttctggatacaggttcaacgacttctatatacacgtgggtgcgacacggcccctggacagggacttggagtggatgggatggatcaacctaagagtggngacacagcctntgcacagacggttccagggcgagggtccacgagtgaggtggtgacgacggaccacggacgccgacgtccacgacgttacggaactttacccgagttcctaggtaacgttcgtggaacggaccgtaccggtccgttttaacgttccgtggttacgacggtaccggaccccggtcggtacgggggaacccggggggtacccgttaaccggtaccgggttccgtaggtacccggg

SEQ ID NO: 121511 - DNA, 604 bp, Homo sapiens
  misc_feature: GYAE6OF02ICNY2.41.2.A02.1.454.CMB.1.raw
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagctggggcctcagtgaagctctcctgcaagacttctggatacaggttcaagacttctatatacactaggggtgcgtacacggccctggacagggacttgagtggagtgggatggatcaacctaaggngtggngacacgagcctntcgcacgagacggttcgagggcagggtcacagtgaggtggagacgacggaccgacgagcgacggtccaacgagtacggtaaccgttaccgagttaccgtagtaaacgtcgtacggtaaggaccggtacgggttacccgttttaacgttaccgttcgggttacgacgggtacccgaccccgggtaccggttacggggaaccggggggggtcccttaaccgggtaccgggttaccggttacgggtaacccgggg

SEQ ID NO: 121512 - DNA, 575 bp, Homo sapiens
  misc_feature: GYAE6OF02GGPHC.41.2.A02.1.454.CMB.1.raw
  modified_base (368)..(368): a, c, t, g, unknown or other
  misc_feature (368)..(368): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcagtgaagctctcctgcaagacttctggatacgaggttcaacgtacttctatatacacgtgggtgcgacgacggccccgtggacgagggacttggagtggagtgggatggactaccgaaaccctaaggcgtggtacgacacgacgcctcngacacagtacggttccgagggcgagggtccaccgagtgaggtggtacgacgacggccgacggacgcgaccggtccaacgagtacggaaccttaccgagtcgtagaagtcgtggaacggcctaccggttccgtttacttcgtggtcgaccgacgaccccggtggtaccggggaaccggggtcctaccggtacggtacgtaggtaccgg

SEQ ID NO: 121513 - DNA, 686 bp, Homo sapiens
  misc_feature: GYAE6OF02IAL1O.41.2.A02.1.454.CMB.1.raw
tcagtctatactatcacgaccggtgctcgatttagactcatctacagggtgagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgaggagcgtgggcctcagtgaagctctcctgacaagtacttgtggatacgaggttacaacgtcttactagtataccacgttggggtcgaccgacgaccggcccctaggaccgaaggggtacctttaggaggtgggtagtagggtagtaggaccgttaaccgaaacccgtaggtacggtttcggtaagaaccgacgaacggtccctacgtaccgagtaacgtacggttaacgggttccggaaggggaccgtaggggacctaaccggtaagtgggaacggtttcggacgtaccggacccgggaccaacgggtaccgcgtacggaccctaagtacggttacggtaaccttaaccgcggtacgtaagacgttcgtaggaaccgacgttacccggtttacctttcgtaccggttggtccggccggtaaccggcccggtacgggtaccggggaccggggttacccctaggtacggttccgtaaccgggg

SEQ ID NO: 121514 - DNA, 584 bp, Homo sapiens
  misc_feature: GYAE6OF02HFRO8.41.2.A02.1.454.CMB.1.raw
  modified_base (350)..(350): a, c, t, g, unknown or other
  misc_feature (350)..(350): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgtacttctatatacactggtgcgacaggcccctggacagggactggagtggagtgggatggatcaacccgtaagagtggtgacacagccctntgcacaggacggttccagggcgacgggtacaccgagtagaggtggtagaccgacggcccgaaccggagaccgacggtaccacgacgtacggaaccttaaccgacgttacctggtaacgtcgtacggaggaccgtacggtcccgtttaacttcggttacgtcgtacggtaccgaccccgtcggtaccgggaaccgggggtacccttaccggtaccggttccgtacggtacccggg

SEQ ID NO: 121515 - DNA, 675 bp, Homo sapiens
  misc_feature: GYAE6OF02I3OU5.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtggaggaagccgtggggcctcgagtgagctctctgcaagacttctggatacgaggttacaacgtcttctatatacactgggtgcgacgcggccctaggacgacggtctgagtggagtgggatggacacgaacctaaggcgttaggtacgacacgacgtcctacgtacgacgacgacggtacggttaccggacgggacgtaccgggtacaacccgtagtacgggtacgggtgggtacggtaaccggaaccgggcccaaccgggacgaccggtacccggtaccgaaccgtacggtaacgtaaccgtttaaccgacgttacgttacggaacgttacgtacgggtaccggtaccgttaccgggttacccgttttaacgttcgttacgggtccggaacggtaccggtaccccggtaccggtacggggggaaccggggggttacccttacgggtaccgggttaccgtacgggttacccggg

SEQ ID NO: 121516 - DNA, 981 bp, Homo sapiens
  misc_feature: GYAE6OF02J1OYF.41.2.A02.1.454.CMB.1.raw
tcagtctatactatcacgaccggtgctcgatttagactcatctacagggggagcatcacccagcaaccacatctgtcctctagagagtcccctgagagctccgtcctcaccatgactggacctgaggatcctcttcttggtggcgagcacgccaccaggagcccacctcctcacggtgcagctgatgcagtcgtggggcgtgtagggtggaggaaacggccgttcgggggtccgtccgtaggtggaaacgtccgttaccttccgttcggaccgtaaacggtaccgtttaccgtgggtaacgttaaccgtaacggtttaaccgtaaaccgtactttaccttaataactaccgtacggttggggtacgacgtaacccgaccgggtccccgttacggggacgtaacgggggttaccttagggtacggttggggtaaggttacggggaggttacggggaaccttacccgtaaaaaccccgggttaagggtaagggtccggggtttacgaaaccgtaccggtaaccggtcccgttaacccggtttcggaacccgtaaccgggaaacgggtttaccggggttaaccccgggtaacgggggtaacccggttacgggggttaaccccgaacccggtaaggttacccggggaagggtttaccggggtaaccggttaaaccgggaacccgggacccgggaaacccgggaggtaaccccggaaccgggttaaccccgtaaccgttaaacggttaaccccggtaaaaccttaacccggttaaccggttaaccggtacgggttaaaccggttccggttaaacggaacccggggttaaccgtaccccgggttttaccggttttaacccgttttcgggtaaccgtccgggtaacccgggtaacccggtacccccgggaggggtttacgggggtaacccccgggggttacccggtttaacggggtaccccgttacgggtttaaccgggaccccgggg

SEQ ID NO: 121517 - DNA, 589 bp, Homo sapiens
  misc_feature: GYAE6OF02FI6UC.41.2.A02.1.454.CMB.1.raw
  modified_base (307)..(307): a, c, t, g, unknown or other
  misc_feature (307)..(307): n is a, c, g, or t
  modified_base (538)..(538): a, c, t, g, unknown or other
  misc_feature (538)..(538): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtggggcctcagtgaagccgtctcctgccaagaccttctggactacgtaggttccaaacgtacttactagtatacgactgggtgcgacacggccccgnggacagggacttgagtggtatgggagtggatccgaaacccgtaagagtggtgacacgagccctcgtgaccacgagacgttacccgacgggtctagggtcccaacgtagtggaggtggtcgaccaccgggtccacgacgccgaacggtccacgtagtacggaacttaccgagtacgtagacgtctaggagaccgtacgttccgttacttcgtcgtggacccgacgaccccgnggtaccggggaccgggggtaccttaccgtaccggttcgtacggtacccggg

SEQ ID NO: 121518 - DNA, 687 bp, Homo sapiens
  misc_feature: GYAE6OF02JDGBH.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggcctcagtgaagctctctgcaagacttctggatacgaggttcaacgtacttctatatacacgtgggtncgacacggcccctggaccagggactgacggtggagtgggatggactacgaaacccgtaagacggtagggtacgacaaccgacgtacccgttcgtaccggaccgaacgtaacggtaacggggtttccccgaaagggggtacccgaacgggggttacccaacccggtaagttacgggtaacgggtacgggtacggaacccgacccggggacccgaacggaccggtaccgtaacccgggtacccgacgtaacgtaacggtaaccttaaccgacggttaccgtagtaacgttacgtcggaacggtaccgtaccgggttccgttttaacgttcgttacggtcgtacggacccggtcccggaggttaccggggacgggggtaccctacgggtaccggtacgtacggtaccggg

SEQ ID NO: 121519 - DNA, 572 bp, Homo sapiens
  misc_feature: GYAE6OF02GLC2D.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgctaagacttctggatacaggttcaacgacttctatatacactgggtncgacaggccctggacagggactgagtggatgggatggatcgaaaccctagagtggtgacacagcctctggcacagacggttccagggcagggtcacgagtgagtggtagacgacggccacgacgacgtacggccacgagtcggaacttacccgagttctagtaacgttctacggaacggtacgtaccggttacccgttttaccttcgtcggtcggtaccggtacggacccccggtggtaccgggggaaccggggggcccttaacggtaccgggttaccgtaaggtacccggg

SEQ ID NO: 121520 - DNA, 534 bp, Homo sapiens
  misc_feature: GYAE6OF02GF4OT.41.2.A02.1.454.CMB.1.raw
  modified_base (433)..(433): a, c, t, g, unknown or other
  misc_feature (433)..(433): n is a, c, g, or t
  modified_base (498)..(498): a, c, t, g, unknown or other
  misc_feature (498)..(498): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggccttagtgaagctctcctgcaagacttctggatacaggttcaacgacttctatatacactgggtgcgacaggcccctggacagggtacttgagtggatgggatggatccaaaccgtagagtggtgacacgagcctctgacacgaggtacggttccgagggtcgacgggtccacgagtggaggtggagacgaccggcctacggacgcgaccggtccanacgtcggaacttaccgagtcagaagtcagacgacgacggtcctttactgtgtcgcgacgccccgngtagggaccggggtcacgtacggtctagcgtacggg

SEQ ID NO: 121521 - DNA, 565 bp, Homo sapiens
  misc_feature: GYAE6OF02FKNXV.41.2.A02.1.454.CMB.1.raw
  modified_base (245)..(245): a, c, t, g, unknown or other
  misc_feature (245)..(245): n is a, c, g, or t
  modified_base (352)..(352): a, c, t, g, unknown or other
  misc_feature (352)..(352): n is a, c, g, or t
  modified_base (518)..(518): a, c, t, g, unknown or other
  misc_feature (518)..(518): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcagtgaagctctcctgcagacttcnggatacaggttcaacgacttctatatacactgggtgcgacgacggcccctggacgaggacttgaggtggagtgggatggatcgaacccgtaagagtggtagacacgngcctgtcgcacagacggtccgagggcgacgggcaccgtagtgaggtggtcgacgacggccacgagccgacggtaccactacgtacggaaccttacccgtagtcctaggtaacgtcgtggacggtaccgacggttcgtttacttcgtagtcgacgtaccgaccccgnggtacggggaccggggggtccttacggtaccggttcgtacggtcggg

SEQ ID NO: 121522 - DNA, 818 bp, Homo sapiens
  misc_feature: GYAE6OF02GBURI.41.2.A02.1.454.CMB.1.raw
  modified_base (237)..(237): a, c, t, g, unknown or other
  misc_feature (237)..(237): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatgcagtcgtgggctggaggtggaggacgtcggtcggctgagagacgtctctcgngaacaacgttcgttgagtactacgtacgtaacgacgttacttacgtataactacgtaggtggtacgacgacggcccggtaccggtacggaacgggtacggttacgtaggtaggtacggtagggtacggtaggtacgtaccgtaaacccgtaaacggttaggtacggttacggaacgtaaaccgacgacccgttaccgtcgtaccggaactaaccgggtacggttacccgggtacgggaacggtacgggttaaccgacccttaaacgggtggtaacgggtacgggttaagggacccgaaccggaccggaaccgtaagggacccgaccgggtaacccacgtaaccggtaagttaaacccggtaccgtaccgtacgtttacggaacgttaacggttcggaaaccggtaacggtaacccgggttacccgttttacccgtttacgttaccgggtcggttaacccgggaccccggtaaccccggttaaccgggttaccgggggggtaaacccggggggggttaaccccgttacccgggtttaaaccgggtcccggggtttaaacggtcccccggtttaaccgggggg

SEQ ID NO: 121523 - DNA, 659 bp, Homo sapiens
  misc_feature: GYAE6OF02JY6UH.41.2.A02.1.454.CMB.1.raw
  modified_base (278)..(278): a, c, t, g, unknown or other
  misc_feature (278)..(278): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgagaagcctggggcctcagtgaagctctcctgcaagacttctggatacaggttcaacgcttctatatacgactgggtncgacacggccctggacgagggtcttggagtcggagtgggattgggatccgaacccgtaaggaggttgggtacgacgaacgacggtcccttacgtcggaccaacgaggtaccgggtttaccggagggtccggtaacggggtaccaacccggtagtacgggtaacgggttagggtacgtaaccggacgggacccgaacgggtaacgggccgtaaccgggtacccaacggtaacgtacgggtaaaccttaccgaagttccgtacggtaacgtcgtacggaacggaccgtacgggtaccgtttacgttcgtcggtacgccggtaaccgcccgtaggtacggggaacgggggtccctaccggttaccgggttcgaccgttaccggg

SEQ ID NO: 121524 - DNA, 731 bp, Homo sapiens
  misc_feature: GYAE6OF02HXKXD.41.2.A02.1.454.CMB.1.raw
  modified_base (245)..(245): a, c, t, g, unknown or other
  misc_feature (245)..(245): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtggggcctcgagtgaagctctcctgcaagacttcnggatacgaggttcaacgtacttctaattatacacgtggggttcacggacacggcccctgggaacgtacgggactttggagtcgggaagtggggatgggaactaccgaacccgttaaggtaggttgggtagaccgtaacgacgtacccgttctacggcctaacggacgggtacgggttaccgaggggtaccggaacgggtaccaccgtagtaggtagtcgggtcgaaccgtaccggacccgacggtacgaccgtaaccggaccgtaaccgtaagttacggtaaaaccgtttacccgaaggttaccgtaacggttaacgttaccggtacggaacggtaaccggtcccgggttaacccgttttaccgtttccggtcggttacggtacccgggtaaccggtacccccggtacgggttaccgggggaacccgggggggtaccctttaacccggggttacccgggttaccggttaacgggttaaccccgggg

SEQ ID NO: 121525 - DNA, 575 bp, Homo sapiens
  misc_feature: GYAE6OF02GTC7G.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacgagcctctgcacgagaggttccgagggcgagggtcaccgagtgaggtggtacgacgacggccgacggacgccgacggtccaccgagtacggaacttaccagttacgtagtaagtcgtaggaaggaccgtacggtaccgttttaccttccgtgttcggaccggaacgaccccggtacgtaccggggaaccggggggtacccgttaaccggttacgggtaccgtacggtaaccggg

SEQ ID NO: 121526 - DNA, 596 bp, Homo sapiens
  misc_feature: GYAE6OF02GL189.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgtacttctatatacactgggtgcgacaggcccctggacaggggtacttgagtggagtgggatggactcaaaccctaagagtggtgacacacgcctctgcacaggtacggttccgagggcagggtcaccgatggagtggtggacacggccgaacggcgccgaccgtccaacgagtacggaaccttaccgacgttctacgaacgttcgaggaacggtaccgtaccgggtaccgttttaccgttcgttcggttccgaccggtaccggtaccccgtcgggtaccgggggtaaccggggggtacccgttaacgggtaccggttaccggtacggttacccgggg

SEQ ID NO: 121527 - DNA, 575 bp, Homo sapiens
  misc_feature: GYAE6OF02F5HET.41.2.A02.1.454.CMB.1.raw
  modified_base (297)..(297): a, c, t, g, unknown or other
  misc_feature (297)..(297): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgtacttctatatacactgggtgcgacaggccctggacnggactgagtgatgggatggatacgaacctagagtggtagacacgacgcctactgacacgagtacggttccgagggcgagggtcaccagtgagtggtgacgacggccgacgacgacgaccggtccaacgacgtacggaacttaccgaacgtactgaacgttcgtacggtacggaaccgtaccggtaccgtttactcgttcgtacgtaccgacgtaccccggacggtacggggaccggggggtacccgttaccggtaccgggttaccgtacggtacccgg

SEQ ID NO: 121528 - DNA, 556 bp, Homo sapiens
  misc_feature: GYAE6OF02FHN5I.41.2.A02.1.454.CMB.1.raw
  modified_base (401)..(401): a, c, t, g, unknown or other
  misc_feature (401)..(401): n is a, c, g, or t
tcagtctatactatcacgaccggtgctcgatttagactcatctacagggggagcatcacccagcaaccacatctgtcctctagagagtcccctgagagctccgttcctcaccatggacctggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactgggtgcgacaggcccctggacagggacttggagtggagtgggatggatacaacccgtaagacgtggtgacacacgcctctgaccacagacggttcgagggcagggtccaccgatgaggttggngacgaccggccgacgagcgaccggtccacgtagtcggaaccttaccgagtctagacgtcaggaggaccaccggtccgtttacgttcgtgtcgaccggacgacccccgtggtacggggaccggggggtcctaacggtccggtacgtagtacccggg

SEQ ID NO: 121529 - DNA, 593 bp, Homo sapiens
  misc_feature: GYAE6OF02HNN1B.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggtagcagccacaggagcccactctcaggtgcagctgatgcagtctggggctgaggtgaggaagccgtggggcctcgagtgaagctctcctgcaagacttcgtggatacgtaggttacaacgtacttactataactacacgtgggtcgcgacgacggcccctggacgagggtacttggagtggatggggatggactacaaaccgtaagaggtggtagacacgacgcctctgacacgtaaggtacggttaccgagggccgtacgggaccaccgagtaggagtggtacggaacgccggacctaacggacgacgtaccgacacgagtacggaaccttaccagtacgtagaagttcgtaggtagaccgtacggtctttacgtacgtgtcggaccgtcgaccccgtaggtacgggtacggggcctacggtacggtccgtacggtccggtacggg

SEQ ID NO: 121530 - DNA, 666 bp, Homo sapiens
  misc_feature: GYAE6OF02HXHCI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcgagtgagctctctgcaagtacttcgtggatacgaggtacaacgacttctatactacacgtgggtgcgacgcggccctggacgagggcttggagtggagtgggatggactactaaaccgtaagagtggtagacgacgacgtacctcgtcgcacgaggtacggttaccgagggtacgaacgggtccaccgtagtaggtaggtcgggtacgaaccgaccggacccgtacggaccggaccgaaccgggtcccgaacgtacgttaacgggtaacccgtttaccgacggtaccgttagggtaacgttcggtacggtaacgggtaccggttaccggttacccggtttttacgttaccggtcggtccggaccggtaaccggaccccgggttacgggtacggggggtaacccgggggtcctaaccgggttacgggttacccggtaaggtcccggg

SEQ ID NO: 121531 - DNA, 569 bp, Homo sapiens
  misc_feature: GYAE6OF02GEISS.41.2.A02.1.454.CMB.1.raw
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacgttctatataccactgggtgcganacggcccctggacagggacttgagtggagtggatggatcaacctaagngtggtgacgacagtcctcgtgacacgagtacggtccgagggcagggttacacccgtagtgagtcgggtgaccgacggccacggacgcgaacgtccacacgtagtaaccttcgacgttcgagaacgtcgtagacggaccgtaccggtcgtttacttcgtcggtcgtacggaccgtcccgcggtacgggggacccgggggttcctaaccggtaccggtaccgtacggtaaccggg

SEQ ID NO: 121532 - DNA, 675 bp, Homo sapiens
  misc_feature: GYAE6OF02HNFTM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcgttggtggcagcacgccacaggacgcccactctcgaggtgcagctgatgcgagtcgtgggctggaggtggaggacgccgtcggggcctcgaggtgaacgctctcgtgacaacgtacgttcgtagtagtacgtaggttaccaacgtacttactaatactacgtacgttggtacgaccggtaccgaccggtacccgtggacggtacgggtacgttggaggtagggtagtgggatggaactaccgtaacgtaaggaggtggtacgacacgtcgtcctgacgcgacgaggtacgtacgagggtacgtacggtacacgtagtggtaggtggacgaccgaccggacgacggacgtaccgacgaccaagtacggtaccgtaaccttaccggagttaccgtaagtacgtcggtaaggaaccgtaccggttaccggttacccgttttagtccgtcgggtaccgaccgggtacccgacccgggttacgggtaccggggggaacccggttaccgtaaccgggttacgggtaccgtacgggtccggg

SEQ ID NO: 121533 - DNA, 678 bp, Homo sapiens
  misc_feature: GYAE6OF02HQLFX.41.2.A02.1.454.CMB.1.raw
  modified_base (251)..(251): a, c, t, g, unknown or other
  misc_feature (251)..(251): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagcccactctcaggtgcagctgatgcagtcgtgggctggaggtgaggaacgccgtggggcctcgagtagacgctctctgacaagtcttcgnggatacgaggttacaacgtacttactatactacgacgtgggtgaccgacgacggtcccgtaggacgtagggtacttggagtggagtgggatggactaccgaaaccgtaggtacgtggtacgaacgacgtcgtaccttcgacggtcgaacgtacgggttaccggttaccggacggggtacggtaacggggtccaaccggtaaggttgggtaacgggttacgggtaaccggaacccggaacccgggtaaccgaacggaacggtacccggaaccgggtaccaacggtacgtaacggtaaaccttacgacgtacgtagagttcgaggacgtacgtccggttacctttacgttcgtggaccgtacggacccggtcccggtaggtccggggggtaaccgggccttaaccgggtacgttacggacggtaccggg

SEQ ID NO: 121534 - DNA, 696 bp, Homo sapiens
  misc_feature: GYAE6OF02JVYS2.41.2.A02.1.454.CMB.1.raw
  modified_base (261)..(261): a, c, t, g, unknown or other
  misc_feature (261)..(261): n is a, c, g, or t
tcagtctatactatcacgaccggtgctcgatttagactcatctacaggggagcgatcacccagcaaccacactctgtcctctagagagtcccctgagagctccgtttcctcaccactcggactcggaccgtgggacggagtcctcttcgttggttcggcgagcgacgccgacacggacgcccactccgtcacggtcgcgacgcgtgatgacgacgttcgtcgggtcgtaggtaggtggaggaaggccggtcgggccgtcgnggtgaacgctctccgtgacaagtacgttgttacggattacgtacggttacgaacgttacgtttctaacttacgtacacgttaggtacgcgtaccgacggcccgtaggaccggacggtacgttggaggtgaggtacggagtggtagtacccgtaacgtaacggaggttacggacgacgacgacgtacgtccgtgacgtacgacgtggtaccgtagggacgtacggccacgtagcggtacgtggtacgaccgtacggccgtaacgacggaccgtaacggtacccacgggttagtccggtaaccgttccgtaagtcgtacgtagaccgtcgaaacgggccttaacggtcccttagttcggtaaccgtcgaccggtaaccgccgggtcggtacggggtacccgggtagttacccggtacggggtctaaccggtcccggg

SEQ ID NO: 121535 - DNA, 690 bp, Homo sapiens
  misc_feature: GYAE6OF02H999K.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctggaggtgaggaacgccgtggggcctcgagtgaacgctctcctgcaagtacttcgtggatacgaggttcaacgtcttactatatacacgtggtcgcgacgcggcccgtaggacgaggtacgtggaggtggtagtgggagtggaactacccgtaaaccgtaaggacggtaggtacgaacgaccgacgtcctacgtcgacgtacgtacggtacgggttaccgacggggtacccgaaggggttacccaacgtaagttggaggttacggtaacggaccgaacccgggaccgtaacggtaccggacccgtaccggtaccaacgtcgttaaaccggaaccgtttaccgagtccgtaggtaacgttccgaggaaccgggtaaccgtaccgggtttaccgttttaacgttaccggtggtaccggtaccgaccgggtacccccgtgggtaccgggggaaccggggtcccgttaacggtaccggttccgtacggtacccgggg

SEQ ID NO: 121536 - DNA, 600 bp, Homo sapiens
  misc_feature: GYAE6OF02FHKW9.41.2.A02.1.454.CMB.1.raw
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctnagtgaagctctcctgcaagcttctggatacaggttcaacgcttctatatacactgggtncgacagcccctggacagggacttgagtggagtgggatggactcaaaccctaggagttgggtgaactacacgccttacgtcgcacaggacgggtttccgagggcgaggggttccaccgtagtggaggtggtaggaccgacggccgacggacgccgacggtccacgtagtacggaaccttaccgagtcgtagaacgttcaggtacggtaccacgggttccgtttacgttcgttacggttcggaccggtaccgtaccccggtggtaccgggggtaaccggggggtcccttaaccgggttaccgggttaccggttaggtaacccggg

SEQ ID NO: 121537 - DNA, 593 bp, Homo sapiens
  misc_feature: GYAE6OF02FJHB9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggcccctggacagggacttggagtggagtgggatggataccgaacccgtaagaggttgggtagaaccgacgagtccctcgtgtccacgagacggttaccgagggtcgagggtccaccgtagtggagtgggtagaccgaccgggccacggacggccgaccggtaccacgtagtacggaaccttaccgagttctagtaacgtctaggacggacgaccggtccgtttacgtcgttggtcgaccggaccggtaccccgtcggtacggggaaccgggggtacccttacggtaccggtacgtacggtaccggg

SEQ ID NO: 121538 - DNA, 606 bp, Homo sapiens
  misc_feature: GYAE6OF02HD895.41.2.A02.1.454.CMB.1.raw
  modified_base (353)..(353): a, c, t, g, unknown or other
  misc_feature (353)..(353): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtgggcctcgagtgaagctctcctgacaagacttctaggatacaggttacaacgtacttctatatacacgtgggtcgccgacacggcccctggacaggggacttggacgtggatgggatggatccgaacctaggtagtggtanacgacgagtcctcgtgaccacgtacggtacggttaccgagggtccgaacggggtccaccgtaagtggtagggtcggtacgaccgacggacctacggacgccgacggccacgtagcggttaaacctaccgtagtaccgtagtaacgtcgtacggaacgtaccgtacggttaccgtttacgttcgtcgtcggacgtaccggtacccggcggtacggggaaccggggccttacggtacggtaccgtaggtaccggg

SEQ ID NO: 121539 - DNA, 619 bp, Homo sapiens
  misc_feature: GYAE6OF02FQOJJ.41.2.A02.1.454.CMB.1.raw
  modified_base (245)..(245): a, c, t, g, unknown or other
  misc_feature (245)..(245): n is a, c, g, or t
  modified_base (318)..(318): a, c, t, g, unknown or other
  misc_feature (318)..(318): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtgggcctcaggtgaagctctcctgcaagacttcnggatacaggttcaacgtacttctaatatacacgtgggtgcgacgacggccctggacagggacttagagttggngtggagtggatacaacctaagagtgtagacagacgcctctgcacgagtacggttccgagggcaggtacaccgtaagtggacgtggtacgacgaccggtacaacggcgtaaccgccgggtaccaaccgtaagtcggtaaaccttaccgaagttccgtagtaacgtcgtacggaacgtaccgtaccgggttacccgttttaccgttacgtcggtacgtacccggtaaccggacccccggtgggtacccggggtaccggggggtacccttaaccgggtaccggttacggtaccggtacccgggg

SEQ ID NO: 121540 - DNA, 664 bp, Homo sapiens
  misc_feature: GYAE6OF02HEPXP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggagccgtggggcctcgagtgagctctcctgcaagcttctggatacaggttcaacgacttctatatacactgggtgcgacacggcccctgggacgagggtaccttggaggtggagtggggagtggatcaaacccgttaagagtggtagacacgacgcctcgtcgacacgaggtacggttccggagggcgacgggtacgacccgagttggacggtgggtacggaccgaccgggcccaacgggaacgaccggacccggtacccgaacgacgttagggtaaacccgttacccgaaggttacgttacggtaacgttccgtacggaacgggaccgtaaccgggttacccgttttaccgtttcgttggtacggtccggaaccggacccccggtcgggtacgggggtaacccgggggggtaccccttaacccggttaccgggttaccggttaggtaaccccgggg

SEQ ID NO: 121541 - DNA, 636 bp, Homo sapiens
  misc_feature: GYAE6OF02I25PZ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtggaggaacgccgtggggcctcgagtgaagctctcctgcaagtacttcgtggatacgtaggttacaacgtacttctatactacacgtggtcgcgacgacggccctaggacgagggtacttaggagtggagtgggagtaggtactaccaaaccgtaggaggtaggtacgacacgcgtccctcgtcgacacgaggtaccggttaccggagggaccgtacggggtaccacgtagtaggaggttacggtacggaaccgtaccggacgacggacgccgtaaccggtccaacgtagtacgtaaccttcgagtctagacgttgacggacggtactcgggttacccgtttattcggtacggtccgtacggtacccgaccccgggtgggtaacccgggggaaccggggtcctaaccgggttaccggtacggttagtacccggg

SEQ ID NO: 121542 - DNA, 629 bp, Homo sapiens
  misc_feature: GYAE6OF02H73DI.41.2.A02.1.454.CMB.1.raw
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgaagtctggggctgaggtgaggaagccgtggggctcgagtgaagctctcctgcaagacttctggatacaggttcaacgtcttctatatacactgggtncgacacggcccctggacagggtacttgagtggtagtggggatggatacaacccgtaagngtggagacacagcctntcgcacaggacggttccgaggcgaggtccacgagtgagtggtcgacgacggccgacggacgcgacggtccacgacgtacggtaacccttaaccgtacgtacgtacggtaacgttacgtacggaaggtaaccgtaaccgggttcccgttttaaccgtttccgttacggttcggaccggtaccggtacccccgtaccgggtaccggggggtaacccggggggtacccgttaaccggttacccgggttacgttaaccgggccggtttacccggggg

SEQ ID NO: 121543 - DNA, 617 bp, Homo sapiens
  misc_feature: GYAE6OF02FRUOB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttcgtggatacaggttacaacgtacttctatatacacgtgggtgcgacgacggccctggacgagggacttgagtggagtgggatggatcgaaccgtaagagtggtagacacgacgcctacgtcgacacgaggtacggtccgagggcagggtcacgagtgaggtggtgacgacggtaccgacggacgccgacggtcccacgtacgtacggtaaccttaccgagttcgtacgtaagttccgtaggaacgggaccgtaccgggttaccgttttaccgttcggttggtacggacccgggtaaccgtacccccggtaggtaccgggggtaaccggggggtcccttaaccgggtaccgggttacgtacgggtaacccggg

SEQ ID NO: 121544 - DNA, 700 bp, Homo sapiens
  misc_feature: GYAE6OF02HDIUP.41.2.A02.1.454.CMB.1.raw
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggggctggaggtgagggaagccgtggggcctcaggtgaagctctccgtgacaagacttcgnggaatacgaggttcaacgtacttctatatacncgtgggtncgacncggccctaggacagggtacttggacgtggagtgggagtggactaccaaaccgtaaggagtggtacgactacgagtcctcgtgaccacgacggtacggttaccgaggggacaacggggtccaaccgtagtacggtagggtcgggtacggaaacccggtccgggaccgaacggcggaccgtaccgggtacccaccgtaaggtacggtaaacctttaccgaggttccgtaaggtaacgttcgtaacggaacggtacccgtaccgggttcccgtttttaaccgttcggtcggtttacggacccgggtaaccggaaccccccgggttcggggtaaccgggggggtaacccggggggttaccctttaaccggggtacccgggttttaccggaccggttaacccggggg

SEQ ID NO: 121545 - DNA, 681 bp, Homo sapiens
  misc_feature: GYAE6OF02HDN7X.41.2.A02.1.454.CMB.1.raw
  modified_base (163)..(163): a, c, t, g, unknown or other
  misc_feature (163)..(163): n is a, c, g, or t
  modified_base (404)..(404): a, c, t, g, unknown or other
  misc_feature (404)..(404): n is a, c, g, or t
tcagtctatactatcacgaccggtgctcgatttagactcatctacagggggagcatcacccagcaaccacatctgtcctctagagacgtcccctgagagctccgttcctcaccatggactggacctggaggatcctcttcttggtggcagcagccacaggacncccactctcgaggtgcagctgatgcagtcgtgggctggaggtggaggaagccgtggggcctgagtaggaagctcctcgtgaccgaaagtacttcgtggaactactacggttacaaacgtaccttacttaataactacgacgtggtcgcgacgccggtcccgtaggacagggtacttggagtgggagcggagtaggactacaaaccgtaagaggtggtaacgactaacgacggtcctttcgngacccgtaacgacggttaccggttcggaacgggtcgaaaccggggtcaaaccgttagtggaggttcgggagtaccgacgaccgtaagacgtaccgtaccgtaccagaacgtaggtaaacccttcggaacgttcgtacgaacgtttcgaaggaacgggtaacccttaccggggtcccttttaagtcggtcggtacggacgtaaccccgggtcccgtacgggttaacggggggaacccggggtccgttaaccggtacgggttaccgtaaggtaccgggg

SEQ ID NO: 121546 - DNA, 740 bp, Homo sapiens
  misc_feature: GYAE6OF02HQMTY.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctctgcaagacttgtggatacgaggttcaacgtacttctatatacacgtgggtgcgacgacggtcccctgggacaggggtacttaggaggttagggacgtggggtacgtggtaactaccgaaacccgttaagggacggtagggttacgaacgaaccgacgtacccgttacgtcgaccgtaacgtaacggtacgggttacccgacggggtaccgtaacggggtaccaaccggtaagttacgggagggttcgggttacggaaccgaaccgggtacccgacggaacggtaccgtacccggtaccgaacccgtaagtaaccggtaaaccgttaacccgtagttaccgtagtaaacggttacgtacggtaacgggaaccgtaccgggtttaccgttttacgttttaccggtggttaccggtaccggtaaccgggtaacccccggtggggttaaccgggggaacccggggggttacccgttaccggtaaccgggttaccggttacggtaacccgggg

SEQ ID NO: 121547 - DNA, 618 bp, Homo sapiens
  misc_feature: GYAE6OF02HU3NA.41.2.A02.1.454.CMB.1.raw
  modified_base (376)..(376): a, c, t, g, unknown or other
  misc_feature (376)..(376): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgaggaagccgtcggggcctcaggtgaacgctcctccgtgacaagtacttcgtaggacttaacgaggttacaacgtacttactatatactacgtagggtgcgacgacggcccctaggaccgacgggtacttggacgtggagtgggatggactaccgaaccgtagagtgtgacanacgctctgacacgagtacggtaccaggggtacgacgggtacaccgagttagtacggtggacggtaacgaccggaccgacggacgccgtaaccggtccaacgtacgtacggtaacctaccgtacgtacgtagacgttcgtagaacggaccgtaccggtacctttacgtcggtcgtaccgacgtacccgacccgcggtaacggggaccggggtaccctacgggtaccggtacgtacggtaccgg

SEQ ID NO: 121548 - DNA, 660 bp, Homo sapiens
  misc_feature: GYAE6OF02IQ7DO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctcggaggatcctcttcttggtggcagcagccacaggagcccgactctcaggtgcagctgatgcagtctggggctgaggtgaggaagccgtggggcctcgagtgaagcgtctcctgacaaggcttcgtaggatacgaggttacaacgtaccttacgtatactacgacgtgggtgaccgtacgacggtccctaggacgacggggtaccttaggaggtaggaacgtgggacttaggaacttaccgaaaccgttaggaggttcgggtacgaacgaacgtacggtccctagtccgtacacgtaacggtacggttaccgagggtacggtacggggtaccaaccgtagtagtacgggtgggacgtaccgacgggccaacgggtcgaccggtaccggtaccacgtagtaccggttaacgtacgacgtacctaggtaaacgtccgtagaacggtacgaccggttccgttacgtcgtacggtcggacgaccgtaccgaccggtacggggaccggggtacctaccggttacggtactacggtacggg

SEQ ID NO: 121549 - DNA, 628 bp, Homo sapiens
  misc_feature: GYAE6OF02FNM02.41.2.A02.1.454.CMB.1.raw
  modified_base (239)..(239): a, c, t, g, unknown or other
  misc_feature (239)..(239): n is a, c, g, or t
  modified_base (276)..(276): a, c, t, g, unknown or other
  misc_feature (276)..(276): n is a, c, g, or t
  modified_base (577)..(577): a, c, t, g, unknown or other
  misc_feature (577)..(577): n is a, c, g, or t
tcagtctatactatcacgaccggtgctcgatttagactcatctacagggggagcatcacccagcaaccacatctgtcctctagagagtccccctgagagctccgttcctcaccatggactggacctggaggatccctcttcttggtggcagcagccacaggagcccactctcaggtgcagctgatgcagtcgtgggctggaggtgaggagccgtggggcctcgagtgaagctcgtcctncgaagacttcgtggatacgtaggttacaacgtacttntatatacagtgggtgacgacgacggtcccgtagggacgaggtacgttgaggtaggagtggatggactaacgtaacccgtaaggaggttggtacgaacgactacgtccgtcgtcgacgaacgaggtacggtaccgagggccggaggtcctacgtagtaggtaggtcggacgacgaccggtccgacgacgaccggtacgtacccacgtacgtaccgtaaccttacgacgtcgtaggtacgttacgtaggacggtaccgtacggttccgttaacttcgtaggtccgacggtacccggacccggnggttaaccggggaccggggtaccttaccggtacggtccgtacggtaccggg

SEQ ID NO: 121550 - DNA, 703 bp, Homo sapiens
  misc_feature: GYAE6OF02JUFNE.41.2.A02.1.454.CMB.1.raw
  modified_base (233)..(233): a, c, t, g, unknown or other
  misc_feature (233)..(233): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctcncctgacagacttcgtggatacgaggttcaacgtcttactatatacacgtgggtacgccgacgaccggcccgtaggacgtagggacttggaaggtcggtaggtgggtatacggtaacgtaccgtaaaccgtaagggtaggttacgggtacgaaccgtaaccgtagtccccgttagtacgaccgtaacgagggttaaccggtcccggtaagggaccggtacgggtaacccaaccggtagtaccgggttaggtacgggttacgaaccggaaccgggtaccgaaccgggtacgcccgtaaccgggtacctacgtacgtacgtaaccctaccggacgttcgtaacgtaggtctagggtaaccgtcgtaacggttccttttacgtacggtacggttcgaccgggtaaccgtcccggtacgggtacggggtaaccggggttcctaccgggttaccggtaccgtacggttacccgggg

SEQ ID NO: 121551 - DNA, 624 bp, Homo sapiens
  misc_feature: GYAE6OF02FK1J5.41.2.A02.1.454.CMB.1.raw
  modified_base (288)..(288): a, c, t, g, unknown or other
  misc_feature (288)..(288): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggagggttgaggaacgcccgtggggccctcgagtgaagcctctcctgcaagacttctggatacaggtcaacgacttctatatacactgggtncgacaggcccctggacagggacttggagtggagtgggatggatcaaacctaagagttggtagacacgaacgtcctacttgccaacgtaggtacgggttccgagggcacggggtcaaccgagtcgaggtcggagacgaccggccgacggtacgccgtaccggtaccaccgaagtaccgggtaaaccttaccgaacgttcgtaggtaacgttcgtaggaacggtaccaccgggttcctttaaccgttcgtcggtacggacccggtaccggaccccggtcggtacggggaacccggggggttaccctaaccggtaccgggttaccacgggttacccggg

SEQ ID NO: 121552 - DNA, 640 bp, Homo sapiens
  misc_feature: GYAE6OF02F4IV6.41.2.A02.1.454.CMB.1.raw
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgaggtgaagcttctcctgccaagacttctggatacaggttcaacgacttctatatacacgtgggtgcgacgcggtcccctggacgagggtacttgaggttggatgggatggatacgaaccgtagagtggtgacacgagcctcgtncacgagaggttcgagggcgaggtcacgtagtcgaggtggtagaccgtacgggaccacggacgaccgaccggtaccacgtaacgtaacggtaaccttaccgtacggttacgtagtaacggttcgtacggacgggaaccgtacccgggtttacccgttttacgttccggtttaggtaccggtcggtaacccggaccccggttacgggtaccggggggtaacccgggggggttacccttaaccgggttaccggttaccggtacggttaacccgggg

SEQ ID NO: 121553 - DNA, 805 bp, Homo sapiens
  misc_feature: GYAE6OF02H0YO9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctgaggtgaggagcgtgggctcgagtgagctctctgcaagtacttctaggactacgtacggttacaaacgtacttacttatacgtacacgttgggtcgacgaacgacggccccgtaggtacgaacgggtcttaggaggttaggagttaggggatagggaactaccgtaaaccgtaaggtaaggttcgggtagaacgacgactcccgtcgtacgacgaagtaacggtacggtcgaacgggcgtaacgggtacacgtagacgtaggtcggtacgaccggaccggtaccaacgggacgtcccggtaacgggtaacccctacgaacgggttacccgttaaaacgtttccccgaaggttttacccgggtaaggttaacccgggtttagaaacggggtaaccggttaaccggtaaccccggggtttttacccgttttttaacccgttttaacggggtccccgggttcgggttaaacccccggtaaaccccggggtaccccccggggtttaagggggggtaaccccggggggggttaaacccccggggggttccccttttaaacccgggggtttaacccgggtttacccgggttaacccgggtttaccccggggggg

SEQ ID NO: 121554 - DNA, 614 bp, Homo sapiens
  misc_feature: GYAE6OF02JBWW0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctgagtgaagtctctccgtgacaagtacttctgatacgagttacaacgtacttactatactacacgtgggtcgacgacgacggcccgtagacgtacggtactggacgtggaacgttgggataggactacgaaccgtaagacgttggtacgacacgacgtctctgaccagacgtacggtccgaggtcgacggtacacgtagtgtagtcggtacgtacgacggtccgaacgacggaccgtaacgtaccgacgtacgtacgtaacctaccggtatacgtacgtaacgtcgttaacgacggtacgtaccggtcctttaacgttccgtacggttacgtacgtaacccggccgtaggtacccggggtacggggtcctaacgggttaccggtcgtacggtaccggg

SEQ ID NO: 121555 - DNA, 652 bp, Homo sapiens
  misc_feature: GYAE6OF02GLAJI.41.2.A02.1.454.CMB.1.raw
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaaggctctcctgcaaggaccttcgtggatacaggttcaacgacttctatatacactgggtnacgacgnggcccctggacagggacttgagtggatcggatggataccaaccgtaagagtggtgactacagcctcgtgcacgagtacggtccgagggcagggtacacgagtcgagtaggtcgacgaccggacacggagacgaccggtccaacgtacgtacggtaaccgttaccgtacggttacgtacggtaaacgttccgttacggaacgggtaacccgaaccgggttacccgtttttaaccgtttccggttacggttaccgggccggtaacccggtaacccccggttaccggttaaccgggggtaaaccggggggggttaccccgttaacccgggttaacgggtttacccggtaccgggttaacccggg

SEQ ID NO: 121556 - DNA, 691 bp, Homo sapiens
  misc_feature: GYAE6OF02HRNHA.41.2.A02.1.454.CMB.1.raw
  modified_base (156)..(156): a, c, t, g, unknown or other
  misc_feature (156)..(156): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagccacnggacgcccactctcaggtgcagctgatgcagtcgtgggctggaggtgagacgccgtggggcctcagtgacgcctctcctgacaacgtcttcgtaggacttacgaggttaccaacgtacttctaattactacgacgtgggtcaccggacgcggcccctaggacgtacgggtactggagtggacgtagggatcggactaccgaaaccgtaggtgtaggtacgacaacgtccgccttacgtacgaccacgtacggtcggttaccgacgggtacgtacgggtaccaccgtagtacggacggttaggtacgacccggacggaccgtacgggacgtacccgtaaccggtccaaaccggtcgtaaccggttaaacctaccggtacgttacggtaacggtaacgttccggtaacggaaccggtaccgttaccggtttaccgttttaccgtcgttcgggacgtacccggtaacccggacccggtacgggtacggggggaacccgggttccctaacggggtacccgtcggttaacggtacccggg

SEQ ID NO: 121557 - DNA, 621 bp, Homo sapiens
  misc_feature: GYAE6OF02HCFVB.41.2.A02.1.454.CMB.1.raw
  modified_base (306)..(306): a, c, t, g, unknown or other
  misc_feature (306)..(306): n is a, c, g, or t
  modified_base (526)..(526): a, c, t, g, unknown or other
  misc_feature (526)..(526): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggagccccactctcaggtgcagctgatgcagtctggggctgaggtgaggaagcctggggccctcagtgaagctctcctggcaagacttctggatacaggttcaacgtacttctatatacactgggtgcgacgacggcccctggaccgngggacttggaggtcggaatggggatgggtactaccgtaaaccctaaggaggttacggtagaacacgacgtcccttcgtcgactacgaggtacgggttcccgtaaggggccgtacggggtaccaacccgagtaggtaggttgggtagaccgaccgggccgaccggaggccacccgggtccaaccgagtacggaacccttccgtacgttcgtagtaagttcncggacgtacgacggtaccgtttacttcgtgtacgccggaacgtccccgcggtacgggacggggggtaccctacggtacggttccgtaggtaccgg

SEQ ID NO: 121558 - DNA, 868 bp, Homo sapiens
  misc_feature: GYAE6OF02HNRDW.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggacgcctggggcctcgagtgaagctctccgtgcaagtacttcgtaggactacgtaggttaccaaacgtacctttacgtaatactaaccacgttggggtcgaccgaaccgacgggtcccccgttagggaccgtaacgggggtacctttacgggaggttgggtaacgtttgggggacgttaggggaacttacccgtaaaaccccgttaaaggtacgggtttacgggttaacgaaccgaaccgtaccggttacccttaccgttacgggaccctaaaccggtacgggttaaccggggtttacccgaacgggggtccggtaaccggggttccaaacccggttaacggtagggtacgggttaggtaccgggaacccgaaccggggtacccgaaccggacggtacccgaacccgggttaccaaccgtaacggttaccgggtaaaaccctttaccgaacggttaccgttaacggtaacggttaccggtaaggaaccgggtaacccgtaacccggggttttacccttttacggtttaccggttacgggtacccgggtaaccgggtaccccgggtaaccccccgggtaccgggttacccgggggggtaaacccggggggttcccgttaaccggggttaccccggggttaccgttaaccgggttaccccggggg

SEQ ID NO: 121559 - DNA, 641 bp, Homo sapiens
  misc_feature: GYAE6OF02FI5MY.41.2.A02.1.454.CMB.1.raw
  modified_base (283)..(283): a, c, t, g, unknown or other
  misc_feature (283)..(283): n is a, c, g, or t
  modified_base (346)..(346): a, c, t, g, unknown or other
  misc_feature (346)..(346): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgagctctcctgcaagcttcgtggatacgaggttcaacgtacttctatactacacgtgggtncgacaggcccctaggacagggcttggagtaggagtgggatggactcgaaaccgtagagttggnacgacagcctactgacgtacaggtacggttacccgagggcgaacgggttcaacccgtagtcggacggttcgggtacgaccgaccgggaccaacggacgaccgaccgggtacccaactacgtaccggtaacttacccgacgttccgtaggtaaacgttcgtacgggaacgtaccggtaccggtttaccgttaacttcggtacggtaccggtaccgtaaccggtaccccggagggttaccggggggtaaccggggggtaccctaaccgggttaccggtaaccgttaggtacccgggg

SEQ ID NO: 121560 - DNA, 652 bp, Homo sapiens
  misc_feature: GYAE6OF02G61ZS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtggggcctcgagtgaagctctcctgacaagacttcgtggatacgtaggttacaacgtacttactatatacacgtgggtgcgacgacggcccgtggacgagggacttggaggtggagtgggatggactaccgaacctaaggaggtggtacgactacgacgtcctcgtacgccacgtacggtacgggtaccgaggggtccggagggtaccaacgtagtagggtacggttgggtacgaccggaccggtacccgacggaccgccgaaccgggtcccaacgtaacgtacgggtaaaccttccgacgttcgtaggtacgttccgaggaaccggaccgtaccggttaccgttttacttcggtcggtacgtaccgggaccggtacccccggtgggtaacccggggggaaccggggtcccttaacgggtaccggtcgttacggtacccggg

SEQ ID NO: 121561 - DNA, 539 bp, Homo sapiens
  misc_feature: GYAE6OF02HF9LV.41.2.A02.1.454.CMB.1.raw
  modified_base (494)..(494): a, c, t, g, unknown or other
  misc_feature (494)..(494): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagctgggcctcagtgagctctctgcaagacttctggatacaggttcaacgtacttctatatacacgtgggtgcgacacggcccctggacagggtacttgagtggatgggatggatcaaccgtaagagtgtagacacagcctctgcacgacgtacggttccgagggcgagggtccacgtagtggagtggtacgacgacggccacgacgcgacgcacgagtcgaacttaccgagtctagaacgtcgtacgacgacgtacggtaccgtttacgtcgtgtcgacgaccgcccgnggtacgggaccggggtacctacggtaccggtacgtacggtaccgg

SEQ ID NO: 121562 - DNA, 770 bp, Homo sapiens
  misc_feature: GYAE6OF02JGV12.41.2.A02.1.454.CMB.1.raw
  modified_base (191)..(191): a, c, t, g, unknown or other
  misc_feature (191)..(191): n is a, c, g, or t
  modified_base (232)..(232): a, c, t, g, unknown or other
  misc_feature (232)..(232): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgngggctgaggtgaggagccgtgggcctcgagtgagctctccngacaagcttcgaggactacgtaggttacaacggtacttactaatactacgtacgtggggtgaccggtacgtaccggccccgttgggaaccgacggggtaaccgttgggtaacggttcgggaaggttaggggtaagtcggggtaacttacccgaaaacccggttaaaggtacggttacggggtaacgaaaccgtaaccggaacggtaccctttcgtaccgggaactaccgtaaacgggttacggtttacccgaacgggggtaccgtacggggttaccccaaaccgtaggttagggtacgggttaacgggtacggaaacccgaccggggaacctaaccgggacgggaaccctacccgggttaaccaacgtagtaccgggtaaacctacccgggtacgtttacgtacggtaacgttcggtaacggaacggaccgtaccgggttcccggtttaactccggttaaggtaccggaccggaccgtaccccggagggtaccggggggaccgggtaccctacggtacggtaccgtacggtacccggg

SEQ ID NO: 121563 - DNA, 675 bp, Homo sapiens
  misc_feature: GYAE6OF02F1GGR.41.2.A02.1.454.CMB.1.raw
  modified_base (288)..(288): a, c, t, g, unknown or other
  misc_feature (288)..(288): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagtctctcctgcaagtacttctggatacgaggttcaacgtacttctattatacacgtgggtcncggacgacggccccgtaggacaggggtacttggagtggagtgggatggataccgaaacccgtaagaggttaggtagaacgacgacgtcctacgtcggaccacgacgggtacggtttaccggaacggggtaccggaacggggtacctaaccgtaacgttgggtacgggttcgggttacgaaccgggtaaccgggacccgtaacgggacggaccgaccgggtacccaaccgtaagtacggtaaccttaccgacgttacgtagtaacgtccgtaggacggtaccgtaccggttccgttttacgtcgttggttcgaccggtaccggtaccccgagggttaccggggacccggggggtcccttaacgggtaccggttacgtaggtacccggg

SEQ ID NO: 121564 - DNA, 658 bp, Homo sapiens
  misc_feature: GYAE6OF02GQ9G8.41.2.A02.1.454.CMB.1.raw
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaatctctcctgcaagcttctggatacaggttcaacgacttctaatatacacgtgggtgcgacncggccctaggacagggcttggacgtggactgggatggactacgaaacccgtaggagttaggngacactagcctcgcgcacgagtcggtccgaggcgaggtcaccgagtcggaagttgggtacgaaccggtaccggccgaacggacgtccgaaccggttcccaacgtacgtacgggtaaacccttaccgacgttaccgtaggtaaacggtccgtggtaacgggacccgtaccgggtacccgtttttacccgttacggttcggttcggtacccgtaaccgggtaccccccggttagggtaacccggggggtaacccgggggggttacccttaacccggggtaaccgggttaccggttaacgggttaccccgggg

SEQ ID NO: 121565 - DNA, 622 bp, Homo sapiens
  misc_feature: GYAE6OF02HGFIM.41.2.A02.1.454.CMB.1.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtgggcctcgagtgagctctcctgcaagtacttctggatacaggttcaacgcttactatatacacgtgggtncgacncggccctggacgaggacttggagtggagtgggatggataccgaaaccgtagaggtggtacgacacgactcctcgtacgccgaactaggtaccgggtttccgaggggaccgtacggggtacccaaccgtagtacggtagggtcgggttacgaccggaacccggccgtaacggaccgaccgaccgggtacccacgtaacgtacggtaaacccttaccgagttccgtaagtaacgtcgtagaacggacgtaccggttaccgtttacttcgtggtaccgacggtacccgacccggtggtacgggggaccggggtcctaccggtcggtactaggtacccggg

SEQ ID NO: 121566 - DNA, 742 bp, Homo sapiens
  misc_feature: GYAE6OF02H9PGX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagatcctcttcgttggtggcagccagcccagaggacgccccactcctcaggtgcagctgatgcagtcgtgggctgaggtgaggacgccgtcggggcctcgtagtgacgtcctcctccgtgacgtaacgtacttcgtaggtaacttacgtaacggttaccgaacgttacctttactaactacgtaaccgtacggttcgggtcggaccgtaccggaccggcccccgtagggaaccggtaggggtaccttagggaggtaggtaggtggggtaatcgggtaactaacccgtaaaccgtaaggtaggttaggtacgaacgaaccgtacgtcccgttacgacgaccgaacgtacggtacggttacccggacgggaccgtacgggtaccgtaacgtagtcgggtagggtaccggacggaccggtaccggccgaacggacgaccgaccgtaccgacgtagtacggtaccttacgtacgtacgtagaaccgtcgtaggaaccgtacggtaccgttaccgtttccgttagtacggtacggtacccggtaaccggtcccgggtaccgggttaccgggggtaacccggggtccgttaaccgggtccggttaccggtaggtacccggg

SEQ ID NO: 121567 - DNA, 732 bp, Homo sapiens
  misc_feature: GYAE6OF02GH81O.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagccccactctcaggtgcagctgatgcagtcgtggggctggaggtgaggaagccgtggggcctcgagtgaagctctccgtgacaagtacttcgtaggaattacgtaggttaccaaacgtactttactaattactacacgtggggtcgacgacgacggcccctagggaacgtagggtacttggaggtggagtgggatggactacaaaccgtaaggaggtcggtagaacacacggtcctacgtacgacaacggaacggtacggttaccgacgggtacgtaacgggtaccaaccgtagtacggacggttagggtacgaccggtaccggaccgtaacggacgaccggtaaccggtaccaaccgtacggttacggtaaaccttaccggtaaacgttccggttaaggaaccgttacgtaacgggtaaccgggtaccgtaacccgggtttccgttttaaccggttcggtttacggaccgggtaccggtaacccgggtacccccgggttcgggtaaccggggggtaacccggggggttaccccttaacgggtaccgggttaccgttacgggtaacccggg

SEQ ID NO: 121568 - DNA, 655 bp, Homo sapiens
  misc_feature: GYAE6OF02JFJS0.41.2.A02.1.454.CMB.1.raw
tcagtctatactatcacgaccggtgctcgatttagactcatctacagggggctggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcgatccacatctcctgcattggaaccagcagtgacattggtaggttataactatgtctcctgtaccacacacccaggaccaaacgccccaaactcaatgacttcgatgatgtcagtaactccggtcctcgtaggggtttctgggtccgcttccgtctacggctacctaggtctaggtccaaccgtaccgccctcccgtacgacctacgttcctccgtcgggcctaccgaggtcgtggacgggtacgacgcgttacggtacttacgtaccgtgtacgtaccggtacttacgtacgttaacttaaccaaacggtacgacggtacaccgtacccttaaccccgtttagttcggttaccgttaccgggtaacgttaccggggtaacgtaacccggttacgtacccggttacccggttaacgggtacctacccggacccgtaaccggaccccgtaaacccccg

SEQ ID NO: 121569 - DNA, 669 bp, Homo sapiens
  misc_feature: GYAE6OF02FGMN9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctgagtgagcctctctgcaagacttctagggataacgtacggttacaacgtacttactatactactacgtggtcgcgtacacggtccccgtaggacgagggtacgttggagtggagtgggatcggataccgaaaccctaaggaggtggtacgacgtacgacgtcctcgtacgacacgtaggtacggttaccggagggacgtacgggccaacccgtagtacggtagggtacgggtccgaaccgtaccgggacccgacggtaaccggaccgaaccggtacccaacggtacgttaacggtaaccttaccgaacggttactaacggtaacgtactaggaaccgaccgttaccggttccgtttaccgttcgtcggtacggacccggtaccgtacccgggagggtaccggggtaaccgggggtacccttacggtaccggttacgtacggtaacccggg

SEQ ID NO: 121570 - DNA, 915 bp, Homo sapiens
  misc_feature: GYAE6OF02FFJJN.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgccccactcctcagggtgctagcctgatgcagtctggggctgagggtgaggagccgtggggcctcgagtgagtccttctcctgaccaagtaccttcgtaggtaactacgtacggtttcaaacgtacgtttacctaatactaccgtaaccgttggggtacaccggtaacgtacgggccccccgttaggggaaccgtaaacgggggtaccgttttagggaaccgggtttacgggtaagttacgggggtaacgttaacggggtaaccttaacccggtaaaaccccgttaaagggtacggtttacgggggtaactaaccccgtaacgaaccgttacccgtttcgtaccggaacccgtacgaacgggtaccgggtttacccgaaggggacgtaccggggtacctaacccggtagtacgggtaacggtgggtacggaaccgtacccggggtaacccgaacgggtaccggtacccgtacccggggtaacccaacggttaacggttaaccgggtaaaacccgttttaacccgaacgtttaacccggttaacggtaaaccgggtttccctaaaggggtaacccgggtaacccgttaaccccggggttttaccttttaacccggtaccgtttcgggtaacggttaaccccggtaaccccggtacccccgggtttaaccgggggtaacccggggggtaaccccggggggttaacccctttaacccggggttaacccgggttacggttaacccgggtacccggggg

SEQ ID NO: 121571 - DNA, 820 bp, Homo sapiens
  misc_feature: GYAE6OF02GGYSJ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaacgccgtggggcctcgaggtgaacgcttctccgtgacgaagtaccttcgtagggaattaccgtaggtttaccaaccgtacttttacctaagttaacttaaccgtacgttggggttcgaccggtaaccgaccgggtcccccgtagggaaccgacgggtaccgtttggacgtgggtaagtaggggtattcggggtaaccttaaccgtaaaccccgttaaaggtacgggttacggtacgtaaccgtacgaacgtccccgttacgttacgaccgtaacgaacggttacggggtttacccggaacggggtacccgtaacgggggttacccaaccggtaacgtacgggtaacggtttcggggtaccggaacccggtacccgggtacccggaacgggttaccggacccgtaacccgggttacccaaaccggtacggttaaccgggttaaacccttcccgaacggtttccgtaacggtaaccgttgtacgggaacggtaccggtaccgggttaccgttttaccgttcgtcggttaccggtaccggaccggttaccccggtaggtaccggggggaacccggggtacccttaaccggtaccgggttaccgtacggtaccggg

SEQ ID NO: 121572 - DNA, 684 bp, Homo sapiens
  misc_feature: GYAE6OF02FJ1XQ.41.2.A02.1.454.CMB.1.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtggaggaagccgtggggcctcagtgaagctctcctgcaagacttctggatacgnggttcaacgtacttctatatacactgggtncgacgacggcccctggacgagggtacttgaggtggagtgggagtggatacaaccctaagagtggtagacacgagcctctgacacgagtacggttccgagggcgagggtccaccgagtcggaggtcggtacggacgaccgggtaccaacggacggccgaaccgggttcccaacgtaacgttacgggaaaccgtttaccgacggttaccgtaggtaagttaccgtggaaccggaccggttaaccggggttaccccgtttttacccgtttacggttccggttcgggtacccgggtaacccgggtaccccccggtaccgggttaccgggggggtaaccccggggggggtaccccgtttaaccgggtaccccgggtttaccggttaccgggttaaccccggggg

SEQ ID NO: 121573 - DNA, 680 bp, Homo sapiens
  misc_feature: GYAE6OF02JBROP.41.2.A02.1.454.CMB.1.raw
  modified_base (399)..(399): a, c, t, g, unknown or other
  misc_feature (399)..(399): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtgggcctcagtgagctctcctgcaagcttcgtggatacaggttacaacgacttctaatactaccacgttgggtgaccgtacgacggtccccgtaggacgtaggggtaccttggaggttggaagtggggagtgggaactaccgtaaaccgtaagtaggtcgggtagaacctacgtacgtcctacggtancgtaacgacgggtacggtaccgaggggaccgaacgggttaccacgtagtggtaggtcgggtacgaccggtaccgggcaacggtcggaccgaacgtcccacgtaacggttacggtaaccttaaccgacgttacggtaacgaacgtttcggaacggaacgggttacccgaccggtttccgtttaacgttcggtcggtaccgaccgggtaacccggtacccggtcggaacggggggtaccggggtcccctaacgggtaccggttaccggttacggtacccgggg

SEQ ID NO: 121574 - DNA, 726 bp, Homo sapiens
  misc_feature: GYAE6OF02IRZPA.41.2.A02.1.454.CMB.1.raw
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
tcagtctatactatcacgaccggtgctcgatttagactcatctacaggggagcatcacccagcaaccacatctgtcctctagagagtcccctgagagctccgttcctccaccatggactggacctggaggatcctcttcttggtgcagcagccacaggagccactctcaggtgcagctgatgcagtcgtgggctgaggtgaggaagcgtgggctcgagtgaagctctccngcaagacttctaggatacaggttacaacgacttntataatactacgtgggtagtcgaaccgaggccccctaggaactacggggactttaggagttggaggtgggaatgggaactaccgtaaaaccgtaaggtacggtggttaacgacgtaacagtccctagttcggacaaccgtaaggttacggtaccgacggggtaacgtacgggtaacctacccgagtacggtacggttaaggtacgacggtaaaccggccgaaacggaacggaccgaccggtaacccgacgttaaccgaaggttaaacccgttaaccgaacgttaccgtaaggtaaccgttaacgtaacggaacggttaacccgtaccggtttaccggtttaaccgtttacggtcggttaccgggtaccggtaaccggtaccccggtaccggttaaccggggggaaaccccggggggttccgttaaaccgggtacccggggttacgtacccgggttaaccggg

SEQ ID NO: 121575 - DNA, 688 bp, Homo sapiens
  misc_feature: GYAE6OF02HZP30.41.2.A02.1.454.CMB.1.raw
  modified_base (289)..(289): a, c, t, g, unknown or other
  misc_feature (289)..(289): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcacgccaacgaggacgcccactctcgaggtgcagctgatgcaggtcgtggggctggaggtaggaagggacgtccggtcggggtcctcgaggtagacgctcctcgtgacaagtcttgtaggactacgtagtcaagtacttntatatacgtacgtggcgacgacgccgccgtggacgagggtatggagtggagtgggatgacaccgaacgtagcggtgacgaacgacacgtcctcgtacgcctaacgacggtacgggttaccgacggggtcgtaacgggtaccacgtaggtacgggtacgggtcgggtacgaaccggtcccggaaccgaacggaccgtaccggcggtaaccacggtagtaccggtaacctacggtacgtgtaacgtacggtcgtagggaaccggtccgttaccgggttacccgttttcgttcgggtaacggtccggttaaccgaacccggggttccccggtaggggtaacccggggggtaacccggggttaccttaacccggggtcggtacccggttacgggttaccgggg

SEQ ID NO: 121576 - DNA, 619 bp, Homo sapiens
  misc_feature: GYAE6OF02HQ5KL.41.2.A02.1.454.CMB.1.raw
  modified_base (283)..(283): a, c, t, g, unknown or other
  misc_feature (283)..(283): n is a, c, g, or t
  modified_base (564)..(564): a, c, t, g, unknown or other
  misc_feature (564)..(564): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcagtgagcgtctcctgcaagacttcgtggatacaggttcaacgacttctatatacactgggtncgacacggtcccctggaccgagggtaccttggagtcggtagtggggatgggactaccaaacccgtaaggaggttaggtgaacacgacgtccgtctgccaacgacggtacggttccgacgggcgaacgggtccaaccgtagtacgaggtggtacgaccgacggccgtacgacgtaccgaccggtaccacgtagtaccggtaacttaccgagttccgtagacgttcgtggaacggacgtacggtcccgttttacgtcgtggtaccggacgaccggtaccccgnggtaccgggggtaccgggggtccttaaccgggtaccggtacgtacggtacccggg

SEQ ID NO: 121577 - DNA, 844 bp, Homo sapiens
  misc_feature: GYAE6OF02G7IHD.41.2.A02.1.454.CMB.1.raw
tcagtctatactatcacgaccggtgctcgatttagactcatctacaggggagcatcacccagcaaccacatctgtcctctagagagtcccctgagagctccgttcctcaccatggactggacctggaggatcctcttcttggtggcagcagccacgaggagcccactctcaggtgccagctgatgctagtcgtggggctggaggtggaggtaacgccgtgggcctcgaggtagaacgtcctctccgtgaccgaagtaccttcgtaggataacgtaggttaccaacggtacctttctaataacgtaacgtcggttgggacgtccggacgtaccgggcccccgttagggaaccgtaggggtacttgggaagttgggagttgggagtcggtaaccgtccgtaaacccgtaaggtaggttacggtcgaaaccgtacgtaccggtaccctacgttaccggacctaaaccggtacgggtaccggggtttacccggaacgggggtaccggtaaccgggggtaccctaaccggtacggttacgggtaccggggttacgggtaccgggtaaacccggacccgggtacccggaaccgggtaccgggtaaccggtaacccgggtacccgtaacgggtaacggttaaccggttaaacccggtttaccggtaaccgtttaccgggtacgtaaaccggtttcggtacgggtaaccggtacccggtacccgggtttaccgtttacggttaccggttcggttacggtacccgggtaaccggtacccccgggttagggtacccgggggtacccggggggttaccttacccgggtacgggttacccgttagggtacccgggg

SEQ ID NO: 121578 - DNA, 630 bp, Homo sapiens
  misc_feature: GYAE6OF02G4QZR.41.2.A02.1.454.CMB.1.raw
  modified_base (251)..(251): a, c, t, g, unknown or other
  misc_feature (251)..(251): n is a, c, g, or t
  modified_base (344)..(344): a, c, t, g, unknown or other
  misc_feature (344)..(344): n is a, c, g, or t
  modified_base (395)..(395): a, c, t, g, unknown or other
  misc_feature (395)..(395): n is a, c, g, or t
  modified_base (548)..(548): a, c, t, g, unknown or other
  misc_feature (548)..(548): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatgcagtcgtggggctggaggtggagggaagccgtggggcctcgagtagagctcgtcctgctaatactntggatacgtaggttacaacgtacttactaatacgtaacagtgggtcgcgaccgaacggcccgtaggacagggtactggagtggtagtgggtangggtaactaaccgaaaccgtaaggagtggtacgaacacgtacgcctacgtnacgacgaggtcggtaccgacgggcgtaagggaccacgtacgtagggagtacggtacgacgacgtacccgaggtacgaccgtacgaccaacgagtaacgaaccttacgacgtttgaggtactcgtaggaccgaacgtccggttacgttttacgngttaacggaccgacggtaacccggacccgtcgggtacgggaccggggtaccttaaccgggacggttccggtacggtaccggg

SEQ ID NO: 121579 - DNA, 698 bp, Homo sapiens
  misc_feature: GYAE6OF02FW3LT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcgaggtgcagctgatgcagtcgtgggctgaggtgaggacgcgtgggcctcgagtgagcctctcctgcaagtaccttctaggtactacgtacggttaccaacgtacttctatatactacgtgggtcgacgacgaccggccccgtaggacgacgggtacgttgacggtggaggtgggtagtacggactaccgtaaccgtaaggtaggtaggtacgacgacgacgtccctacgtcgaccgtaccgacggtggtaaccgagggaccgtaacgggtccaaccgtagtacggaggttcggaacggacgaccggacgtacggacggacccgtaaccgtaccgaacgtaacgtaaccggtaaaccttccgaacgttcgtaagtaacggttacgtaggtaacggtaccgtaccggtttccggtttaacgttccgttacggtccggtaccgggtacccggtacccggtacggggtaacccgggggtacccggggttaacccgttaaccgggttccgggtacggtaccggtacccgggg

SEQ ID NO: 121580 - DNA, 610 bp, Homo sapiens
  misc_feature: GYAE6OF02FO77G.41.2.A02.1.454.CMB.1.raw
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcagtgaagctctccgtgcaagacttctggatactaggttcaacgacttctatatacacgtgggtgcgacaggcccctggacgagggtacttgagtggngtgggatggatacaacctaagagttggagacacagccgtcngcacaggacggttaccgagggacgagggtaccaccgatggtagtgggtagcgacggccgacgacgccgaaccggtccaacgagtaggtaaccttaccgtagtcgtagtaacgtacgtggaacggtaccgtaaccgggttccgtttaaccgttccgttacggtggtacccggtaaccgtacccccggtacggttacgggggtaaaccgggggggaccctttaacgggtaccgggttaccgtacggtaacccggg

SEQ ID NO: 121581 - DNA, 625 bp, Homo sapiens
  misc_feature: GYAE6OF02IC3SC.41.2.A02.1.454.CMB.1.raw
  modified_base (246)..(246): a, c, t, g, unknown or other
  misc_feature (246)..(246): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacaggagcccactctcaggtgcagctgatgcagtcgtgggctgaggtgaggagccgtggggcctcgagtgaagctctcctgcaagcttcgnggatacaggttcaacgtacttctatactacacgtggggtgcgacgacggcccctgggacgacgggtacttggaggtcggattggggatgggtaactaccaaccgtaaagnggtaggtanacacgtagcctacgtcgccaacgaggtacggttccgaggggcgtagggtccaccgagtggaggttggcgacgaccgggccacggacgccgacggtccaaactgtaacggtaaccttaccgaaggttcctaacggtaagtccgttaggaaacggtaccgtacggttaccccgttttacgttccggtggtcggaccgtccggaccccggtcggtacggggaccgggggtacctaacccgggtggtaaccggtcggtaccggg

SEQ ID NO: 121582 - DNA, 686 bp, Homo sapiens
  misc_feature: GYAE6OF02IIFHN.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggagtgaggaagccgtgggcctcgagtgaagctctccgtgacaagtacttcgtaggactaacgtaggttacaaacgtacttactaatatacacgtggtgacgacacggccctggacagggcttgagtggatgggatggatacgaaacctaagagttggtagaacacacgtcctagtcgacaacgagtacggttaccgaggggtacaacggggtacaaccgtaagtacgaggttagggtacgaaccgaaccgggaccgaaccggaacgacccgaaccgggttacccaaagttacggtaaacggtaaaccgttaccgaagtttaccgaaggttaaacgttcgtaagggaaccggtaaccgtaaccgggttaccgttttaaccttcggtacgttacggacccggtaaaccggtaccccccgaggggttaccgggggtaaacccgggggtacccgttaaccgggttaacggttccgttaacgggtaaccccggg

SEQ ID NO: 121583 - DNA, 857 bp, Homo sapiens
  misc_feature: GYAE6OF02IC70V.41.2.A02.1.454.CMB.1.raw
  modified_base (243)..(243): a, c, t, g, unknown or other
  misc_feature (243)..(243): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagcgtgggcctgagtagagctctcctgcagacttcgnggtactacgagttacaacgtacttactatactactacgttgggtacgacgtacgaccggtccccgtagggaaccgtaacggggtaccgttagggacggttagggtacggttaggggtagtacgggaacctacccgtaaacccggttaaaggtacggttacggtacgaaccgtaccgtacgttcccgtcgtacgacccgtaacgtacgggttaaccgggttccggaaccggggtacggtaaccgggttaccctaaccggtaaggttacgggtaacggttacggggttaaccggacccggtaacccgggtacccgtaaccgggtaccggtaacccggtaaacccggtacccgaaacggttacggtaaaccggttaaaccccgtttaaccggtaccggtttaccgtaacggtaaaccggtttaccggttaagggaacccgggttaccgttaacccggggtttacccgtttttaaccgttacgggtaacccgggttaccggtaacccgggtaccccgggtaacccccgggttaggggtaacccggggggggttaaccccgggggtaccccgtttaaccgggttacccgggtttaccggtaaccgggttaacccggggg

SEQ ID NO: 121584 - DNA, 655 bp, Homo sapiens
  misc_feature: GYAE6OF02I960I.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagcttctggatacgaggttcaacgtacttctatactacacgtgggtgaccgacgacggcccctggaccgagggtacttaggaggtggacgtgggatgggataccgaaacccgtaaggagttgggtacgacacgacgcctctcgaccacgagtacggttccggagggcgagggtaccaaccgtagtggtaaggtcgggtacgaaccgacgggaccacgggacgaccgtaccgggtaccaacgtacgtacggtaacccttaccgaacggttccgtaggtaacgtcgtacggacggtaaccgtaccggttaccgttttacgtacgttcggaccggtaccggtacccgaccccggtagggttaaccgggggtaccggggttacccctaacgggtaccgggttaccgtacgggtacccggg

SEQ ID NO: 121585 - DNA, 555 bp, Homo sapiens
  misc_feature: GYAE6OF02HPGHQ.41.2.A02.1.454.CMB.1.raw
  modified_base (345)..(345): a, c, t, g, unknown or other
  misc_feature (345)..(345): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtggggcctcgagtgaagctctcctgcaagacttctggatacaggttcaacgacttctatatacactgggtgcgacaggcccctggacagggacttggagtggatgggatggatcaaccgtaagagtggtgacacngcctcgtgcacgacgaggttccgagggcagggtcaccgtatggtagtggtgacgacggaccgagacgacgacggtccaacgacgtacggaacttaccgagtcgtagaagtctagacgacgacggtaccgtttactcgtcgtgccgaacgtccccgtacggtacggggaaccgggggtcccttaacggtaccggttacctaggtacccggg

SEQ ID NO: 121586 - DNA, 805 bp, Homo sapiens
  misc_feature: GYAE6OF02G2WJP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgctagtcggtgggcgtaggagggtggaacgggacggcccggtcggggcctcgagtaggaacgtcctcctccgtgactaacgtacttcgtaggtacttaacggtacgttaaccgaacgttactttactaattactaacgaccggttgggtacgcgaccggaccggtcccgtaggacggtacggtacgtacggaggtggaggtaggacgtggaacctaccgtaaccgtaaggtacggtagtaccgacgacgacgtcctcgacgactaacgtaggtaaccggtcggaacggtcggacggtaccacgtgtacggtacggtgggtacgacccggacgtacccgacggaaccgccggtaaccgcccgtaacgtaaccggtaccggttaaccgttacgtaccgggttaacgtacgtaacggttcgggtaaacccggtaacgggtaacccgttaaccgggttttccccgtttaaccggtttaccgggtaaccggttccccgggaaccggggttaaccccgggttacccggggtaacccgggggttaccgggggggtaaccccccggggggtttaacctaaccccgggggtttacgggtttacccgggtaacccgggttaccccggggg

SEQ ID NO: 121587 - DNA, 706 bp, Homo sapiens
  misc_feature: GYAE6OF02HYG00.41.2.A02.1.454.CMB.1.raw
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctttggtggcagcagccacaggacgcccactctcaggtgcagctgatgcngtcgtgggctggaggtgaggagcgtgggctnagtnagctctctgcaacgtcttcgtggatacgtacggttacaacgtacttacgtaatactacacgttgggtcgacggtacaccggcccgtggaacgagggtactggacggtggaggtgggactggtaacaccgtaaacgtaggagtgggtaacactactacgtcctcgtgaccgaacgtcgggtacggtcgagggtcgaacgggtacaccgagtgggacgttgggtacgaccgtaccggaccgaacggtaccgccggtaccgtaccgaacgtagtaccggtaacccttaccgtaacgttacgtacggtaacgttacggtacggtaaacgggtacccgtacccggtttaccgttttaacgtttcggtacggtaaccgggacggtaaccccggaacccccgggttaggggtaccgggggggttaaccccggggggtaaccctttaacccggggttaacccggtttaccgggtaaccgggttacccgggg

SEQ ID NO: 121588 - DNA, 769 bp, Homo sapiens
  misc_feature: GYAE6OF02H9XV7.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggaacgccgtggggcctcgagtagaacgtctctccgtgacaacgtctttcgtggtactacgtacgttaccaacgtacttacttataactacacgtcgggtcgcgtacgaccggcccgtggacgacgggtacgttggaggtaggtacggtagggtacgtggtaactaccgtaaccgtaaggaggttaggtacgaacgacgtcgtacctacgtcgacgacgtaacgggtacggttacggacgggacgtacggggtaccaccgtagtacggtaggtacgggtacgaaccggacccgggaccgtaacggacgtacccgtaccgtaccgtaaactggttaacccgtaaccgttaaccgtacggttccgttaagggtaaaccgttcgtaacgggaaaccgtacggttacccgggttacccgttttttaccggttacggtcggttaacccggaccgggtaaccccggttaacccccggttagggggtaccccggggggggtaacccggggggttaaccccttttaaccgggttaaccggggttacccggttacgggttaaacccgggggg

SEQ ID NO: 121589 - DNA, 730 bp, Homo sapiens
  misc_feature: GYAE6OF02GFPMT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatcgcagtcgtgggctggaggtggaggaagccgtggggcctgaggtcgaagcctctcctgacaagtcttcgtggatacgaggttcaacgtacttctatatacgtacgtgggtcacgaccgaccggccctggtaacgaggtacgttggaggtggaggtgggtacgtacggtactaaccgaaaccgtaaggaggttacgggtacgaacgacgtacgtacccgttacgcgtacgtaaccgacgggtacggtacccggaacggggaccgtacgggtaccctaaccggtaggttagggtaccggttcgggtaaccggaacccggtacccgggacccgaaccggtaaccggacccggtaacccggtacccaaacggtacgtaaacggtaacccttacgaacgttcgtacggtaacgttacgacggtaacccggtacgtaacccgtttccgttaccgttcgtaccgggaccgttaaccggcccggtaaccccgggtgggtaaccggggacccggggttactaacccggttccgggtacggtacgggttacccggg

SEQ ID NO: 121590 - DNA, 667 bp, Homo sapiens
  misc_feature: GYAE6OF02G6LPR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagcctggggcctcgagtgaagctctcctgcaagcttctggatacgaggttcaacgtacttctatactacgacgtgggtgcgacgacggccccgtaggacgagggtacttgaggtggagtgggatgggactaccgaaacccgtaaggacgtgggttacgaaccgtacgtacgtcccgttacgtgaccgacgtacgggtacggttacccgagggtaccgtaacggggtccctaaccggtagtcggaaggttcggtaacggaccgaccgggcccgtaacgggacgtccgaaccggttccactacgtacggtaacccttaccgagtctaggtaacgttcgaggtaacggtaccgtacggtttaccgttttcgtacgttggtacgtaccggtacccgtaccccggtggtaaccggggggaacccggggttcccttaaccggtaacgggttacgtaccggtaccggg

SEQ ID NO: 121591 - DNA, 641 bp, Homo sapiens
  misc_feature: GYAE6OF02G0GGR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtgggcctgagtgacgctctcctgacaagacttcgaggtatacgtaggtacaacgtacttactataatactacgtgggtacgacgacgaccggccccgtaggacgagggtacgttggaggtggagtgggatggaactaccgaaaccgtaaggtagtcgggtacgaacacgacgtcctcgtacgacacgtaaggtacgggtaccgacgggtacgtacgggtaccaccgtaggtaggacggtggacgacgaccggaccaacggcgacaccggacagacgtacgaaaccttacgacgtctagtacgtcgaggaaccgtacgtaccgggttcttttaacgtcggtcggtaccggacggtaaccccgacccggggtaggtaacccggggggtaccggggttaccctacgggtacggtcccggtaggtacccggg

SEQ ID NO: 121592 - DNA, 619 bp, Homo sapiens
  misc_feature: GYAE6OF02FLAM4.41.2.A02.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggggctgaggtgaggaagccgtggggcctcagtgaagctctcctgcaagacttcgnggatacaggttccaacgacttctatatactacgtgggtgcgacaggcccctggacaggggtacttgagtggagtgggntggactacgaaaccctaaggngtaggtnacacgacgcctctgcaacaggacggttccgagggcgagggtcgacctagtcgtaggtgggtcgaccgacgggaccacgacggccgaccggccacgagtcggtaacttaccgagttacgacgtaagtcgacggaacggtaccgtaccgggttaccgttttaccgttcgttacggttcggccggtaacccggtcccccggtacggtacgggggaacccggggggtacccgttacccgggtaccggttaccggttacggtaacccgggg

SEQ ID NO: 121593 - DNA, 698 bp, Homo sapiens
  misc_feature: GYAE6OF02I5R9N.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcgagtgaagctctcctgacaagcttctggatacgtaggttacaacgtacttctatactacacgttggggtcgcgacgacggccccgtggaccgagggacttggaggtaggagtgggatggataccgaaccgtaaggcggttgggtacgaacacgacggtcctcgtcggacaacgtaggtacggttaccggaagggtcgtacggggtaacctacgagtaggacgggttgggacgacggaccggaccgacggacgtccgaaccggtaccacgtaacgtacggtaaaccctttaccgacggttacgtacgtaaagttcggtaacggaacggtaccgttaaccggttaccggttttaccgttacggtcgtaccggtaccgggtaacccgggtaccccgggtaccgggttaaccggggggtaacccgggggggttaccgttaaccgggttaacccggggttacccgtaacgggttacccgggg

SEQ ID NO: 121594 - DNA, 746 bp, Homo sapiens
  misc_feature: GYAE6OF02JPKKW.41.2.A02.1.454.CMB.1.raw
  modified_base (149)..(149): a, c, t, g, unknown or other
  misc_feature (149)..(149): n is a, c, g, or t
  modified_base (203)..(203): a, c, t, g, unknown or other
  misc_feature (203)..(203): n is a, c, g, or t
tcagtctatactatcacgaccggtgctcgatttagactcatctacaggggagcgatcacccagcaaccacatctgtcctctagagagtccctcgagagctccgttcctcaccatcggactggacctggaggatcctcttcttggtggcngcagccacgaggagcccaactctcaggtgacagctgatgcagtcgtgggctggnggtgaggaacggccgtggggcctcgacggttgaacggcttcgtcctagcaacgtacgttctacggtattacgtaggttacaacggttactttactagtaattacgaacgtgggtacgtcgaccgacggtccccgtggaaccgtaggggtacctttgggtaggtcgggtaagttacgggtagtggtaactaccgtaaacccgtaaggtacggttcggttacggaacgtaaccgtacgacccgttcgtacggtaccggacgaaggttaccgggttaacgtacggggtaccggtacgggtaaacccgtacgtacggttaaggtcgggttaacgggtacggtaaccggtaccgggtacccgaacggttaacgcccggtaccggtacaccggtacgtaacggtaaccgttaccgaggtttaccaggttaaacgttcgacggtaacgaggtacccggtacgttttacgtacgtttacggcgtaccggtaccgaccgtaccgggtaccgggtacgggtacccgacggtacgggttacctaggtacccggg

SEQ ID NO: 121595 - DNA, 746 bp, Homo sapiens
  misc_feature: GYAE6OF02JG3IR.41.2.A02.1.454.CMB.1.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (577)..(577): a, c, t, g, unknown or other
  misc_feature (577)..(577): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcaggtctgggctggaggtgagaagccgtggggcctcgagtgaagcgtctctgcaagacttcgnggtatacgtaggttacaacgactttactatacgtactaacgtggggtacncggtaaccacggtcccgtaggtaccgagggtacttgggacgttaggagtgggtatgggtaactacgaaaccgtaaggtaggttacggagaacgaccgtagtcccgtacgtaacgcgttaacgaaacggtcggtttacccggacgggtaaccgtaacgggggttccaaccccggtaaggtagggtaacgggttaggtaccggaacggttacccgggacccacggggtaacgccgtaacccgggtaccacggtaacgttacggtaacttaccgagtaaccgnggtaaaccgttcgaacggtaaccgggtactaacccgggttacgttttaaccgttcgttacggggtactaccggggtaacccgtaaccccgggttcgggtaaaccggggggtaaccggggggtaccccctttaagggttaccccggtaacggggttaacccgtcccgggg

SEQ ID NO: 121596 - DNA, 547 bp, Homo sapiens
  misc_feature: GYAE6OF02GPZ7N.41.2.A02.1.454.CMB.1.raw
  modified_base (286)..(286): a, c, t, g, unknown or other
  misc_feature (286)..(286): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgacgctctcctgcaagccttcgtggatacaggttacaacgacttactatatacacgtgggtncgacgacggccccgtggacaggacttgagtgggagtgggatggactacaacccgtaagagtggtgacacacgcctctgaccacgaggtacggttccgagggcgacggtcgaccagtgagtggtgacgacggcacgancgacgccacgngtcgaactacgagttctagagtcgtaggacgacgacggtcctttacgttcgtggtacgcggaccgacccgtgtacggggacggggcctagggtccgttacggtacgtaccggg

SEQ ID NO: 121597 - DNA, 863 bp, Homo sapiens
  misc_feature: GYAE6OF02G2MA3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctctttcttggtggcagcagccacgaggagcccactctcaggtgcagctgatgcagtcgtgggctggaggtgaggacgccgtggggcctcgagtagaacgctctccgtgactaagtacttcgtggtaatacgtaggttacaacgtactttactattaactaccgacgttggggtacgaccggaccgtaccggccccgttaggaacggtaacgggttacgttaggaggttgggtagttacggggagttcgggaactaccgtaaacccgttaaggtacgggttacggtacgaaccgtaaccggtcgtacccgttacgacgaccgtaacgtaagggttacccgggttacccgggaacggggtaccggaccgggttaaccgaacccgttacggttacggtacgggttcgggttaacggaaccccggtaccgggtaacccgacgggtaaccggtacccgtaaacccgggtaccaaaccggtacgttaaacccgggttaaccctttaacccgggtacgttaacccgttaaggttaaccggttacggttaacgggtaaaccggtaccggtttaacccggttttacccggtttttaaccgttaccggtttacgggtaccggttaaccccgggtaacccgggttaccccggtaacggggttaacccggggggtaccccggggggttaacccttaaccccggggtttaccggtaaccggttaccgggttaaccccggggg

SEQ ID NO: 121598 - DNA, 588 bp, Homo sapiens
  misc_feature: GYAE6OF02GTUGN.41.2.A02.1.454.CMB.1.raw
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgagggaacgccgtggggcctcgagtgaagctctctgacaagcttcgtggatacgtaggttcaacgtacttctatatacagtgggtgcgacgcggccctggacagggtactggaggtggagtgggatggactacaaaccgtaaggagtggtagacacacgcctcgngacacgtagcggttccgagggtcgacgggtcacgtagtggaggtggtacgacgacggccaaggacgcgaaccggtaccaacgtcgtacggtaaccttaccgagtacgtagtaacgtcgtacggacgtacgtaccggttccgttacgttccgtggtacgaccggaccgtacccggtcggtacggggaccggggccttacggtacggtacgtaggtacccggg

SEQ ID NO: 121599 - DNA, 691 bp, Homo sapiens
  misc_feature: GYAE6OF02II7J8.41.2.A02.1.454.CMB.1.raw
  modified_base (250)..(250): a, c, t, g, unknown or other
  misc_feature (250)..(250): n is a, c, g, or t
tcagtctatactatcacgaccggtgctcgatttagactcatctacaggggagcatcacccagcaaccacatctgtcctctagagagtccctgagagctccgttcctcaccatgactggacctggaggatcctcttcttggtggcagcagccacgaggacgcccactctaccaggtgcagctgacgtgctagtccggtgggctggagggtggaggaaggccggtacggggcctcgagtagagtctccgtcngtcaagtcttcgaggatacgacgttacgaacgtacttatatatacgactgggtcgacgagccgcccgtagacgaggtctggagtgagtggacgtgactacgaaacgtaggtagtggtacgactacgcgtcctagtacgaccgtaaggcgtacgggttacggacggacccggtagggtacccaacggttagtggacgggttggaccggaccgtaaccggaccgaacgtcggacccgtacggtaccaacggttaacgacggtaacccgttacgtaaagtccgtaaggtaacgtcggaacgtaaccggtacccgttacgggttacccgttttaatcccgggtaagtacccggtaacgtaccccgggtaacccggtcgggttaacccgggggaacggggttcccttaacccgggtaacgggttccggtaccggttaacccggggg

SEQ ID NO: 121600 - DNA, 635 bp, Homo sapiens
  misc_feature: GYAE6OF02GS5LC.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtggggcctcgagtgagctctcctgcaagcttcgtggatacgaggttcaacgtacttctatatacacgtgggtgcgacgacggcccgtggacgagggtactggaggtggagtgggatggaactaccaaaccgtaagaggttggtacacgacgacgtccctctacggcgaacgaggtacggtccgagggacgacgggtcaccgagtggtaggtacgggtgaccgtaccggccgacggtacgcccgacggtacccacgtagtaaccggtaaccttaccgtaaggtactagtacgttacgtacggtacggaacgcccggttaccgtttaccgttcgtcgggttccggaccggtaccggaacccccggtgggaccgggggtacccgggggtaccgttaacccgggtacggttaccggtacggtacccggg

SEQ ID NO: 121601 - DNA, 696 bp, Homo sapiens
  misc_feature: GYAE6OF02H4RC3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtgggcctcgagtgagctcctcctgcaagtcttctggatacgaggttacaacgtacttctatactacacgtggtgcgacacggcccctaggaccgagggtacttggaggtggagtgggagtggactaccgaaccgtaaggagtggtacgaacacacgtcctacgcgacacgtacggtacggttaccgagggcgtacgggtaccacagtaggacgtggtagaccgaccggtccacggacgaccgaacggtccaacgtacgttacggtaaaccgttaaccgacgttacgtaacggtaacggttcgtaacggtaacgggtaccgtaccgggtttacccggtttttaacgtttcccggttacgggtttaccggacccgggtaacccggtaaccccccggtagggggttaaccccggggggaacccggggggggttacccgtttaaacccggggttaaccggggtttccccggtaaggggttaaccccgggg

SEQ ID NO: 121602 - DNA, 702 bp, Homo sapiens
  misc_feature: GYAE6OF02JJE9V.41.2.A02.1.454.CMB.1.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgnggggctgaggtgaggacgcgtgggcctcagtgagctctctgcaagcttcgnggatacaggttcaacgtcttctatactactacgtgggtcgcgacgacggcccctagggacgaacggggtacttaggacggtagggtagtggggaacttggggaactaccgtaaaacccgtaaggtacggtagggtacgaacctacggaacgcccttacgtacggaccgtacgaggtaaccgggtttccggaacgggtaccgtacgggtaccaaccgtagtcggtaacgggtggtaccggtaccgacccgggaccgacggtacggccgtaaccggtccaacgtaagtaccgggtaaccttaaccgtacggtacgtacggtaccgttacgtacggaacggaccgtaccgggttacccgttttacgtccggttggtcggaccggtaccggtacccggtacgggtaccgggggaaccgggggtccctaaccgggttaaccgggttacgtaccgggttacccggg

SEQ ID NO: 121603 - DNA, 711 bp, Homo sapiens
  misc_feature: GYAE6OF02IHHH5.41.2.A02.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgnggtgaggaacggccgtggggcctcgagtgagctctccagcaagcttcnggatacgtaggtacaacgtacttactaatactactacgtggggtcgccgaacgaccggtcccgtaggaccgagggtacttggagtacgggagtggagtcggactacgaaaccgtaggaggtgacgtacaacgtacgtccctacgtcgaccgacgacgggttacggtaccccggagggaccgtacggggtacctaacgtaggtacggtagggtcgggtacgaaccggtaccggacgtaccgacgtacccgaccgtacgaaacgcgttaaccggtaacccttaccgaacgttctaacggtaagttaccggtaagggacccggtaacgtaccgggttttaccctttaggtttccggttggtaccggtacccggacccggttacccccgggtacggggttaccgggggggtaaccccggggttaccgttaacccgggttaaccggttcccggtaaggttaccccggggg

SEQ ID NO: 121604 - DNA, 641 bp, Homo sapiens
  misc_feature: GYAE6OF02HYU85.41.2.A02.1.454.CMB.1.raw
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagtcttctggatacaggttacaacgacttctagtactacacttgggtcgacgacgacggcccctggacagggacttgagtggagtgggatggactcaaccgtagagtggtnacacagcctcgtgactacgagtacggtccgagggacgtacgggtacgaccgtagtaggagttacgggtacgacgtaccggaccgtacgacggaccgtacggtccaacgtacgtaccggtaacctttaccgtaacgttacgtacggtaacgttcgtaaggaccgtaaccgtaccggttaccgttttaccgttcggttacgtcggtacggtacccgtaccccggtaccgggttacgggtaacccgggggggtacccttaaccgggttaccggttaccggtacggtaacccgggg

SEQ ID NO: 121605 - DNA, 724 bp, Homo sapiens
  misc_feature: GYAE6OF02JMK1M.41.2.A02.1.454.CMB.1.raw
  modified_base (637)..(637): a, c, t, g, unknown or other
  misc_feature (637)..(637): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtaggaggaaggccgtggggcctcgaggtagaagtcctcgtcctagccaagtacttcgtgatacgaggttacaacggtacttactagtatacacgtgggtgtacgacgtcggcccctggaaccgagggtaccgtttggacggtagggacgttaggggatgggtactacccgtaaacccgttaagggaacggttggggtcaacggtaaccgaagtcccgttagtagggacccacggtaaggtaccgggttaccggacggggtaccggtaacgggtccgtaacacggttaggcgttagggttacggaaccgtccgggacccgaaacggccgggacctaacggggtcccaacggtaagtaccggtaaaccttacccgtagttaccgtaacggtaacggttcgtacggacggtaccgtaccgggttccgtttttaaccgngtttaccggacgtaccgggtaccgtaccccgggacggttacggggaaccgggggtcctaaccggttacggtctacggttaacccggg

SEQ ID NO: 121606 - DNA, 824 bp, Homo sapiens
  misc_feature: GYAE6OF02FL677.41.2.A02.1.454.CMB.1.raw
  modified_base (224)..(224): a, c, t, g, unknown or other
  misc_feature (224)..(224): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctctcttggtggcagcagccacaggagcccactctcaggtgcagctgatgcagtctggggacttggaggttgaggaagccgtggggccctnaggtcgaagccttctccgtgcaacgacttctggactaacgtacggttacaaacgtactttacttagtaactacctaagttcgggttgcgtaaccgacggtacccccgtaggacggtacgggaccgtttaggaggttcgggaagtaggggtatcgggtactaccgtaaacccgtaaggtaggttacgggttacgaccgaacgacggtcccttacgttacggaccgtacgtaaggaccggggtttacccgaaggggccggtaacggggtacccgtaaccgtaacgggttaccggtagggttacgggtacggaacccggtaaccgggacccgaaaccgggttaccggaaccggtacccgggttacccgaaccgtaacggttaaccggtaaaccgtttaacccgaacggttcgttaacgggtaaacgttaccgtacgggtaaacgggtaccgtaacccggggtttacccgtttaacccggtttaccggttcggttacggtacccgggtaaccggttacccccggtaaccgggttaaccgggggacccgggggggttaacccgttaacgggtttacccgggttaccggtacggttaaccccgggg

SEQ ID NO: 121607 - DNA, 679 bp, Homo sapiens
  misc_feature: GYAE6OF02HA6B2.41.2.A02.1.454.CMB.1.raw
  modified_base (236)..(236): a, c, t, g, unknown or other
  misc_feature (236)..(236): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctggtggcagcagccacaggacgcccactctcgaggtcgcagctgatgcagtcgtgggctgaggtgagacgccgtgggcctgagtgaagtctctccgnacgaacgtacttcgtacggtatacgtaggttacaaaccgtcttaccgttaataactacgtacggtggggtcgacggaccgaacgggtccccgtagggaaccgtaggggtccttaggaggttcggaacgtgggtatcggaactaccgaaaccgtaggaggtgtacgacgacgtacgccttagcgacgacgtacggaggttacccgaggtcgtacgggtcaaccgtagtagggaagtcggggaacgaccggaccggacggaacggtacgaaccgtccgtacgaacgacgtacggtaaaccttccggaagttcgtaagtccgaagtcggaacgaccgtaccggggttacctttaccgttcggtaacgtccggacgtaaccggaccccggtacggttaccggggggacccgggttctaacccgggtacggttccgacggtacccggg

SEQ ID NO: 121608 - DNA, 616 bp, Homo sapiens
  misc_feature: GYAE6OF02G4F6W.41.2.A02.1.454.CMB.1.raw
  modified_base (357)..(357): a, c, t, g, unknown or other
  misc_feature (357)..(357): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtctggggctgaggtgaggaagccgtggggcctcagtgaagctctctgctagacttctggatacaggttcaacgcttctatatacactgggtgcgacgacggcccgtggacagggtacttggagtggagtgggatggatccgaacctagagtggtagacacagtcctacncgcacgagtacggttaccgagggacgagggtaccaccgagtggaggtggtacgtacgacggtccgacggacgccgaccggtccaacacgtacgggtaaccttaccgaagtccttacggtaacgttccgtagggaacgaccgtaccggttaccgttttaccgttacggttcggttacggtcccggaaccggtacccccggtgggtaccggggacccggggggtacccttaccgggttacggttaccgtacggttacccgg

SEQ ID NO: 121609 - DNA, 753 bp, Homo sapiens
  misc_feature: GYAE6OF02GI71O.41.2.A02.1.454.CMB.1.raw
  modified_base (372)..(372): a, c, t, g, unknown or other
  misc_feature (372)..(372): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggacgcccactctcaggtgcagctgatgccagtcgtggggctggaggtgaggaagccgtggggcctcgagtgaagctctcctgacagacttcgtggactacgtaggttacaacgtacttctatatacctacgtgggtgcggaccgaccggccccgtaggaacgagggtacttaggaggtgggagtgggagtcggtaactaccaaaccgtaaggnggtagggtacgaccgaacgacgtccctacgtcgaccgaccgtagggtacggttaccgaacggggtaccgaggggtaccaccgtaggtaggtacggtagggtacgaaccggaccgggtacccgaacggtaccggaccgtaaccgggtacctaacggacgttaaccggtaaaccgtttaccggtaacgttccggttaagacggtttaccggtaacgggtaaccgaaccgggttaccggttacccggttttaacctttacgggtccggttacgggtacccgggtaaccccgggtaccccgggtacggtaaccgggggggttaaccccgggggggttccctaaacccggggtttacccggggttaccggtacggttaacccgggg

SEQ ID NO: 121610 - DNA, 679 bp, Homo sapiens
  misc_feature: GYAE6OF02HGH45.41.2.A02.1.454.CMB.1.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (432)..(432): a, c, t, g, unknown or other
  misc_feature (432)..(432): n is a, c, g, or t
  modified_base (494)..(494): a, c, t, g, unknown or other
  misc_feature (494)..(494): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacgaggacgcccctactcctcgaggtgcgagctgactgcagtcgtgggctggaggtgaggacgccgtcgggcctgagngacgtctctcgngacgtaacgtacttgtggaactacgtggttaccacgtactactaattactactacggtgggtacgaccgtacgccggacccgtaggaacggacggttatggngtaggagtggagtcgactaccggaactaggaggtcggtacagacgacgtccgtactacggcctaaggtacggaccggttaccggnggggaccctaacgggtccaaccgtaggtagggtaggttgggtaccgacgccgggaccgacgngaaccgacgtacccgaatcggtaaaccgttctacggtatacggttacgacgtcggaaacggtaccggtacggtacccgtttacgtttactcgggtctaccggtacccgacccggtccggggtacggtaaccgggggggtacccgggtacccttacgggttaaccggttacggacccggtaccggg

SEQ ID NO: 121611 - DNA, 659 bp, Homo sapiens
  misc_feature: GYAE6OF02IMXN8.41.2.A02.1.454.CMB.1.raw
  modified_base (407)..(407): a, c, t, g, unknown or other
  misc_feature (407)..(407): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtgggctggaggtggaggagccgtggggcctcgagtagacgctctccgtgactaacgtacgttcgtaggtactaacgtacggttacaacgtactttacttataactaaccgtacggttgggtcgacgaacgaccgggtccccgtagggaccgtagggtacttggacggtggtagtggggagtcggactaccgaaaccgtaggagtggacgacgacncgtcctgcgcgagtaggtacggtacgagggctacgggtacacgaggtagtaggtggacgacgaccggtaccgacggacgaccgtaccggtccaacggtacgtaccgggtaaacctttacccggagtcccgttaaggtacgtcgtaacggacggtaccgtaccggttccgtttacttcggtcggtacggaccgtccggacccggtaggtaccgggggaaccggggtccctacgggtaccgttcggagtccggg

SEQ ID NO: 121612 - DNA, 691 bp, Homo sapiens
  misc_feature: GYAE6OF02II1X5.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaggaagccgtgggcctcgaggtgacgctcgtcctgacaaaggtcttacgtaggactacgacggttaccaacgtcttatatacttacgacgtggtcgacgtacgcggtccccgtaggccgagggtactaggaggttaggacgtgggacgtagggtactacccgaaaccggtaaggtacggttcggtacgaaccgaccgtacgtcccttacgcggtaccaacggtacgggtacggtttaccggaggggtacccgtacggggtacccaacgtagtagggtacggttagggtaccgacggaccggaccgaacggacgtaccgtaccgacacgtagtacggtaaccttacgagttcgtaggtacgtaccgtaggccggtaacgtccggtttacgtttacgtcggtacggtcgaccggtaacccggtcccggtacgggtaccgggggtacccggggttaacttaccgggttaacggtccgtacggtcccgggg

SEQ ID NO: 121613 - DNA, 748 bp, Homo sapiens
  misc_feature: GYAE6OF02J15YU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagcctggggcctcagtgaagcgtctcctgcaagacttctggatacgaggttcaacgacttacgtatatacacgtgggtgacgacacggccccgtaggacgtacgggtacttcggaaggtgggtaacgtaggggacttacggggaactacccgaaacccggttaaaggacgggtttacgggtaacggaaccgaacgtaaacggtcccgttaccgttacggaccgtaaacggtaacggtacgggtttacccgacgggggtacggtaaccgggttaccaacccgtaagttacgggtaagggttacgggtacggaaccgaaccgggtaccaacgggacgaccgtaccggtacccgacgtaacgttacggtaaccgttaccgtaccgtaccgtaacggtaacgtacgtaacggaacgtaaccggtaccggtttacccgtttacttacggtcggttcggaccggtacccggttaccccggacggttaccgggggaacccggggggtaccttaaccggttaacccgggtacgtaaccggtaacccgggg

SEQ ID NO: 121614 - DNA, 705 bp, Homo sapiens
  misc_feature: GYAE6OF02HPZOV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagtcttctggatacgaggttcaacgacttctatatacacgtgggtgcgacgacggccctaggacgagggtaccttggacgtggagtgggatagggactacgaacccgtaaaggacggtggtagtaacgacgacgtaccttcgtaggaccaacgacggtaacgggtttacccggaaggggtccgtaaggggtaccaacccgtagttacggtagggttgggttacggaccgaaccgggacccgaacggaacgtaccgaaccggttcccgaacgacgtaccggtaaacccgtttaaccaaggttcgtaggtaaacttcggttaacgaacgggtaccgtaccgggttacccgtttttaccgttacggttacgttccggccggtaaccggtacccccggtacggtaccgggggtaacccggggggtacccgttaaccgggttaaccgggttccgttaacgggtacccgggg

SEQ ID NO: 121615 - DNA, 672 bp, Homo sapiens
  misc_feature: GYAE6OF02GPWJB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatgactggacctggaggatcctcttcttggtggcagcagccacaggacgcccactctcaggtgcagctgatgcagtcgtggggctgaggtgaggagccgtggggcctcgagtgaagctctcctgcaagacttcgtggatacgtaggttcaacgtacttactatactacacgtggggcgcgacgtcggcccgtggacctagggactggagtggatgggagtgacgtacaaccgtaagacggtggtacacgacgacgcctacgtcgacgaacgtaaggacggttaccgacggggaccgtacgggtaccgaacgtaggtacggtaaacgggttcgggtacggaaccggaccgggacccgtaacggaacggtaccgtaacccgggtccaacgtaacgtacggtaaaccgttaccgtagttactacggtaacgttcgaaggtaacggaccgtccgggtttaccgtttacctacggttcgggtacgtaccggaacccgtacccggacgggtaccgggggaaccgggggtcccttaacgggtaccgggttaccgtacgggtaccggg

SEQ ID NO: 121616 - DNA, 596 bp, Homo sapiens
  misc_feature: GYAE6OF02INPS5.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacgaggttacaacgacttctatatacacgtgggtgcgacacggccctggacagggcttgagtggatgggatggatcgaacctaagagtggtagacgacgacgcctctgacgacaggtacggttaccgagggtacgacgggtacaccgagtcggaggtcggtacgacgaccgggaccgaacggacgtaccgaacggtaccaacgtagtacggtaacttaccgagtacgtagtaacgtcgtaggaacggacctacgggtccgttttaacgtcgttgtacggacggtacgtaccccggacgttacggggaaccgggggtcctaacggtaccggttacgtacggtaccggg

SEQ ID NO: 121617 - DNA, 725 bp, Homo sapiens
  misc_feature: GYAE6OF02H5WRP.41.2.A02.1.454.CMB.1.raw
  modified_base (413)..(413): a, c, t, g, unknown or other
  misc_feature (413)..(413): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaacgcgtgggcctcgagtgaagctctcctagcaagtacttcgtaggtactacgtaggttacaacgtacttctaatataacgacgttgggtcgaccgtacgaccgggtccccgtaggaccggtacgggtactttggacggttgggaaggttcggggaagtacgggtaactaacccgaaaccggttaaaggacggtaggtacgaacgacncggtacctcgtagccgaacgtacggttaccggttaccggaacgggtcggtacgggtaccctaaccgtaggttacgggtacggtagggtacggaaccgaaccgggtacccgaaacgggacggaacccggtaccggtacccgaacgtaacggttacgaaaccctttaccgtaagtaccgtacggtaacgttcgtaggtaaccgggtacgtacccggttaccgtttaccttggtgtacgccggaacccgtcccggacgggttaccggggaaccgggggtacccttaccgggaccggttacggtaccggtaccggg

SEQ ID NO: 121618 - DNA, 653 bp, Homo sapiens
  misc_feature: GYAE6OF02GB76Q.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacgaggttcaacgtacttctatatacacgtgggtgcgacgacggccccgtggacagggacttggagtggagtgggatggactaccgaaaccgtaaggagttgggtagaacgacacgtccctcgtacgacacgacggtacggttaccgaaggggtccgaacggggttccaaccgtagtacggtacggttgggtacgaccgacggtaccgaacgacggaccgaccggtaccaacgtacgtacggaaccttaccgtacgttcgtaaggaacgttcgtacggaaggtaacccgaccgggttacccgttttacgttcgttcggtacggccggtaaccgtccccggtacggttacgggggaacccggggggtcccttaaccgggtaccggtaccggtacggttacccggg

SEQ ID NO: 121619 - DNA, 661 bp, Homo sapiens
  misc_feature: GYAE6OF02FISIL.41.2.A02.1.454.CMB.1.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagcccgtggggcctcgagtgagctctcctgcgaagcttcgtggatacgtaggttacaacgtacttctactatacacgttgggngcgaacncggcccgtaggacaggggtactggaggtggagtgggagtggataccgaaccgtaaggaggttgggagaacctacgacgtaccctcgtgacctacgaggtacggtccgagggcgacgggtcacgagtcggtaggtcggtacgacgaccggaccgacggacgaccgacgtacccaacgtacgtacggtaaccttaccggaacgttacggtaacgtacgttacgacggtaacgacgggtacccggttacccggtttaccgtacgttcgggtactaccggtaacccgggtacccccgtaggggttacccggggaccgggggggtaacccgttacccgggtacgggttacccgtacgggttacccgggg

SEQ ID NO: 121620 - DNA, 626 bp, Homo sapiens
  misc_feature: GYAE6OF02F0UDU.41.2.A02.1.454.CMB.1.raw
  modified_base (436)..(436): a, c, t, g, unknown or other
  misc_feature (436)..(436): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttgtggatacgaggttcaacgtacttcatatacacgtggtgcgacgacggaccctgggacagggtacttaggacgtggtagtgggatggatacgaacaagtaagaaggttggacgaacacgtacgcctacgtgtacaacgtacgtaggttaccgaaggggtcaacggggtccaaccgagtcggacggttaggngacccgtacgggacccaacggacgcgtaccgggaccagtaacgtacggtaaaccttaccgagttactacggtaactcgtaacggacgtacgaccgggtttccttaacgtttcgagtcggacccgtaccgtaccccgggtcggtacggggggtaacccggggtccttaacggttaccggtaccgtaacggg

SEQ ID NO: 121621 - DNA, 863 bp, Homo sapiens
  misc_feature: GYAE6OF02IQJ9S.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgccccactctcgaggtcgcagctgatgcagtcgtcggggtctggaggtggaaggaacggtcccggtggggcccctcgaggtacggaagccttcctccgtggaccaaagttacttcgtaggtaactacggtaaggttaccgtaaacgtaccttttactaattaactaaccgtacggttgggggtaccgccggtaaccgacggggtacccccgttacggggaaccgaagggggttaccgttagggtacgggtagggtaggtacgggggtagtacgggaacttaacccgaaaacccggttaaggtaacggggttacggggagaaaccaaccggtaccgtcccgttacgtacggaccgaacggtaacgggttaaccgggttaccgggaacgggtaccggtaacgggccctaaccgtaggttacggtaagggtccgggtacgaacccggacccggtaaccgaacggaccggtaccgtaacccggtacccgtaacgaacggttaacggtaacccgttacgaaccgttacgtacgtaacggttaccgtaggaacccggtaaccgtacccgggtttccgtttaccggtttacggtccggttacggaccgggtaacccggtacccgggtacccggggtaacgggggtaaccccggggggtttacctaacccggggtttaacccgggttaggttacccgggtacccggggg

SEQ ID NO: 121622 - DNA, 676 bp, Homo sapiens
  misc_feature: GYAE6OF02G05W2.41.2.A02.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctnagtgaagctctcctncaagacttctggatacaggttcaacgtacttactatatacctagtgggtcgcgacgaccgggtcccgtggaccgagggactgagtggagtgggagtggactaccgaaccgtaagcggtaggtcgacgacgaagtccctacgtgaccgaacacggtacggtaccgacgggtcgaacgggtacacccgagtcggtaggtggtacgtaccgaccggaccgaacgacgaccgaaccggtccaacgtacgtaaggtaaacccttaccgtaacgtccgtaacgttaacgtacggtacggaaaccgggtaccgtaaccggtttacccgttttaccgtacggtttcgggtacgacccgggtaacccgtcccccgggaggttaacccggggggaccgggggttaacccgttaccgggtttaacccggttaggtaacccggttaacccgggg

SEQ ID NO: 121623 - DNA, 780 bp, Homo sapiens
  misc_feature: GYAE6OF02HNAQL.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagccacaggacgcccactctcaggtgcagctgatgcagtctggggctggaggtgaggacgccgtggggcctcgagtgaacgcctctcctgacaagtacttcgtggatacgtacggttacaacgactttactaatactactacgtcgggtacgcggacgaccggtacccgtagggaccgtacggggtaccttgggtacggttagggtacgttaggggacgtagggacttaacccgtaaacccgtaaggacggttcgggtaacgaaccgaacgtacggtcccttacgtacggaccgtaacgaacgggttaacggggttccgaaccggggtacgacggggttaccaactacggttacgaggttacgggtaccgaaccgtaacccgggaccgtaacggtacgacccgaacggtacccaaccgtacgttaaccggaaacccgtttacacggttaccgttaacggtaacgttaccggtaaggtaacccgggtaccgtaccgggttacccgtttttacggtttaccggtcggttaccggacccgggtaacccgggtaccccggtacggggtaacgggggtaaacccggggggtccttaaccccggggttaacggttcccggttaaccgggtacccggg

SEQ ID NO: 121624 - DNA, 654 bp, Homo sapiens
  misc_feature: GYAE6OF02IGX04.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatgcagtcgtgggctgaggtggaggaacgccgtggggcctcgaggtgagctctctgacaagtcttcgtggatacgtaggttacaacgtacttactaatactacacgtgggtcgacggacacggccctaggaccgaggggtcttaggaggtacggaggtcgggtaagtcggaatacccgaaaccgtaggtacggtggtacgactacgacgtcctacgtcggacacgggtacgtacgggttacggacgggacggtaacggtccgaaccgtgtacgggtagggtacgggtacgaaccgggtaccggacccgtaaccgggacgtacccgaccggtaccaacgtaacgtacggtaaccttacgagtacgtagaacgtcgacggacgtacgtaccggttccgtttaacgttcgtggtcggccgaccgtaccggaggtccggggaccgggtccgtacggtcggtccgtaggtacccggg

SEQ ID NO: 121625 - DNA, 1189 bp, Homo sapiens
  misc_feature: GYAE6OF02HYL5J.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggagcccacgtctcagggtgcagctgatcgcagtcgtggggctggaggtgaggaagccgtggggccttcgaggtgaagctccgtcctgcaagtcttgtaggataacgaggttacaacgtcttctaatatacacgtgggtgccggacgacggtccccgtaggaccggtaacgggtacgttacgggtaggttacgggtacggtagggggacgtaggtaaccttaccggtaaaaaccccgttaagggtaagggttacggggttaacgtaacccggtaaacccggtaaccggtaacccccggtttcgtaacccgggtaacccgtaaacccggttaacgggggtaacccgggggttttaaccccggggtaaacgggggggaaccccggttaaacggggggggttaccccctaaaacccggggtaaacgggtttaaaccgggggttaaaccgggggtttaaccgggggttaacccggggaaaacccccgggtttaaccccggggggaaaaacccccccccgggggtaaaacgggggtttaaacccccccgggggaaaaccccggggtttaaaaccccccgggggggtttaaacccccccggtaaaaaccccgggtttaaaccggggttttaaaaaccccccgggggttttaaaaaaccccccggggttttaaaccccccggggtttttaaaaccggggttttacccccgggtttaaaaaaccgggggggtttttaaaaaccccggggtttttacccccggggtttaaaaaaaccggggggggttaaaacccccggggggttaaaaacccccggggttttaaaccccccgggggggtttttaaccccccggggttttttttaacccccccggggttttaaacccggggtttttttttaccccccggggtttaaaccgggggggtttaaaacccccccgggggggttaaccccccggggtttaaaaaccccccccgggggggggttaacccccccgggggtttaacccccgggggggggggggtttttaaaaaccccc

SEQ ID NO: 121626 - DNA, 847 bp, Homo sapiens
  misc_feature: GYAE6OF02GTY27.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcacgccacaggagcccactctcaggtgcagctgatgcgagtcgtgggctggaggtggaggaacgccgtcggggcctcgagtgaacgtcctctcctgaccaaggtactttcgtaggtactactacggttacgaaccgtacttactaacgtaattaccgagtcggggtacgaccgacgaccggccccgtagggaaccggtacgggtacgttcggtagggtacgggaggttaggggaacgttagggtaactaaccggtaaacccgttaaagggtacgggttacgggtacgaaaccgtaccggtaacgtcccgttacgtccggaccgtaaaccggtaacgggtaccggggtttaccggaaccgggggtacggtaaccgggggtaccctaacccggtaaaggttcgggtaacggggtttccggggtaacggtaacccgggaacccggggaacccgtaacgggtaacccggtaccggtaacccgggtacccgtaaccggtacggttaaaccgggaaacccttttacccggaacgttaccggtaaggttaaccgtcggtaacgggaaccggtaaccgtacccgggtttaccgttttacgttccgggtttagtaccgggtaaccggacccggtaccccgggtcggttaaccggggggaccggggtacccgttacccgggtacgggttacccgtacgggtacccggg

SEQ ID NO: 121627 - DNA, 659 bp, Homo sapiens
  misc_feature: GYAE6OF02HKE1W.41.2.A02.1.454.CMB.1.raw
  modified_base (505)..(505): a, c, t, g, unknown or other
  misc_feature (505)..(505): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctagatgcagtctggggctgaggtgaggagccgtgggcctcgagtgagctctactgacaagtacctcgtggaatacgtaggttaccaaacgtaccttctaattaactaaccgaccggttggggtacgaccgaacgtaccgggtcccctaggggaaccgagggtacttaggaggtggagtcgggatagggactaccaaacccgtaaggtagtacgggtacaacgtaccacgccttacgacgacgaacgtaggtacgtccgagggacgtaacgggtacaaacgtagtcggtaaggttcgggtacgaaccgccgggaaccaccgggaacnccgtaaccggctaacgtcgtaacgtaacctccggaatccgagtaactcgaacgtacggtaacttccggttacgtttcttcggtagggcgaacccggtacccgcccggaggttccgggggaacccgggctttaaccggaccggttgaccggtcgg

SEQ ID NO: 121628 - DNA, 717 bp, Homo sapiens
  misc_feature: GYAE6OF02JVEGF.41.2.A02.1.454.CMB.1.raw
tcagtctatactatcacgaccggtgctcgatttagactcatctacagggggagcatcacccagcaaccacatctcgtcctctagagagtcccctgagagctccgttcctcaccatggactggacctggaggatcctcttcttggtggcagcagccacgaggacgcccactctcaggtgcagctgatgcagtcgtggggctaggaggtgaggaacgccgtggggcctcgagtggaagtccgtctccgtgactaacgtccttcgtaggtacttaaccgtagggttaccaaaccggttctttataacttaactaccgtacggttcgggtacgaccggaaccgaccgggtcccccgtagggaaccgtagggtaccgtttaggaaggttagggaggtagggtacgtaggaccgttaacccgaaaccggtaaggtacggtacgggtacgaacgtaactacggtccctacgtaccgtacgaacgggtaacggtaccggtttaccgggaacggtaccggtacgggttaccaaacggttcggtaaggtaggttcgggaacgaccggaccggaccgtacggacgacgtaccgaccagtactacggtaacctacgcgtacacggtacgcgtaaggcgtaccgtccgttccgttactcggtcgtacgtaccggaccgtcccggtaggacccggggtaccggtacctacgggtacgtccgaggtaccggg

SEQ ID NO: 121629 - DNA, 618 bp, Homo sapiens
  misc_feature: GYAE6OF02H8SJC.41.2.A02.1.454.CMB.1.raw
  modified_base (84)..(84): a, c, t, g, unknown or other
  misc_feature (84)..(84): n is a, c, g, or t
tcagtctatactatcacgaccggtgctcgatttagactcatctacagggggagcatcacccagcaaccacatctgtcctctagngagtcccctgagagctccgttcctcaccatcggactggacctggaggatcctcttcgttggtggcagcagccacgaggacgcccactctcgaggtcgcagctagatgctagtcgtggggctggaggtggaggacgccgtggggcctgaggtgacgtctcgtctgacacgtattcgtagatacgtggtacacgtcttatagtatacgtccgtgggcacgacgcggccctaggacgaggtctggagtgggaactggggaatcggtaactaccgtaaacgtaggtcggtacggtacacgagtccgtctcggtacgacgtacgtaacggtacggtcggacgggtacgacggggtccaacgtgtaggaggttacggacggacggaccgccgaagacggccgtacgaccacgtagtaccgtaactctagtcgagtacgtcggtacacggtaccgttacgttcctttcgtgtcggtaccggacggtaccggccggtagggtcggggaaccggtccgtaaccggtcgtacggtaggtccggg

SEQ ID NO: 121630 - DNA, 746 bp, Homo sapiens
  misc_feature: GYAE6OF02ID5ER.41.2.A02.1.454.CMB.1.raw
  modified_base (633)..(633): a, c, t, g, unknown or other
  misc_feature (633)..(633): n is a, c, g, or t
  modified_base (674)..(674): a, c, t, g, unknown or other
  misc_feature (674)..(674): n is a, c, g, or t
tcagtctatactatcacgaccggtgctcgatttagactcatctacgaggggagcatcacccagcaaccacatctgtcctctagagagtcccctgagagctccgttctcaccatggactggacctggaggatcctcttcttggtggcagcaggccacaggagccctactcctcgagggttgccagctgactggacgagtccgtgggggtctggagggttcgaggaacgccgtggggccttcgacgtggaagtccttccgtcctcggtcaaacggtcctttccgaggtaactacgtacggtttaccgaaaccttacttcgtataacgtctaaccgtgggtagcgtaaccacgggtcccctaggaccgagggtacttacggaggttggagtcgggtaatcgggtaactccgaaacccggtttaaggaggttacggtacgtaacgaaccgtaggtcccttaacgtcgggaccctaagggaacggttacggtttcccgaaaggggtcgaacggggttaccaaccgaggttaccggaggttaggggtaccaaacggtaccgggaacccgaaggcgggacccttagggaacccaacgttacgtacggtaaaaccgttctaaaggtccctaaaggttacgngttaacggaccggttaccgacggtttccgtttaacttccgngtcggtaccgaacccgtcccggtaggaacgggggtcccgggtacttacccggacgtttccggagttcccggg

SEQ ID NO: 121631 - DNA, 603 bp, Homo sapiens
  misc_feature: GYAE6OF02IKTPE.41.2.A02.1.454.CMB.1.raw
  modified_base (261)..(261): a, c, t, g, unknown or other
  misc_feature (261)..(261): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctctttcttggtggcagcagccacgaggacgcccactctcaggtgcagctgatgcagtcgtgggctggaggtggaggaacggccgtcggggcctcgaggtagacgctcctcctgacaacgtacttcgnggtataacgtacggttacaacgtacttactaatactacacgtgggtcgcgacgcggtcccgtaggacgtaggtattggagtaggagtggagtaggactaccgaaaccgtagtaggtggtacgacacgacgtcctctgacgtacgacgtacggtccggagggtacgtacgggtccaaccgtagtacggtaggttacgggtacgaccggaccggtaccgaacggacgaccgaccgtacagtacgacgtactacngtntagngtcgaggacgactcggttcctttagtcgtgtcgacgtaccggccgtggtaccggggaccggtctacggtacgtcgtaggtcgg

SEQ ID NO: 121632 - DNA, 777 bp, Homo sapiens
  misc_feature: GYAE6OF02FZQ4K.41.2.A02.1.454.CMB.1.raw
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (484)..(484): a, c, t, g, unknown or other
  misc_feature (484)..(484): n is a, c, g, or t
tcagtctatactatcacgaccggtgctcgatttagactcatctacagggggagcatcacccagcaaccacatctgtcctctagagagtcccctgagagctccgttcctcaccatggactggacctgggagatcctcttcttggtggcgacgacgcaccacggacgcccgacctctccgtaggtcggcgacgacgtgtagtgtcgacgttcgtgggtcggtcgtaggtaggtacggaaacggccgttccggggtcggtacctaggtacggtaacgtccgttccgtaccgttcggtacgtaacgtacctttacggttgggtacttaacgttaacggtttaccgtaaaccacggttttacttataacgttaacaccgttacggggtggaccgtacgaacggtcccccgcgtacgacgggtattacgngagggtctaggggatgaagtcaacctaacggtagngttcggacaccgagtccagtcgacngtaagacggttccgacgggacgacggttaccgactaacgtagtcggtacgttcgaacggtacccgcggtaaaccggtagccggtaaccggtactactaacgggtagtaacccggttaaacgtcttaaccggtcttaaagggttccgaacggtccggtaaacgtacccggtttcccgtttacttacggttcggtaccggttacggaccccggttaccccgggaacgttacgggggggaacccggggttaaccgttaccggttaacccggttacgggacggttacgtacccgggg

SEQ ID NO: 121633 - DNA, 768 bp, Homo sapiens
  misc_feature: GYAE6OF02FXBMK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgtgggctgaggtgaggacgcgtcgggcctcagtagacgctctccgtgactagacttgtagtatacgtagtacaacgtacttactataacacgtacggtcggtcgacgtaccgcggtcccgaggacgtacggtacgttaggagtaggtaggtaggtagtacggtacctaacgtaaaccggtaggtacggtacggtacgaacgtaccgtcgtaccgtcgtaacgaccggtaacggtacgggttaccggtaccggacggtaaccggtaacgtacccgtacggtacggtaagggtaccgggttaacgaacccgggtaacccggaacccgggtaaccggaaccggacccgtaaccgggtaacccgtaacgtaacccggttaacggttaaaccgtaaccgttacgtaacgttacggtaacgggtacgttaacggacggtaacccgtttacggttacccgtttacgttcggttaccggtcggtaaccggccccgggtaacccgggtaaccggttacggggtacccggggttaaccggttaaccgggttaccggtaaccggttaccgggtacggttacccggggg

SEQ ID NO: 121634 - DNA, 697 bp, Homo sapiens
  misc_feature: GYAE6OF02HP9UA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagccgtggggcctcgagtgaagctctcctgcaagtacttcgtggatacgaggttcaacgtacttctatactacacgtgggtgcgacgacggcccctggacgagggacttggaggtggagtgggatggaatccaaaccgtaaggacggtggtacgacacgtacgcccttgacgtaccgaacgtacgggtacgggtttacccgaagggggtaccgacgggggttaccaaccgtaggttacgggagggttacgggtacggaacccgtaaccggggacccgtaacgggacggtacccgaccgggtaccctaacgtacggtaacggtaacccgttacccgtaagttaccgttacgtaacgttcggtacggtaaccggacgttacccgggttccgttttaccgttcggtacggttcgaccggacccggtaccccggagggtaccgggggtaccgggggtacccttaaccgggtaccgggtaccgtagggtaccggg

SEQ ID NO: 121635 - DNA, 752 bp, Homo sapiens
  misc_feature: GYAE6OF02GR9H3.41.2.A02.1.454.CMB.1.raw
tcagtctatactatcacgaccggtgctcgatttagactcatctacagggggagcatcacccagcaaccacatctgtcctctaccccgagagtcccctgagagctccgttcctcaccatggactggacctgggaggatcctcttcttggtggcagcagccacaggagccccactctcaggtgcagctgatgcagtcgtgggctgaggtgaggaagccgtgggcctcgagtgaagcctctccgtgcaagacttctggatacgagttcaacgtcttctatactacacgtgggtcgcgacgcggtccctggacgtagggtaccttggaacggttggagttagggagtcggaacttacccgaaacccgttaaggtacgtagggtacgaaccgtacgaccggtaccttccgtacggacctaacgtaacggtacgggttaccgaacggggtccgaaacggggtcccaaccggtaacgttacggtacgggttacgggtcggaaaccgtaccgggtaacccgaaccggtaacggacccggaacccgggtacccaacgaacgttacggtaaacccgtttaaccgacggtccttaacggaacggttaccgtacggtaacggaacccgtaccggggttacccgttttacgtttaccgtacgggtccggtaaccgggtaaccggaccccccggtacgggttaccgggggacccggggggttacccttaaccgggttacccgggttaccgtaccgggtaacccggg

SEQ ID NO: 121636 - DNA, 798 bp, Homo sapiens
  misc_feature: GYAE6OF02FKR7P.41.2.A02.1.454.CMB.1.raw
tcagtctatactatcacgaccggtgctcgatttagactcatctacagggggagcatcacccagcaaccacatctgtcctctagagagtcccctgagagctaccgttcctcaccatggactggacctggaggatcctcttcttggtggcagcagccacaggagcccactctcaggtgcagctgatgcagtctggggctgacggtgagacgccgtggggccctcagtggaacgcctccttcctggccaaggtacctttcgtgggactaccgtagggttccaaacgtaccttacacgttactaacgacgttgggttcacggtaccaggtcccctgggaccaggggtaccttagaaccggttgggtaactggggacttcgggtaacttccgaaaaccccggttaaggacgggttacggggttacaacccgacgtaccggacccgttttccgacgggaccctaacggtaacggtaacgggtttccccggaaaggggcccgtaacggggttaccaaacccgtagttacggtaacgggttgggtaccgtaaccggaacccgggttccacggaaacggcccgtaaccccgggttacaacccggtaagttaccgggtaaaccctttaacccgacggttacccgtaagggtaacggttaccgtaaaggggtaaccgtaacccggtacccgggtttacccgtttaccgttaccggttacggttcggaaccccgtacgggtacccccgacgggttacggggacccggggggtccctaacccgggtaccggttaccgtacgggtacccggg

SEQ ID NO: 121637 - DNA, 651 bp, Homo sapiens
  misc_feature: GYAE6OF02FVCNV.41.2.A02.1.454.CMB.1.raw
  modified_base (359)..(359): a, c, t, g, unknown or other
  misc_feature (359)..(359): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctcgagtgaagcctctccgtgacaagtacttcgtaggactacgacggttcaacggtacttctattactactacgtgggtgcgactacggcccgtggactagggacttaggagtcggagttgggatggactaccaaccgtaaggnggtaggtcgacgtacgacgtcctcgtgaccacgtaggtacgtccgagggcgagggtaccacgtagtggtaggtcgggtacgacgtaccggaccacgacgccgaaccggtccacgtacgtacggtaacttcccgtagttccgacggtaacgttctacggaacggaccgtaccgggttccgtttaccgttcgttcgggtacggtaccggtacccggtcccccgggtacggttaccggggggaacccgggggtcccgttaacccgggtaccggttaccggtacgggttacccggg

SEQ ID NO: 121638 - DNA, 782 bp, Homo sapiens
  misc_feature: GYAE6OF02I21QG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggacgcccactctcgaggtgcagctgatgcagtcgtgggctggaggtggaggagccgtggggccctgtagagacgtcgtcctcgacgacgtagttacgtcgagtacgtaacggtacgtacgaacgttcttacttaataactacgtacggtggtcgacggaccgtccgtccggaggacggtacgtcgtaggtacggtaggtggtaggagtacgtaacgtaaccgtaacgtaaggaggtacgtaacgacgacggtactccgttagaccgtacgtaacgtacggttaccggtaacgggtacggaacgggtaaccgtccgaaaccggttaggttacgggtacgggttaacggaccggaacccgggacgtaaacccgggaccgaacggtaacccggtaccggaacctaaaggttaccgtaaaacccgttaccgttaccgtaacggtaccgtaaacgttccgggttaagaccggtaaccgggtacccggttaaccgtttttcccggttaacgttccggtaacgggtttcccgaaccggggttaccccggaaccgggttccggggaaaccgggggttccccggggtaacgttaccgggtaacccggtttacgggaccgttacccgggggg

SEQ ID NO: 121639 - DNA, 616 bp, Homo sapiens
  misc_feature: GYAE6OF02IQYB0.41.2.A02.1.454.CMB.1.raw
  modified_base (351)..(351): a, c, t, g, unknown or other
  misc_feature (351)..(351): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgagctcgtcctgcaagtcttcgtaggatacgtaggttacaacgtacttctatatacacgttggtgcgacgacggccctggacgagggtacttggagtggagtgggatggactcaacctagagtgtanacgacagcctgcgcaacgaggtcgtacgacgggtcgacgggtacaccgtagtacgaaggttggtacgacgaccggtaccgacggacgaccgaaccgtacacgtacgtacgtaaccgttacgacgtacgtacgaacgtcgtaggacgtaccgtaccggttaccgtttacgttcggtacgttacgaccggacccggtaccccggtacggtacggggacccgggggttacctaacccgggttaccggttaccgtacggttaacccggg

SEQ ID NO: 121640 - DNA, 769 bp, Homo sapiens
  misc_feature: GYAE6OF02G0I1Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccagaggacgcccactctcaggtcgcagctgatcgcgtagtcgtggggctggaggtggaggaacgcgttgggcctcgagtgaacgctcgtcctgcaagtacttcgtggatacgtacgttacaaccggtacttctactaactataacccccggtggggttcgaccggaccgacggccccgtaggaaccggaagggtacgttacgggaaggttacgggacggtaggggagtacgggtactaaccgaaacccgtaaagggtacgttacgggtacgaacgaacgtaaccgtccgttccgtacggacctacggaacggttacgggttaccggaacgggtcggaaacggggtcctaaaccgtagttacgggtaggtcggggtaacggtaaccgaaccggttacgaccggaacgtccggaacccggtacctaccgaacgttaaccgggtaaacttaccgtaacgggtacgttaccggaagttccggtacgaacgggtaccgtaaccggttacccggttttacgttcggtacgttaccggtaccggacccggtacccggtcggacgggggtaacccgggggtacccggtaccggttaacccgggtacggtaccggtacccgggg

SEQ ID NO: 121641 - DNA, 653 bp, Homo sapiens
  misc_feature: GYAE6OF02F3DDP.41.2.A02.1.454.CMB.1.raw
  modified_base (235)..(235): a, c, t, g, unknown or other
  misc_feature (235)..(235): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggagggtgaggaagccgtggggcctcgagtgaacgctcncctgcagacttcgtggatacgagttcaacgtacttactatatacacgtgggtcgacgacgaccggccccgtagggaccagggtacttggagtggagtgggatggactacgaaccgtagacgtggtcgacacgacgcctctagcacgagacggttccgaggcgaggtacgacagtggaggtggtacgaccgacggaccacgacggcgaccggtaccacggtacgtacggtaaaccgttaccgacgttacgtacgtaacgttacgtacggaacggtaaccgaaccgggtttacccgtttttaaccgttccggttaggttacggtacggtaacccggtacccccggtacggggttaccgggggtaacccggggggttacccgtacgggtttacccggggttaccgtaacgggttacccggg

SEQ ID NO: 121642 - DNA, 707 bp, Homo sapiens
  misc_feature: GYAE6OF02FGYP7.41.2.A02.1.454.CMB.1.raw
  modified_base (652)..(652): a, c, t, g, unknown or other
  misc_feature (652)..(652): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctggaggtgaggacggccgtggggcctcgagtgaacgtctccgtcctgactaagtaccttctggtaatacgtacggttacaacgtacttctactataccgtacgtgggtagccgaccgtacggccccgtaggtacggacgggtaccgtaggagtacggtagtagggataggtacctacgaacccgtaaggtacggttaggtacgaaacgtacgaccgtccgttacgtacgaccaacgtaaggtaccggttacccggagggcgtaacggggtacctaacgtcgttagggtacggttcgggtaaccggacggtaaccgggacccgaaggttaccgaccggtacccggtacctaacggacgttaccgtaaacgttaccgagtaccgtaacgtacgttcgtaggaccgtacgtaccgtttaccgttactcggtaacggtcggacccgaccgtaccccggngggtaaccgggggtcccgggtacttaccgggtacccggttagtaccggtaccggg

SEQ ID NO: 121643 - DNA, 604 bp, Homo sapiens
  misc_feature: GYAE6OF02JJBR9.41.2.A02.1.454.CMB.1.raw
  modified_base (219)..(219): a, c, t, g, unknown or other
  misc_feature (219)..(219): n is a, c, g, or t
  modified_base (281)..(281): a, c, t, g, unknown or other
  misc_feature (281)..(281): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctnagtgaacgctctcctgcaagacttctggatacaggttcaacgacttctatatacactgggtncgacaggccctggacagggacttgagtggatgggatggatcaaccgtaagagtggtgacacgtacgcctactcgcacgagacggttaccgagggcgagggtaccaccagtacgaggtggtacgaccgacggaccgacggacgccgaccgtccacgtagtacggtaaccgttaaccgacgttcgtaggtaacgtcgtacggaacggtacgaccgggttaccgttttacgttccgttacggttcgaccggtaacggtaccccggtcggtaaccggggaccggggggtacccttacgggttaccggttacgtacggttacccgggg

SEQ ID NO: 121644 - DNA, 525 bp, Homo sapiens
  misc_feature: GYAE6OF02GTGS7.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctcgtgcacagacggttccgagggcagggtcaccgatgagtggtgacgacggccgacgagcgacggtccacgacgtacggaacttaccgagtcgtagaagtctgagacgacggtccgtttacgtcgtgtcgcgacgacccgcgtcgggaccgggggcctacggtacggtcgtaggtacgg

SEQ ID NO: 121645 - DNA, 611 bp, Homo sapiens
  misc_feature: GYAE6OF02GM7XH.41.2.A02.1.454.CMB.1.raw
  modified_base (334)..(334): a, c, t, g, unknown or other
  misc_feature (334)..(334): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaacgccgtggggcctcgagtgaagctctcctgcaagacttcgtggtatacgaggttacaacgtacttcgtatactacgactggggtacgcgacgacggccccgtgggagtacgggacttgaggtggngtagggagtggacgtacaaaccctaaggacggtggtagacacagtcctctgctaacgagtacggttcgacgggacgtacgggtacacgtagtcggtaggtgggtacgacgacgggaccacgggacgaccgaccggtaccaacgtagtaccggtaaccttaccgacgtacgtacgaacgttacgtggaacgacgtacggttccgttacgttcgtgtacggccgaccgtacccgcggtacgggtaccgggggtcctacggtacggtccgtagtaccggg

SEQ ID NO: 121646 - DNA, 634 bp, Homo sapiens
  misc_feature: GYAE6OF02JQNQ0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtcgggctggaggtagaggagccgtggggcctacgagtagaagtctctctgacagtacttcgaggtatacgacggttcaacgtacttctatactacgacgtggtacgacgtacgaccggtcccgtaggacggacggtacgttgaggtacggagtggatcggtactaccgaacctaaggtagtcggtagactacgtacgtctcgcacgacgaaggtacggtcggaacggcgtacgggtactaccgaggttacgacgggttcgacgaccggaccgacggtaccgacgacctaccggacctacgtacgtacgttaacctaccgtcgttacgtacggtaagtccgtaggaacggtactaccgggttctttacggtcgtggtacgaccggtaccggaccgtcgggtaccggggaccgggtcctacggttccggtactaccgggttccgg

SEQ ID NO: 121647 - DNA, 904 bp, Homo sapiens
  misc_feature: GYAE6OF02JIQHB.41.2.A02.1.454.CMB.1.raw
tcagtctatactatcacgaccggtgctcgatttagactcatctacaggggagcatcacccagcaaccacatctgtcctctagagagtcccctgagagctccgttctcaccatggactggacctggacggatcctcttcttggtggctagcagccacaggacgcccactctcacggtgcagcttgatgctacgtcgtcgggactggaggtcgaggtaacgccgttggggcccttacgaggttcgaacggtccttacgtcccgtagtaccgtaaacgtaaccgtttccgtaggtacgttaacgtacgggtttaccgtaaaccggtacctttaccgttaagttaacttaaccggtaaaccgttcggggtaccgttcggaaccgtaccgggtaccccctagggaacccgtaaggggttaaccttaggtacggttacggaacggttagggtaacgtcggaacgttacccgaaaacccggttaagtaacggttcgggtacgtaacgacgtacggtccgttacgtcggtaccgtacgaacggttaccggttacggtaccgggtaacggtacggggttaccccaaccggttacgttcgggacgtttacgggtaaacccggtaccggtaaccgggaccccgtttaaacgggacccggtacccgttaacccgggttcccgtaaaccgtaacggttaacccggttaaaccctttaaccccgaaggtttaccgttaaccggtaacgttaccgttaacggtaacccgggacggtttaaccccgggtttacccggttttaccgttacggtaacgggtttaccgtaaccgggtaacccgtacccccggtttaagggtacccgggggtaacccgggggtcccctttaacgggttacccggttactaccggggttacccgg

SEQ ID NO: 121648 - DNA, 642 bp, Homo sapiens
  misc_feature: GYAE6OF02HHZ08.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagcctgggcctcagtgagctctctgcaagtactctgatacaggttcaacgtacttactatactactcgtgggtgcgacgcggccctaggacgaggtacgtgaggtcgtagtagggagtggactaccgaaccgtaagtaggtggtagaaccgactacgaccctcgtcgaccgaacgtacgtacggttccgaacggggcgtaacgggtccaacgtagtagacggtggtacgaccgaccggaccgtaccgacgacgacccgtaccgacgtaacgtaccggtaaccttaccgagttactaacggtaacgttcgaaggtacgaccggttaccgttacccgttttaccgtcggtggttaccgacggtacccgtacccccgggtggtacccgggggaaccggggtccccgttaacggtaccggttacgacggttacccgggg

SEQ ID NO: 121649 - DNA, 763 bp, Homo sapiens
  misc_feature: GYAE6OF02GCPS3.41.2.A02.1.454.CMB.1.raw
  modified_base (158)..(158): a, c, t, g, unknown or other
  misc_feature (158)..(158): n is a, c, g, or t
  modified_base (201)..(201): a, c, t, g, unknown or other
  misc_feature (201)..(201): n is a, c, g, or t
  modified_base (333)..(333): a, c, t, g, unknown or other
  misc_feature (333)..(333): n is a, c, g, or t
tcagtctatactatcacgaccggtgctcgatttagactcatctacagggggagcatcacccagcaaccacatctgtcctctagagagtcccctgagagctccgttcctcaccatcggactggacctggaggatcctcttcttggtggcagcagccacnggacgcccactctcaggtgcagctgatgctagtcgtgggctgnggtgaggacgccgtgggctcgagtgaacgctcgtcctgacaagtcttctggactacgtaggtaccaacgcttcgataactaccgacgttggggtcacgtacgaccggtcccgtaggaacgcgggtactcggngtaggtacggtggtagtcggtactaccgtaaaccgtaggcggtagtacacgtagaccgtccgttacgacgtaccgaacgtacggtaccgggttcggaacgggtccgtaagggtaccctaaaccggtaggttacgggtaagggttacgggaaccggtacccgggaccggtaacccggtaaccggtaccggaaccgggtaaccccggtactaaacccgggtacgttaaaccgggtaccctttaacccggtaaacgtcggttaaccgggaacgtttacggaaccggtacggtaaaccgtcccggtttaccggttttaccgttccggttacggtaaccggacccggttacccgggtaaccccggtggggttaacccgggtaacccgggggttacccttaccgggtaccccgggttacgtaccggttaccccggg

SEQ ID NO: 121650 - DNA, 678 bp, Homo sapiens
  misc_feature: GYAE6OF02IYGFS.41.2.A02.1.454.CMB.1.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggagcccactctcaggtgcagctgatgcagtcgtggggctgaggtgaggagccgtggggcctcgagtgaagctctcctgcaagactttcgnggatacgaggttacaacgtacttactataactacgtacgttaggggtnccggaaccgacgggcccctagggaccagggtacttaggagtggagtgggatggactaccgaaaccgtaaggagtggtagacacgacgcctctacgaccaacgaggtacggttaccgaacgggcgaacgggtaccaaccgtagtggacgttggtaccgaacgccggtaaccgaccggacgaccgaccgtacccaacgtacgtaacgtaacccgttaccgtaagtctaaggtacgttaccgtacggaacggtaccgtaccgggttccgttttaccttaccggtacggttacgaccggtaacccggtaccccggtagggttaaccgggggtaacccggggggtacccttaaccgggtaaccggttaccgtacgggtaacccggg

SEQ ID NO: 121651 - DNA, 745 bp, Homo sapiens
  misc_feature: GYAE6OF02JMPKW.41.2.A02.1.454.CMB.1.raw
  modified_base (711)..(711): a, c, t, g, unknown or other
  misc_feature (711)..(711): n is a, c, g, or t
tcagtctatactatcacgaccggtgctcgatttagactcatctacagggggagcatcaccagctaaccacgatctgtcctctagagacgtccctgagagctccgttcctcaccagtggactcggacctggtaggactccgtcttacttcggtaggacgtaagcgaagtacctaacgtaggacgcccaactcacgaacggtacgacacgtactcgatcgtacctacgtcgtggggtaccttaggtaggttacggaacgggtaacggcccgttaggggtcccgtacgtaggtacgtaacgggtcgtaccgtccggtaggaccgtaacgtacgtttacgtacggtaacttaccgttaacgttacgaaccggttacttacgtaatacgtacgtaccggtaggtacgtacgtacgtaccggaccctaggacgtacgtacgttacgtagtacggagtacggtagtacggactaccgtaaccgttaacgacggtacgtagacgtaaccgacgtccgtacgtaggacgtacgtacggtaacggtggaacggtccggtaagggtcccaaccgtaacggtcgtaacgggtcgtaaccgtaccggaccgtaccgtaccggcgttacccgacgttacaacgtcgtaacggtaccttacggacgtacgttagaacgttcgacggacgtaccgtgttcctacgtggcgtacggacgtccgacggngtacggggtcgcgttaaccgggtctagtcccggg

SEQ ID NO: 121652 - DNA, 857 bp, Homo sapiens
  misc_feature: GYAE6OF02I9QA4.41.2.A02.1.454.CMB.1.raw
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagtctatactatcacgaccggtgctcgatttagactcatctacagggggagcatcacccagcaaccacactctgtcctctaagagacgtcccctgagagctccgttacctcaccatggactggacctggagatcctcttcttggtggccaggcagccacgagggtcgccctagtcctcgaggtcgacagtctaggatcgcgtagtcggtcgggacttgggacggtagaggacgtccggttacgggcctacgaggtagtaacgtccttccgttccgngtacgaaacgttccgttggnggtaactacgtaacggtttaccaaaaccggttctttacttaaagtaccgttaaaccgtacgggtttcggggtaccgaaccggtaacccgtacccggggtaccccgtaaggggaaccggtaaaggggttccgttttacgggagggttaagggtaggtagggtaggtaacggtaacttaaccccggaaaaccggtttagggtaggttacggtacgaaaccgtacggacgttacccgtagtaccggaaccgtacgtaagggttacccggtacgggtacggacggtaaccgggtaccgtaaccgtacgtagggtacggtacgggtaccgaacggtaccgggtaccgacgaccggaccgtaccgggaaccctaggtaacgtaacggtaacccgttaccgaacgttacgtaaccgtacggtaacgacgggtaaccgacccggtaccggttaccggtttaccttccggtggtacccggtaccggtaaccccggtccggtaaccggggtacggggtaacccgggggtacccttacgggtacccggttaccggtaccggtacccgggg

SEQ ID NO: 121653 - DNA, 646 bp, Homo sapiens
  misc_feature: GYAE6OF02GAONA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctctgcaagcttctgatacagttcaacgtacttctatatacacgtggtgcgacacggccctggacgagggacttgagtggagtgggatggactacgaacccgtaaggagtgggtagaccacacgtcctcgtacgcacgagacggttccgagggcgacgggtacaccagtacggaggtggtacgaccgacggacccgaggacgccgacggtaccacgtagtacggtaaaccttaccgagttcgacgtaacggtacgtacggagggtaacccgtaccgggttcccgttttaccgttccggttaggtaccggtaccggtaacccggtacccccggttaccgggtaccgggggggaacccgggggggttaccccgttaaccgggtacccggggtttaccggtaaccggttaccccggggg

SEQ ID NO: 121654 - DNA, 551 bp, Homo sapiens
  misc_feature: GYAE6OF02H0203.41.2.A02.1.454.CMB.1.raw
  modified_base (355)..(355): a, c, t, g, unknown or other
  misc_feature (355)..(355): n is a, c, g, or t
  modified_base (466)..(466): a, c, t, g, unknown or other
  misc_feature (466)..(466): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcagtgaagctctcctgcaagcttctgatacaggttcaacgacttctatatacagtggtgcgacaggcccctggacagggacttgagtggatgggatggtaactacaacccgtaaggagttggtagacgacagcctgngacacgagtacggttccgagggcgagggtcacatgagtggagacgacggccacggagccgacgtccacgatacggtaacctaccgagtacctgtaagtccgtaggacgganaccggtacgtttactcgtgtcggcgaccggtacccgcggtacggggaccgggggtaccctacgtaccggttcgtacggtaccggg

SEQ ID NO: 121655 - DNA, 738 bp, Homo sapiens
  misc_feature: GYAE6OF02F9RV9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggaagccgtggggcctcgagtgaagctctccgtgacaagtaccttcgtaggatacgaggttccaacggtacttctaatactacacgtggggtcgtcgacaccgggcccgtacgggacgacgggacgttggaggtaggacggtgggtagtagggtaactaccaaacccgttaaggtaggtagggttacgaacgacgacgtaccctgtccggacgtaaccgaagggttacgggtttacccgaagggggtaccgtacgggggtaccaacccgtaaggtacggtagggttagggtacgaacccggaccgggaccgtacgacggaccgtaaccggtacccaacgtacgtaaccgggtaacctaccggtacgttacgtacggaacgtttcgaggtaaccgggaacgtacccgggttaccgttttaccgttacggttcggttaccggaccgtacccgggacccgttacggggttacccggggggaaccggggggttacccgttaccggtaaccgggttacccgtaacggttacccgggg

SEQ ID NO: 121656 - DNA, 624 bp, Homo sapiens
  misc_feature: GYAE6OF02I19L2.41.2.A02.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaggagccgtggggcctcagtgagctctccngcaacgtacttcgngatacgtaggttcaaacgtacttactatatactacgtgggtgcgacacggccccgtaggacgaggacgtgaggtggagtggatggactaccgaaacctagagtggtacgacgacgacgcctcgtacgacgaacgtacggtacggtaccgacgggtacgtacgggtaccaaccgtagtacggagggttcggtacgacccgtaccggacccgtacggacgccgaacggtccaagtacgtaccggtaacctccgtagtcgtaggtacgttagacggtaacgacgtaccggttaccgttttactcggtcgtacggcgtaacccggtccggtacggtaccgggggaccgggtcctacggttcggtacggttacgtaccggg

SEQ ID NO: 121657 - DNA, 784 bp, Homo sapiens
  misc_feature: GYAE6OF02HJ14O.41.2.A02.1.454.CMB.1.raw
  modified_base (293)..(293): a, c, t, g, unknown or other
  misc_feature (293)..(293): n is a, c, g, or t
  modified_base (681)..(681): a, c, t, g, unknown or other
  misc_feature (681)..(681): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacagggacgcccactcctcgaggtgcagctggatgactaggtcgtgggggacttggagggtaggaagggaacgtcccggtggggacctcgtaaggtaggaacggtccttccgtaccgtagacctaaagttcctttacgnggtaactaccgtaggttaccgaacgttaccttacttaattaactaaccgtacggtggggtccgacctaacggtccggtacccccgttagggacggacgggttacgttaggtaacggttgggagtcggggtatacggtaaccgtaacccgtaaaaccggtaaggtagggttacggtacgaacccgtacggaaccgtccttacggtcgaaccgacgtaacgggtaccggttaccggcggggtaacggtacccgggttaaccaaccgtagtacgggtaggttacgggtaaccggacccggaccggaccccggaagtacccggtaacccaaccggggtacccacgttaagtacgggtaaacccttaccgaggtacgttacgaacggtttacngggaaccctacggtcccgttacgtttactcggttcgccggacgtaacccggacccggtaggtacccgggggaccggtactaccggtacggtcgtaccgacggg

SEQ ID NO: 121658 - DNA, 641 bp, Homo sapiens
  misc_feature: GYAE6OF02FYYCC.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacactgggtgcgacacggccctggacagggacttgagtggatgggatgggactaccaaccgtaaggcgtaggtgacacaggtcctctcgacaccgaaggtacggttccgaggggccgaagggtaccaaccgagtggacggttagggtacgaccgaccgggaccgacggacggaccgaacgggtcccaacgtacgtacgggtaaaccttaccgagttccgtagtaacgttctaggtaacggaaccgtaccggttaccgttttaacgttcgttcggtacggtaccggtaacccggtaacccccggtcggttaacggggggaaccgggggggttccctaaccgggtaaccgggtacgttaacggtacccgggg

SEQ ID NO: 121659 - DNA, 750 bp, Homo sapiens
  misc_feature: GYAE6OF02IG3WW.41.2.A02.1.454.CMB.1.raw
tcagtctatactatcacgaccggtgctcgatttagactcatctacagggggagcatcacccagcaaccacatctgtcctctagagagtccctgagagctccgttctcaccatggactggacctggaggatcctcttcttggtggcagcagccacaggacgcccactctcaggtcgcagctgatgcagtcgtgggctggagtggaggacgcgtggggcctcgagtgaacgtctctcctgactaagtcttcgtaggatacgacggttacaacgtacttactaatacttaacgcgttagggtcgaccgacgaaccggtcccgtaggaccggagggtacttaggaggtacggattcggggatagggactaaccgtaaaccgaaggtaggtacgggtacgaaccgacgacggtacctacgtcggaccgacgtacggtaacggttccgaaggggcgtaaaccgggtccaaacggtagtacgggttaacgtacggggactaaccggaccggaacccgtaacggaccggtacccgtacgggaacccagttacggaacccggttaaacttccccgaaaggttacccgtacgtaaacgttccgtaaacggtaaccgggtaacccgttaccggttaccgttttacgttcggttaacggtaccggtacccggaaaccgtcccccgggttaacggggtacggggggtaaaccccggggttccttaaacccggggtacgttcccggtaaccgggttacccgggg

SEQ ID NO: 121660 - DNA, 686 bp, Homo sapiens
  misc_feature: GYAE6OF02FPNOP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggaacgccgtggggcctcgagtagaagctctccgtgacaagtacttgtaggactacgtaggttacaaccgtacttactactactaccgtaggtgggtcgacgtacgccggtcccgtaggacgtagggtacttggaggttggagtcgggaagtaggtactaaccgaaaccgtaagaggtggacgacgacgacggtcctacgtgaccgaacgtacgtacgggtcccggaagggtaccggtacggggtccaaccgagggtacgggtacggttcggggaaccggaaccgtaacccgggaccgaaccggggtacgaaccccgggttaccgggtaacctaaccgggtaacggttaccgggtaaaccctttaccggagtttacgtaggtaacgttcggtacgtacgggaccgtccgttacgtttctcgtggcggaccgaccggccggtggtcgggggacccggtccgtagaccggcgttggacccgg

SEQ ID NO: 121661 - DNA, 787 bp, Homo sapiens
  misc_feature: GYAE6OF02H31LU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggacgcccactctcaggtgcagctgatgcagtcgtgggctggaggtgaggagccgtggggcctcgagtagacgctccgtctgacaagtcttcgtaggattacgaggttacaacggtaccttcttatactacaccgtggggtacacgaacgcggtacccctaggacggtaacggggtacttagggaagttggaaggtggggtaacgtaggaacttaccgaaacccggttaagggtacggttacgggttacgaacgaaaccgtcggtacccgtttcgtacgaccgaacggtaagggttaccgggtttaaccggacgggggtaccggttacggggtaccgtaacccgtaagtacgggtaaggttgggtaaccgaaccggacccggttacccggtaacggaccggtaaccggtaccggtaacccgaacgttaacgggtaaccggttaaaccgttaacccgtaggttaaccgtaacgggttaaacgttcggtaacggaaccggttaaccgtacccggtttaccgttttaccgttccggtaacgttaccggaccggtaacccgacccgggtacgggtaccgggggtaacccgggggtaccttaaccgggttaacggtccggttaacggtacccgggg

SEQ ID NO: 121662 - DNA, 781 bp, Homo sapiens
  misc_feature: GYAE6OF02HIWCA.41.2.A02.1.454.CMB.1.raw
  modified_base (205)..(205): a, c, t, g, unknown or other
  misc_feature (205)..(205): n is a, c, g, or t
tcagtctatactatcacgaccggtgctcgatttagactcatctacagggggagcatcacccagcaaccacatctgtcctctagagagtcccctgagagctccgttcctcacctatggactggacctggaggatcctcttcttggtggcagcagcccacgaggagcccactctacaggtgcgagctgatgcagtcgtgggctaggnggtagaggtacgccgtcggggcctcgagtaggaacgtctcctccgtgacaacgtacttcgtaggacgttactacggttacaaccgtacttacctaattaactactacggttcggggtacgtacggaaccggtaccggcccgtacgggaccgtaaggggtccgttaggtaggtagggtaggttaggggagttcgggaacgtacccgtaaaacccggtaaggtagggttacggtaggaaccgacgacgttcccgtaccttgacccgtaagacggttacggttacccggaggggtaccgtacgggtaccacgtacgtagggtacggtagggtacgaacccggccggtaaccgaaccggtaggtcccgtaacccgggtacccaacggttaaccggttaaccggtaacccgttaaccgtaccggttacgtaacggttacgttaccggaacggtacggtaaccgtcgtacgttaccggttttaacgtcgtcggttacggtaaccggtacccggtacccggacggggttacggggtaacccggggtaccggttaacccggttaccggtaccgttaacccgggg

SEQ ID NO: 121663 - DNA, 811 bp, Homo sapiens
  misc_feature: GYAE6OF02GCG6Q.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcaggtcgtgggctgaggtgaggacgccgtggggcctcgagtgaagctcctcctgacaagtacttcgtggtatacgtaggttacaacgtacttatatactacgacgtgggtcgccgacgaccggcccgtgggaccgtaggggtacttggaggtggagtgggagttaggacgttaccaaacccgtaaggtacggttagggtacgaacgaccgtacgtacccgtcgtccggactaaccggtacgggtacgggttacccggagggtaccgggtacgggtacccaaccgtaggttagggtacgggtacgggtacggtaaccccgggacccgggtaacccgaaccggggaaccggtacccggtaaacccgggtacccgaaaccgttaacgggttaaacccggttaaaacccgttacccggttaacgggtaccttaacgggtaaccgttacggttaaacggaaccgggttaaccgtacccgggttttaccccgttttacgttcgggtttcgggtaccggtaccccgggtaacccggtacccccggggtgggttaaccccgggggggggtacccgggggtttacccttaacccggggttacgggtttacccggtaacgggtttaaccccggggg

SEQ ID NO: 121664 - DNA, 670 bp, Homo sapiens
  misc_feature: GYAE6OF02H43DY.41.2.A02.1.454.CMB.1.raw
  modified_base (265)..(265): a, c, t, g, unknown or other
  misc_feature (265)..(265): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (510)..(510): a, c, t, g, unknown or other
  misc_feature (510)..(510): n is a, c, g, or t
tcagtctatactatcacgaccggtgctcgatttagactcatctacagggggagcatcacccagcaaccacatctgtcctctagagagtcccctgagagctccgttcctcacatggactggacctggaggatcctcttcgttgggtggcaggcagcccacagggacgccccactctcgaggtgaccagctgatcgacgtagtcggtcgggggattggagggtggagggaacgccggtcggggccttacgagtgacgtctcctcggngacaagtaccttgtagacgtacgtacggttacaacgttaccttatactaacttacgacggtggtcgaccggacggtaccggccctggaccggtacgggtnttcgggnggtaggtagcgggtanaggtactacgaacgtagcgtagccagacncgtctcncgacgagtacggcggtacgaggcggacgacgtccgaagtggtagcggtacgaccggcgacgacggaccgtacgggacctacccganacggttacgttaaccgtacgtaccgtgaacggttccggagtaccggaagttacccggtaccgtttaggtttacccctttggccgtccggtaaccgcccggtacccggtcgggtacggggtcccgggtaaccttacggggtacttacggaggtacccgggg

SEQ ID NO: 121665 - DNA, 676 bp, Homo sapiens
  misc_feature: GYAE6OF02G4RAT.41.2.A02.1.454.CMB.1.raw
  modified_base (155)..(155): a, c, t, g, unknown or other
  misc_feature (155)..(155): n is a, c, g, or t
  modified_base (251)..(251): a, c, t, g, unknown or other
  misc_feature (251)..(251): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagccanaggagcccactctcaggtgcagctgatgcagtcgtggggctgaggtgaggaacgccgtggggcctcgagtgaacgtctctcctgacaagtctttgnggacttacgaggttaccaacgtacttactaagtataactacgtggtcgacgtacacggccctaggaccagggtacttggagtggacgtggagtggactaccgaaaccgttaaggacgtggtagacacgtacggtaccctgtcgaccgtaacggtaggtaccgggtacccggtaacgggcgtaacggggtacccaaccgtagttagggacggttacgggtaacgccggtaacccgggccgtaaacggcggtaacccgaccggtaccaaacgtcgtaaccgggtaaaccttcgacgtcgtaagtacgtcgtaggaacgtaaccgtcggtttaccgttcttacggtgtcggaccgggtacccgacccggttacggtacgggggacccggggttacccgttaccggtaccggttcgacggttacccggg

SEQ ID NO: 121666 - DNA, 651 bp, Homo sapiens
  misc_feature: GYAE6OF02G3CS7.41.2.A02.1.454.CMB.1.raw
  modified_base (585)..(585): a, c, t, g, unknown or other
  misc_feature (585)..(585): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctgagtgaagcctctccgtgacaagtacttcgtggaatacaggttacaacgtcttacgtatatacgacgtgggtcgacgtacgacggcccgtaggacggacgggtacttggaggtggagtgggtagtcggtaactacgaaacccgtaaggacggtacgggttgaacaccgagtccctacgtgacgacgaggtaccgggttcgacgggacgtacgggacacgtagtggagtcggtacgacgacgaccgtacggacgcgtacgtaccacgacgttacggaaccttacgacgttacgagtacgttcgtagggtaaccgcgtaccggttcctttaacgttcgttcggacgtaaccgggccggtaccccggngggttaaccggggtaaccgggggtacccgttaaccgggtacggttaccggtacggttaacccgggg

SEQ ID NO: 121667 - DNA, 687 bp, Homo sapiens
  misc_feature: GYAE6OF02H04OW.41.2.A02.1.454.CMB.1.raw
  modified_base (189)..(189): a, c, t, g, unknown or other
  misc_feature (189)..(189): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccaacaggacgcccactctcgaggtgcagctgatgcngtcgtgggctggaggtgaggacgccgtcggggcctcgagtggaacgctctccgtgacaacgtctttcgtaggtataacgtacggttaccaaacgttacttactagttaactacgtacggtcgggtcgaccggaaccgaccggtccccgtagggaccggaaggggttcttaggaggtggaggtgggatggaactaccgaaccgtaaggtagtggtacgacgacgtcgtcctgtacgacacggtaaggtacggttaccggaggggtaccgtacgggtactaccggtaggttacggaggtcgggtacgaaccggaccgtaccggaacggcgaaccgtaccggtaccaacgtagtaccgtaaccttaccgtagtacgtagtaacgttcggacgaacggtaccgtaccggttacgttttacgtcggtaaggtaccgccggtaacgaccccggtggggtaccggggaccggggtcgttaaccgggcgtacggtaccggtacggg

SEQ ID NO: 121668 - DNA, 638 bp, Homo sapiens
  misc_feature: GYAE6OF02JS7S0.41.2.A02.1.454.CMB.1.raw
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (289)..(289): a, c, t, g, unknown or other
  misc_feature (289)..(289): n is a, c, g, or t
  modified_base (506)..(506): a, c, t, g, unknown or other
  misc_feature (506)..(506): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcgaggtncagctgatgcagtcgtgggctggaggtgaggacgccgtggggcctnagtgagtctctcctgacaagtacttgtaggatacgacgttacaacgtacttctatatacacgttggngtcgacgcggacccaggacgaggcttaggagtaggagtgggataggactacgtaaccgtagaggtacggtagaccgacgtacgcctcgtacgacacgtaaggtaccggtacgagggtaccgacgggtacaaccgtagtacggtggtacggtacgacgaccggaccgaaggaccgaccgaccgtacgacgtagtacggtaacccttacgacgttacgnggttaacgtcgtaacggtacggaccgttaccggttaccgtttacgtcgtaggtaccggaccgaaccggtacccgtgggttaacccggggacggggttacctacgggtaccggttacgtaccggttacccggg

SEQ ID NO: 121669 - DNA, 653 bp, Homo sapiens
  misc_feature: GYAE6OF02G705J.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctcgagtgagctctccgtgacaagtacttctggactacgtaggttacaacgtacttctatactactacgtgggtcgcgacgacggcccgtggaccgtagggtacttgagtgggagtgggatggaactaccgaaaccgtaagtacggtagtacgacacgacgtacctcgtagaccaacgacggtacggttaccgagggtccgtagggtccaacgtagtaggtaggtcggtacgacggacggaccgacgacgccgacggtaccaacgtagtacggtaaaccttacggtagttcgtaaggtaccgttcgtaggaacgtaaccgtaccgggttacccttttacgttcgtcggtaccgtaccggtaccggtaccccggtagggtacccggggggaaccggggttaccttaacccgggttaccggtacgtaaccggtacccggg

SEQ ID NO: 121670 - DNA, 703 bp, Homo sapiens
  misc_feature: GYAE6OF02IGCUF.41.2.A02.1.454.CMB.1.raw
tcagtctatactatcacgaccggtgctcgatttagactcatctacagggggagcatcacccagcaaccacatctgtcctctagagagtcccctgagagctccgttcctccaccatggactggacctggaggatcctcttcttggtggcagcagccacaggagcccactctcaggtgcagctgatgcagtctggggctgaggtgaggaagccgtggggcctcagtagaagtctctcctagcaaagcttcgtggactacgaggttcaacgtacttcgtaatatacacgtgggtgtacgacgacggccccgtaggacgagggtacttgagtcggtagtgggtataggataccgtaaaccgtaaggaggtacggtacgaacgaacgtacgtccctacgtcgaccaacgtaacgtacggtttaccggaacggggtacgacggggtaaccaaccgtaacggtaggtaacgggttacgggtaccggaaaccgtaaccgggtaacccgaacgggaacggtacccgtaaaccggggttaccaaaccggtacgttaaccgggtaaaccttaaccgaacggttacgttaacggtaacggttacgtaggtaacggtacgtaaccggttaccgtttaacgttcgtaggtcgaccggtaacgtacccgtaggtaccggggaaccggggtccgtaccggtacggtcgtaggtaccggg

SEQ ID NO: 121671 - DNA, 618 bp, Homo sapiens
  misc_feature: GYAE6OF02HNO4N.41.2.A02.1.454.CMB.1.raw
  modified_base (178)..(178): a, c, t, g, unknown or other
  misc_feature (178)..(178): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (515)..(515): a, c, t, g, unknown or other
  misc_feature (515)..(515): n is a, c, g, or t
tcagtctatactatcacgaccggtgctcgatttagactcatctacgagggggagcatcacccagcaaccacatctgtcctctagagagtcccctgagagctccgttcctcaccatggactggacctggaggactcctcttcgttggtggcagcagccacaggagcccactctcaggtncagctgatgcagtcgtggggctgaggtgaggacgtccgtagggcctcgagtgagctctcctgcaagtacttcaggtatacgaggttcaacgtacttactataactacgacgttgggtgacgtacgacggcccctaggaccagggtacttggacgttgggaatgggagtaggactacaaccgtaaggagtcggtanacacgtagcctntcgactagacgacggttaccgagggtacacgggtacacgagtacggagtacggtagaacgtccggacgtacggacgtccgaaccgtaccgatacgtacggtaacctaccgaacgtcgtaacggagttcgngtaacggacgtaccggtccgtttaacgtcgtaggtccggacgtaccgtacccggtcgtacggggaaccggggtccttaacggaccggtacgtacggtacccgg

SEQ ID NO: 121672 - DNA, 573 bp, Homo sapiens
  misc_feature: GYAE6OF02JF8W5.41.2.A02.1.454.CMB.1.raw
  modified_base (156)..(156): a, c, t, g, unknown or other
  misc_feature (156)..(156): n is a, c, g, or t
  modified_base (357)..(357): a, c, t, g, unknown or other
  misc_feature (357)..(357): n is a, c, g, or t
  modified_base (529)..(529): a, c, t, g, unknown or other
  misc_feature (529)..(529): n is a, c, g, or t
tcagtctatactatcacgaccggtgctcgatttagactcatctacagggggagcatcacccagcaaccacatctgtcctctagagagtcccctgagagctccgttcctcaccatggactggactggaggatcctcttcttggtggcagcagccacnggagcccatctcaggtgcagctgatgcagtctgggctggaggtgaggaagctggggcctcagtgagctctctgcaagacttctggtatacaggttcaacgacttctaatataccacgtgggtgcgacgacggccctggacagggacttggagtggagtgggatggactcaacccgtagagtggtcgacacacgctctgacncgaggtacgttcgagggacacgggttaccacgtaatggtacggtggtcgaacgacgggtaccacggagaccgacggtaccagtacgtcggaacttaccgacgttctacggtaagtccgtaggaacgtacgtacggtacccgtttataccggttggtcggcggacgtacccgnggtacgggacggggtcccaacggttccgggtactaggtaccggg

SEQ ID NO: 121673 - DNA, 862 bp, Homo sapiens
  misc_feature: GYAE6OF02FGZEU.41.2.A02.1.454.CMB.1.raw
  modified_base (146)..(146): a, c, t, g, unknown or other
  misc_feature (146)..(146): n is a, c, g, or t
  modified_base (195)..(195): a, c, t, g, unknown or other
  misc_feature (195)..(195): n is a, c, g, or t
tcagtctatactatcacgaccggtgctcgatttagactcatctacagggggagcatcacccagcaaccacatctgtcctctagagagtcccctgagagctccgttcctcaccagtggactggacctggaggatcctcttcgttggngcagcagccacgaggacgcccactctcaggtgcagctgatgcaggtcgnggggtctggacggtgacggacgtccggtcgggcctgagtcggacgtcctccgtccgtagtaaccgaacgtaccttcgtcggtacgtacgttacggtacctaaccgtactttacctacgttaactacgtaccgggtggtacgaccgtacggtacccggtacccggtaggaacggtaccggggtacgttacgggaagggttccgggtaaggtaggggtaacggttacggtaaccgttaacccgaaacccgttagggtaaccgggttacgggtaaaccgtaaccgtaaccgaccggttacccgtttaccggaccggtaacgtaaccgtaacgggttaccggggttaacccggtaacggggtacccgtaacccggggtaaccctaaccgggttacggtacgggttaacgggttaccgggtaaaccggaacccggaccgggtaaccggaacggaccgttaacccggcggtaaacccgtacggaacggtttaccggaaccgttacggacgttacggttaacgtacggtaacgtaacgggtaccgttaaccgggttccgttttaccgtacgttcggtaacggtccggtaacccggccggttacccggtccggggtaaaccgggggttcccggtaccggttacggtaacccgggttacgtaacggttacccgggg

SEQ ID NO: 121674 - DNA, 707 bp, Homo sapiens
  misc_feature: GYAE6OF02FTP4Q.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcagtgaagctctcctgcaagacttctggatacgaggttacaacgtcttactatatacactgggtgcgacgacggccccgtggacgtagggacttggaggtcggagtgggacgtggaactaccgaaacccgtaaggtaggttagggtacgaacgtaaccgacgtacccgttacgtcggacgtaaccgtaggtaccggtttacccgaggggacctacggggtaccacccgtaagtacgggtaggttacgggtacgaaccgtaccgggtaccgaacggtacggacccgtaaccgggtacccgtaaccgtaacggttaacgggtaaacctttaaccccggtagttacccgtaaggtaaccgttacgtaggtaacgggtaccgtaccgggttaccgttttacttccggttggtacggtaccggaccgtaccccggagggtaccggggaccgggggtacccttacggtaccggttacgtacggttacccggg

SEQ ID NO: 121675 - DNA, 678 bp, Homo sapiens
  misc_feature: GYAE6OF02IF0UG.41.2.A02.1.454.CMB.1.raw
  modified_base (115)..(115): a, c, t, g, unknown or other
  misc_feature (115)..(115): n is a, c, g, or t
  modified_base (145)..(145): a, c, t, g, unknown or other
  misc_feature (145)..(145): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (548)..(548): a, c, t, g, unknown or other
  misc_feature (548)..(548): n is a, c, g, or t
  modified_base (575)..(575): a, c, t, g, unknown or other
  misc_feature (575)..(575): n is a, c, g, or t
  modified_base (582)..(582): a, c, t, g, unknown or other
  misc_feature (582)..(582): n is a, c, g, or t
tcagtctatactatcacgaccggtgctcgatttagactcatctacgagggggagcatcacccagcaaccacatctgtcctctagagagtcccctgagagctccgttcctcaccanggactggacctggaggatcctcttcttggngcagcgagccaacaggacgcccactctcnggtncagctgatcgcacgtcgtgggcttggagggtcggagaacggtccgtgggggaccctcgtagtgaacgtcctccgtccgtagtccaaacgtacttacgtggtaacgtacgaaggttaccaacgtaccttatataactaaccgacgttagggcgtacgacgtaccggcccgtaggacggacgggtacctaggacggtaggaggtgggtacgtggtactaaccgaacccgtaaaggtacggtaggtagaactaaacgtcgaccgtctacgggcctaacggtacggttaggtacccgacggggtacgacggtccaaccgacgtagaggtacggtacgaacccgaccggtacacggcgaccgaccggtcgaaacngtacgtaacctcgaagtcgaacgtacncggttanaacggtcaacggttccgttactcctgggtacgaccggaacgtccccgtacggcggggtaaccggggaccttacgggtaccgttcggtaaggtccgg

SEQ ID NO: 121676 - DNA, 708 bp, Homo sapiens
  misc_feature: GYAE6OF02FUXS3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagccccacgtctcaggtgcagctgatgcagtcgtgggctggaggtgaggagccgtgggcctgagtgaagcctctcctgacaagtcttcgaggtactacgtaggttaccaacgtacttactatactactacgttgggtcgaccgtacgaccggccccgtggaacgagggtacttggagtggtagtgggtacgtggactaccgtaaccgtaaggcggtggtacgaacgactacgtccttacgtcgaccgacgtaacggtaccggggttaccgaacggggtcgaacgggttaccgaaccgttacgttagggtacggttcggggtacgaacccggaccgggacccgaacgggaccgtaccgacccggtacctaaaccgtacgggttaacgaaacccgttacggtacgtacgttacggaacgttcgaaggtacgtaccgttaccggttacctttacgtcgttgggtccggtaccgacccggtaccccggtgggtacccgggggtaccggggttaccctaaccggggttaccggtacggtacccggttaccggg

SEQ ID NO: 121677 - DNA, 790 bp, Homo sapiens
  misc_feature: GYAE6OF02FZFRS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctcgagtgaacgctctctgacaagtctcgtggactacgtaggttcaacgtcttactatatactacgtggtacacgtaccgaccggtcccgtaggacgagggtaccttggacggtaggtagtcgggagtcggaacttaccgaaacccgttaaaggtcggtaacggtacgaaccgtaacgtaacgtcccttaggtaccgacccgtaacgtacgggtaacgggtttcccggaaggggtacccggtagggtaacccaaccggttaagtacgggtagggtttccgggtaacacccgggtacccgggaccgaaccgggtaccgtaaccgttaacccgggtacccaaacggtacgggttaacccggtaaaactttcccggaaggtttacccgtaagggttaacgtaccggttaacgggaccggttaacccgtacccgggttttacccgttttctttaccggtacggtaccggtaaccggtaccccgggttaaccccggtacgggggttaccgggggggaaaccccggggttcccttaaccggggttacccggtttaccggtaaccggggttaacccccgggg

SEQ ID NO: 121678 - DNA, 755 bp, Homo sapiens
  misc_feature: GYAE6OF02GR777.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggtaggtgaggagccgtggggcctcgagtgaagctctccgtgcaagtaccttgtaggtatactaggttacaacgtacttctattactacgtacgtgggtacgcggtaccgccgggtaccccgtgggacggaggggtaccttgggacggtagggagtggggagtacggtaacgtaccgtaaacccgtaagggtacggtgggttacgaaccgtaaccgtacggtacccgttacgtacgtacccgtaagtaacgggttaccggggtttacccggaacgggggtacccggtaacggggttccaaacccgttaggtacgggtaaggggttacgggtccgaaccggtacccggggacccgaaccgggtaccgaccggtaacccggtccaaccgtacggttaacgtaaccccttaggtacgtaccgttaggaaccgtcggttaaggaccggtaacgtccggttaccgttttacgttacgtggacccggtccggacccggtacccggtacgggtaccgggggtaaccgggggtccttaccgggttacggtacgtaccggtaccgggg

SEQ ID NO: 121679 - DNA, 657 bp, Homo sapiens
  misc_feature: GYAE6OF02F7Q4F.41.2.A02.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatgcagtcgngggctgaggtgaggagcgtgggcctgngtgagctctccngacagtcttcnggatacgacggttacaacgtacttcatatacgacgtgggtcgcgacgaccggcccgtggaacgagggtacttggacggtggagtaggagtggactaccgaaaccgtaaggacgttgggtacgacgtacgacgtaccctgtcgacgtacgtacggtacgggttaccgagggtaccgacgggtaccctacgagtacggtagggtcggtacgaacccgtccggaccgtaccggacgccgtaccggtacccaacggtcgtaacgtaaccgttaccgacgtacgtacgaacgttcgagggtaccgacgttaccgtccgtttaacgttccggtaggtacgtaccggaaccggtccccggtacgggtacgggggtaacccgggggtaccttaaccgggaccggttaccgtacggtaccgggg

SEQ ID NO: 121680 - DNA, 635 bp, Homo sapiens
  misc_feature: GYAE6OF02G74Q0.41.2.A02.1.454.CMB.1.raw
tcagtctatactatcacgaccggtgctcgatttagactcatctacgagggggagcatccacccagcaaccacatctgtcctctagagagtcccctgagagctccgttcctcaccatggactggacctgggaggatcctctttcttggtggcagcagccacaggagcccactctcaggtgcagctgatgcagtcgtgggctggaggtgaggaacgccgtgggcctcgagtgaagctctcctgacaagtcttcgtggatacaggttacaacgtacttactactatacgacgtggtcgcgacgcggccctaggacggaggtacgtgagtaggagtaggagtggactacgaaccgtaaggaggtacggtacgacacgtacgtcctacgtacgacgaacgtaacggtacggttaccggaacgggcgtacgggacctaacgtagtacggacggttacggacgaacccgaacgggcccgaacggtaccgaccggaaccggtaccactacgtaaccgtaacccttacgaccgtacgtagtagtcggagaccgacgtacggttacctttacgtcgtcgtcgaccgaccgacccggtaggtaccggggacccggggtacgtaccggtccggttagtccgtaccgg

SEQ ID NO: 121681 - DNA, 668 bp, Homo sapiens
  misc_feature: GYAE6OF02HLPAV.41.2.A02.1.454.CMB.1.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggaagccgtggggcctcagtgaagctctcctgcaagacttctggatacgaggttacaacgtacttctatatacacgtgggtgcgacgcggcccctggacgagggtacttaggaggtggagtgggatggatccgaacctaggngtggtagacacngcctgtgaccagacggtacggttaccgagggtcgacgggtaccaccgtagtcggtaaggtcggtacgaccggaccggtaccgacggaccggaccgtaacccgggtaccaacgtacggttacggtaacccgttaccgtacgttaccgtaggtaaccgttcggtaacggtaaccggtacgtacccgggtttaccgtttttaaccgtttcggttacggtacggtacccggtacccggtacccccgggtgggtacccggggggaaccgggggttacccttacgggttacccggttacggttaccggtaccgggg

SEQ ID NO: 121682 - DNA, 839 bp, Homo sapiens
  misc_feature: GYAE6OF02GA9GK.41.2.A02.1.454.CMB.1.raw
  modified_base (161)..(161): a, c, t, g, unknown or other
  misc_feature (161)..(161): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggancccactctcaggtgcagctgatgcagtctgggctggaggtagaggaacgcgtgggcctcagtgaacgcgtctccgtagactaaacgtacttcgtaggaatactacggttacaacgtactttacgtatactaacgtacgtgggttcggaccgtaccgaccgggtcccccgtagggaaccgaggggtacctttaggaggttacggtaggttacggggaattacggggaactaaccccgtaaaccggtaaaggtaacggttacgggtacgaacgtaaaccgaccggtaccttacgtaagaccgtaaccggtaaggtaccgggttacccggaaggggtaccgtaacggggtccctaaacggtacggtacgggaacgtttaggggaaccgtaaaccggacccggaaccggtaacccggaccggtaccgtaaccgtaccgtaaccgaacgtttacccgggtaaaccgtttacccgacggttaaacggttacccgtaaacgggtttccgaaagggccggttaaacccgggaccgggttttaaccccgttttaggtttcccggttaaacgggtcggaaaccccggggttaccccgtaaccccggggtcgggttaaacccgggggggtacccggggttacccggtttaaccgggtaaccccgggtttacggaaccgggttacccggg

SEQ ID NO: 121683 - DNA, 626 bp, Homo sapiens
  misc_feature: GYAE6OF02HG6A8.41.2.A02.1.454.CMB.1.raw
  modified_base (287)..(287): a, c, t, g, unknown or other
  misc_feature (287)..(287): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtggggcctcgagtgagctctcctgcaagtacttcgtggatacgtaggttacaacgtacttctatatacacgtgggtncgacgcggccctaggacgagggtactggagtggagtggatggactaccaaccgtaagaggtggtacgacacgacgtcctgtacgacacgaggtaccggttcgacgggacgtaacgggtccaccgtagtggtaggtgggtacgaccgaccgggaccgacggacgcgtaaccgtaccacgtagtaccggtaacttacgacgttctaggtacgtcgtacggacggtaccgtaccggttaccgttttacttcggtcggttacggccggtaacccggtaccccggtcgggtaccggggggaacccggggttcctaacgggttaccggttacggtacggtccggg

SEQ ID NO: 121684 - DNA, 691 bp, Homo sapiens
  misc_feature: GYAE6OF02IJPS2.41.2.A02.1.454.CMB.1.raw
tcagtctatactatcacgaccggtgctcgatttagactcatctacagggggagcatcacccagcaaccacatctgtcctctagagagtcccctgagagcaccgttcctcaccatggactggacctggaggatcctcttcttggtggcagcagccacaggagcccactctcaggtgcagctgatgcagtcgtgggctgaggtgaggagccgtcggggcctcgagtgaagcctactcctggaccaagtaccttcgtggactacgtaggttacaaaccggtctttactaatactacgtacgtcgggcgtacgacgaccggcccgtaggaaccgtagggtaccttggaggtcgaggtggtagtggactaccgaaaccgtaggtagtaggtacgacgtagacgccttgtacgactaacgtacgtacgggttaccgacgggtacgaacgggtcctaaccgagttagggtacggtaggtacgaccgaccgggtacacgggacggaccgtaaccgtccgaacgtacggtaacggtaaacccttaccgtacgtacgtacgtaacgttcgtacggaacgtaccggtaccggttacccgtttagttccggtggtaccggtaccggtaacccggtcccggtacgggttaccgggggacccgggggttcctaaccgggttaccggtaccggtacggtacccggg

SEQ ID NO: 121685 - DNA, 727 bp, Homo sapiens
  misc_feature: GYAE6OF02GA5J7.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagcccactctcaggtgcagctgatgcagtctggggctggaggtgaggaagccgtggggcctcagtgaagctctcctgacaagtacttcgtggtaactacgtaggttaccaacgtactttactaattactacgacgtgggtgaccgacacggccctaggaccgaggtactgagtggacgtggatggactaccgaaccgtaagacgtggtacaacgtacgacgtcctcgtacgacaacgacgggtacgttcccggaagggtaccgtaacgggtaccctaccgaagttaggtaacggtcgggtacggaaccggaccggaccgaacggcgtaaccgaccgggtacccaagtacgtaacggtaaaccttaccgtaggttacgtacgtaacgttacgtacgggtaaccggtaaccgtaacccgggttttaccgttttaacttaccggttaacggggtaccggtaaccgggttaccccggaacccccggttacggggtaacccgggggggttaaacccggggggttcccgttaaaccccggggtacggttaaccggtaccggggttaacccggg

SEQ ID NO: 121686 - DNA, 634 bp, Homo sapiens
  misc_feature: GYAE6OF02I63HR.41.2.A02.1.454.CMB.1.raw
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagcttcgtggatacgaggttccaacgtcttctaatactacacgtgggtcncgacacggccctaggacngggactgagtggatgggatggacttcgaaacctaaggngtggtanaacacgacgtcctactgacacgacggttacggtccgaagggcgtacgggtacaccgagtaggtacgtggtacgaccgtacggaccgacggacgcgaccggtaccgacgtaacgtacggaaccgttaaccgtacgtacgtacgtaagttccgtacggaacggtacccgtaaccggttccgtttaccgttacgttacggttcgaaccggtaccgtaccccggtacggtaccggggtaaccgggggttccctaaccgggttacggtaccggtacggtaacccggg

SEQ ID NO: 121687 - DNA, 884 bp, Homo sapiens
  misc_feature: GYAE6OF02GVZFT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggactcctcttcttgggtggcagcacgccacgaggacgcccactctcaggtgcagctgatgcaggtcgtcggggcgttggaggtaggaacggaacggtccggtcggggacctacgagtacggaacgtccgttcctccgtcgactaacggtacctttcgtacgggtaactaaccggtacggtttaaccgaaccgttaactttacttaaagttaaccttaaccggtaccggttaggggtaccggaccgtaaacccggtacccggggtaccccgtagggaaccgggtacgggggttaacgttaggggtaccggttaggggacgttaagggggacgttacggaacttaacccgaaaacccgggtaaggtacggttggtaaacggacctaacggtacctcgtccgtacggacaacggtaacgggttacggtccgaacggggcgtaacgggccaacgtaggttacggacggtagggtaccgaacggacccggccgtaaccgggacgtaacccgggtacggacccgtaagttaacccggtaaccggtaaccgtttaccggtacgtaccggttaacggtaaacgttcccggaagtaacccggggacctttacccgggtttactttaacccggtttgtaaccggggtaccggtaacccgggaacccgggtacccccgggtaaggggggttaccccggggggaaccgggggtttccccttaaacggggtttacccgggtttaaccggaccgggtttaccccggggg

SEQ ID NO: 121688 - DNA, 655 bp, Homo sapiens
  misc_feature: GYAE6OF02JEZC0.41.2.A02.1.454.CMB.1.raw
  modified_base (245)..(245): a, c, t, g, unknown or other
  misc_feature (245)..(245): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcgagtgaacgctctctgcagacttcngatcaggttacaagcttactatatacacgtggtgacgtaccgacggtcccctggaccgacgggtacttaggtaggtgggagtaggggattaggactacctaaaccgtaaggagttggtagaacacgcgtacctcgtgacgtagaacggtacggttaccgacgggtacgaagggtacccgaaccgtagtacggtacggttacgggtacgaaccggaccggaccgacgacgtaccgtaccggtaccgaccgtagtaccggtaaccgttaccgacgttacgtacgtaacgtcgacgtaaccggacgtaccggtaccgtttacgttacggtcggtaccgtacggtaccggaccccgtagggtaccggggtaaccgggggtccttaaccggtaccggttcgtaagggtacccggg

SEQ ID NO: 121689 - DNA, 801 bp, Homo sapiens
  misc_feature: GYAE6OF02F3KZ2.41.2.A02.1.454.CMB.1.raw
  modified_base (109)..(109): a, c, t, g, unknown or other
  misc_feature (109)..(109): n is a, c, g, or t
tcagtctatactatcacgaccggtgctcgatttagactcatctacagggggagcatcacccagcaaccacatctgtcctctagagagtcccctgagagctccgttcccnccacagtcgacgtcgacgtgggagtctccttctttcgttggtcgacgacgcacgaccaggacggccgtaccctacttctacggtaggtcgacgacgtccgtgtacgttcggacgtacggtcgggttacgggtcgtaggtacgggtagaacgggtaccgtccggggtaccggtcctagtaacggtagtaagtccccgtttcgccgtagaaccgtaacggttcctttaggcggtaaagtaccggtttaggtaaacccgtaacgttaccgtttacttaaccttaacgtaaccgttcgggttagggtacgaaccgaaccggtacccggtaccccgtaagggtaaccggaacggtttacggtttacggaggtttacgggtagggtacggtaaggttacggtaacctaaaccccgtacggtaaaagtcggttacggacacgtaacgtacgtccttaggccgacgcgtaagttaccgtacggtacgtacggaccggtacgacgtagtacggtaggtcgacggacgtaccggacgacgacgccgttaccgaccgtagaccgtacgacgttacgaagtccgtaagcgtacgacggaacgtacgtccgtttagtaccttggtacgtcggacacccgggtaccggacggttacccggggtccgggtaaccgttaccgggtacggtaccggtaggttacccggg

SEQ ID NO: 121690 - DNA, 569 bp, Homo sapiens
  misc_feature: GYAE6OF02GJCG6.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtgggcctcgagtgaagctctcctgcaagacttctggatacaggttcaacgacttcgtatatacacgtgggtgcgacacggccccgtggacgagggacttgacggtggaagtgggagtggactcaaaccgtaagagtggtcgacacagacctcgtcgcacgagtacggttccgagggctaggggtaccaccgagtgaggtggtcgaccgtacggccacgtacgccgacggtccaactacgtacggaaccttaccgagttacgtagtaacgtctaggaacgacgacggtaccgtttacttcgtcggtcgcgaccggacccgcggtacggggaccggggtcctacgcggttacaggtaccgg

SEQ ID NO: 121691 - DNA, 701 bp, Homo sapiens
  misc_feature: GYAE6OF02IRFLS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggagcccactctacaggtgcagctgatgcagtcgtggggctgaggtgaggacgccgtgggcctcgagtgagctctcctgacaagtaccttgtggtacttacgtaggttaccaaccgtactttctaattaattaaccgtacggtggggttacgaccggaccgacgggtccccgtggaccggtaacggggtaccgttaggaggttggtagtgggacgtgggaactaccgtaaaccgtaaggtacggttcgggaacgtaccgacgtacgccttcgacgaccacgtagtacggtacccgagggtcgagggcctacgtagtcggtaggtcggtaaccgaccgacggaccgacggaccgaccgtaccggtccctaagacggttaacgtaaacccgttaccgtacgttcgtagtaacggtgttacggaacgtaccggtaccgtttaccgtttactttcggtcggttaccggacggtacccgtcccgggtacggtacggggggaacccggggtccctttaacgggacccgggtttacagggtaacccgggg

SEQ ID NO: 121692 - DNA, 765 bp, Homo sapiens
  misc_feature: GYAE6OF02HCFEQ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgaggaacgccgtggggcctcgagtgaagctctcctgcaagacttcgtaggtatacgaggtttaccaaaccggtactttactataataaccacgttggggtcgaccggaccgacgggcccctagggaccgaggggtaccttaggacggtgggtagtggggaatggactaccgaaacccgtaaggaggttaggtagaccgaacgtacgcccttacgtcgaccgaacgtagggtacgggttacccgaggggtccgtaagggtacccaacgtaggttggagggttacgggacgtaaccggaccggtaccgaccgggaacgccggtaaccggtacccgaacgtacgtaaccgggtaaacctttaccgacgttaccgtacggtaacgttacggtaacggtaacggaacccggttaacccgggttaccccggttttacgttacccggtttacggttaccgggtacccggtaacccggtaccccccgggtacgggttaaccgggggggaaccccggggggttacccttaacccggggttaaccgggttcccgtaaccggggttacccggg

SEQ ID NO: 121693 - DNA, 628 bp, Homo sapiens
  misc_feature: GYAE6OF02GDFK0.41.2.A02.1.454.CMB.1.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (259)..(259): a, c, t, g, unknown or other
  misc_feature (259)..(259): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccacaggacgcccactctcgaggtgcgagtctgatgcagtcgngggctgnggtgagganccgtgggcctcgagtgaagctcgtcctgacgaacacttcgtcggtanacgtaggttcaacgtacttctatactacctagtggggtctcgacgacgcccgtaggacgacgggtctggacgtggactgggattcgacttcgaaccttagngtagggtanaactccgatccgtcngccgtacgaggtaccggtcgacgggcgacggggtccaacgagtgaggtaggtacgacgtacggcacggacgttcgaccggtaccagtacgtacggtaacctacgtacgtcgtttacgaagttcccgtggtaacgggaccacggtttaccgttacgtttcgtacgtcgttaccggaccgtccccggtaggtaccgggggtaccggggtacctttaccggacccggtttacggtacgttacccggg

SEQ ID NO: 121694 - DNA, 670 bp, Homo sapiens
  misc_feature: GYAE6OF02GK3FW.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgaagcctctcctgacaagtacttcgtggatacgtaggttacaacgtacttctattatacgacgtgggtcgacgaccgacggcccctggacgagggtacgttggaggtggagtagggagtcggtactacctaaaccgtaagacggtaggtacgacacgacgtcctcgcgacgacgtaggtacgggttccgaggggccgacggggtaccaaccgtagtggacggttggtaccgaccgaccggacccgaacggacggacccggtaaccgtccctaacggacgttaccggaaacccgtttaccgacgttcgtacggtaagtcgtacggaaggaaccgtccggttacgttttaacgtcggtacggttacggccggtaaccggtccccggtacggaccgggggggaccggggttccccgtaacggttaccgggtccgttaacgggtacccgg

SEQ ID NO: 121695 - DNA, 847 bp, Homo sapiens
  misc_feature: GYAE6OF02HRBS6.41.2.A02.1.454.CMB.1.raw
  modified_base (177)..(177): a, c, t, g, unknown or other
  misc_feature (177)..(177): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtncagctgatgcagtcgtgggctggaggtgaggagccgtggggcctcgagtgaacgtctctcctgactaagacttcgaggactacgtaggttaccaacggtacttactaataactacctacggtggggtcaccggacgaccggtccccgtagggaccgacggggtacttagggaggtacgggaggtagggagttacggaacgttacccgaaaccgttaaagggacggttagggtaacgaaccgaacgtaccgtcccgtactacggaccgtacgtaacgggtaccggggtttaccggaacggggtaccggtaacgggttacccgaaaccgtagggttacgggtaagggttacgggtaaccggtaacccggaacccggggtaccccggtaaacgggacccggtaaccgggtaccccggtaaccgtaaccggtaacggttaacccggtttaaacccggttacccgtaaacggttcccggttaacggttaaaccgggttacggtacgggtaaaaccgggtccgggttaccccgggttttacccgtttttaacggttaccgttacgggttccggacccggtaaacccccgggtaccccggtacgggggtaacccgggggtaacccggggggtccccttaacgggttacccgggttaccgtaccgggttaacccgggg

SEQ ID NO: 121696 - DNA, 739 bp, Homo sapiens
  misc_feature: GYAE6OF02HC5VB.41.2.A02.1.454.CMB.1.raw
  modified_base (293)..(293): a, c, t, g, unknown or other
  misc_feature (293)..(293): n is a, c, g, or t
  modified_base (703)..(703): a, c, t, g, unknown or other
  misc_feature (703)..(703): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggagcccactctcaggtgcagctgatgctagtcgtgggctggaggtgaggacgccgtgggcctgagtgaagcctctccgtgctaagtcttcgtggactacgtagttacacgtacttcgtatactacacgttgggtcncgacgaccggtcccgaggacgacgggtactaggaggtcggtagtgggatcggactaccgaaccgtagacggttagtcgaacgtaccgaacgtcccgtacgacggtacgaacgtaacgggtaccgggttaacccgaggggggtaacccgtaaccggggtttaaccaccccggtttaaaggtcggttaacggggttcggggaccggttaaacccggccgggtaaaccccgtaaccggtaccgggacccgtaaacgggttaccccgacgttaaccgggtaccgttaaacccctacggtaagttacccggtagtaaacgtccgtaaggaacccggtaacgttcccgggttactttaccgttcggtggttccggacccgtacggaccccgtggggtaacgggggtaaccccggtnttaaacccggggcttaccggtaaggttcccccgggg

SEQ ID NO: 121697 - DNA, 695 bp, Homo sapiens
  misc_feature: GYAE6OF02IY3PY.41.2.A02.1.454.CMB.1.raw
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (380)..(380): a, c, t, g, unknown or other
  misc_feature (380)..(380): n is a, c, g, or t
  modified_base (482)..(482): a, c, t, g, unknown or other
  misc_feature (482)..(482): n is a, c, g, or t
  modified_base (589)..(589): a, c, t, g, unknown or other
  misc_feature (589)..(589): n is a, c, g, or t
tcagtctatactatcacgaccggtgctcgatttagactcatctacagggggagcatcacccagcaaccacatctgtcctctagagagtccctgagagctccgttcctcaccatggactggacctgggaggatcctcttcttggtggcgagcagccacgaggacgcccactctcaggtgcagctgatgcagtcgnggggctggaggtggaggacgccgtggggcctgagtgagctctcgngcaagtacttcgtggatacgtacggttacgaacgttacgttactataatacctaacggtggttcggacgacgacggtcccgtacggacgagggtaccttggacggttggaagtggggataggactaccgtaaccgtaaggnggtaggcgaatacgacggtcctggacgcaacgacgtacggcgaacggggcagggaaccctgaacggttggaagcgggtaggtaccgacgggaccgaaccggnggaccgtacgggtaacccgacgaacggttacgaacccgttaaccgacgttaaccgcggttaacgtacgtacgggtaagggtaaaccccgtcgggtcccgttttttanccggtttggttcggaacccggtaccgggtacccgtacggggtaaccggggggaaccggggttacccggttaacgttacccggggtaccgtacgggttaacccgggg

SEQ ID NO: 121698 - DNA, 726 bp, Homo sapiens
  misc_feature: GYAE6OF02HU3GJ.41.2.A02.1.454.CMB.1.raw
  modified_base (157)..(157): a, c, t, g, unknown or other
  misc_feature (157)..(157): n is a, c, g, or t
  modified_base (410)..(410): a, c, t, g, unknown or other
  misc_feature (410)..(410): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccanaggacgcccacctctcgaggtgacaggctagatgccagtcggtggggctggaggtggaggaacggccggtggggcctcgaggtagaacgtcctcctcgtagacctaagtacttcgtaggactacggaggttaccaaccgtactttactaatatacgtacggtgggagccgacgtaccggccctagggacgaggtcttaggacgtaggagtgggatcggactaccgaacgtaagcggtaggacaacgaacgtcnccttgacaccgaacgtaggtaccgggttaccggaagggtaccggtaacgggtacctacgggtaggttagggtacggcggtacggacccgacgggaaccctaggaccgtaccgaacggtaccaaagttacgtaaccggtaaccctgtacgtactaaggtacggtacgagggtaacgtacccggttaccggtttccgtttaacgtcggttaacggtaccggacccggtaccgggtaccccggtacgggggtaaaccggggggaccccggggttacccgttaaccgggtaacccgggttaccgtaggggtaccccgggg

SEQ ID NO: 121699 - DNA, 651 bp, Homo sapiens
  misc_feature: GYAE6OF02JM6P0.41.2.A02.1.454.CMB.1.raw
  modified_base (192)..(192): a, c, t, g, unknown or other
  misc_feature (192)..(192): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
tcagtctatactatcacgaccggtgctcgatttagactcatctacaggggagcatcacccagcaaccacatctgtcctctagagagtcccctgagagctccgttctcaccatgactggacctggagactcctcttcgttggtggacagcgagccacgaggacgcccactctcgaggtcgcgagctgagtgcngtcgtgggctaggacggtagaaggacgtccgtcgggcctcgagtagacgctctcgtcggactaagtcttcgaggtactaacgnggttaccaacgtnttactatactacgtacggtcggtacgaccgaacggtacccggtcccgtaggaaccgtacggggttattacgggaggtcgggtaggtacgggtntacggtacctacgtaaaccgtaaggcggtacgtacaccgacgtacgcccttagcgaccgtaagacggttacgtcgacggnggtacgcgacgtgtagnggtcgacgccggacgcaacggtcgacgtacgcacgtagtaccgtaccaggtcacgtcgtaatcgacggaacgtcgtaaccggtttccttaaggtcgtcgggtacaccgggtaacccgtccgggtacgtacggggggaccgttacttaacggtcgggttacgaccggtttccgg

SEQ ID NO: 121700 - DNA, 723 bp, Homo sapiens
  misc_feature: GYAE6OF02JJHUJ.41.2.A02.1.454.CMB.1.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (290)..(290): a, c, t, g, unknown or other
  misc_feature (290)..(290): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcgaggtgcagctgatgcagtcgtgggctgaggtgaggacgccgnggggcctcgagtagagtctctccgtgacaagtcttcgnggatacgagttcaacgtcttactatatacagtgggancgacgcggtccccgtgggaaccgtagggtacgtttggaggtggtaggtgggacgtggactaaccgaaacccgtaagggacggtttacggtacgaaccgacgtacgtcccttacgtaccgacgtaccgtaagggtacggttaccgagggggtacctaacgggtaccgaaacctagggtaggtacgggttacggggtaaccaacccggtcccgggaaccgaaccggtaacggcccgaaacccgggttccaacggttaacgtaacgggtaacccttaacggtagggttaccgtaacggtaacgttcgtaacggtaaccggacccgtaccgtttccgtttactggtacggtaccggtcggtaacccgcccggtaaggggtaacccgggggtaccgggtaacccttaacggtaccgggttacgtacccggtaaccggg

SEQ ID NO: 121701 - DNA, 668 bp, Homo sapiens
  misc_feature: GYAE6OF02I2TA2.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccacaggacgcccactctcaggtgcagctgatgcagtccgtgggctggaggtggaggaacgccggtcggggcctcgagtgaagtcctacgtcctgacacgtaccttcgtggaactacgtaggttacaacgtacttactatatactagtgggtcgccgacgaccggcccgtaggacggaacggggtacttaggtaggtagggtacggagggtagtaggtacctaccgtaaaccgtaaggtaggtgggtacaacgacgacgtacctcgtacgacaaccgaggtacggtaccggagggtcggacggtacgaccgtaggtagtacggtacgggtacgaccggacggtaccgacgtacgccgtaccggaccacgtacgtaaccgtaacgttacgtacgtacgtagtacgtacgtagaccggaccgtcggttaccgtttcgtacgtcggtaccgtacggtacccgccggtaccggtacggggtaaccgggtccggtaacgtcggttacggacggtaccggg

SEQ ID NO: 121702 - DNA, 787 bp, Homo sapiens
  misc_feature: GYAE6OF02GPULZ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgacaagtacttcgaggatacgaggttacaacgtacttctatactactacgtgggtgccgacgacggtccccgtaggacgagggtacttaggacggtagggagtaggggacgtacggactaccgaaaacccggttaaggacggttacgggtacgtaaccgaacggtaccgttcccttacggtaacggtaccgaaaccggtaacgggttaaccgggtttaccccgggaaggggtcccggttaaccgggggtaccctaacccggtagtacggggtaacgggttcggggtaaccggaacccggaacccgggtacccgaaccggaccggaccggtaccggtaccaaccgtacggtaaccggtaaccgttaccgacgggttactaacggtaacgttccggtacggaacgggtaccgtaaccggggtttaccgttttaccgttccgggttaacggtaccgggtaccgtaaccccgggtaccccgggtacgggttaaccggggggaaccccgggggttacttaaccccggggtacggttaccggtacggtacccgggg

SEQ ID NO: 121703 - DNA, 657 bp, Homo sapiens
  misc_feature: GYAE6OF02F4R6I.41.2.A02.1.454.CMB.1.raw
  modified_base (219)..(219): a, c, t, g, unknown or other
  misc_feature (219)..(219): n is a, c, g, or t
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctnagtgaagctctctgacaagtacttnggactacgaggttcaacgtcttctatatacacgtgggtancgacacggcccctaggacgagggtaccttggagtgggagtgggatacggactaccgaaaccgttaaggagtacgggtacaacacgagccctctacgaccacgacggtacgggttaccgaagggtccgacgggttaccaaccgtagtagaaggttgggacgaccgaccggtcaacggcgacgacgggtaccaagacgtagaacccttacgacggtactacggaagttccgtaggtaacgggaccgtaacgggtttcccttacgtttacgtaccgggtacggtaccccgggtacggacccccggttagggacccggggggtaaacccggggttccttaacccgggttaccggttacggtaaccggttaaccgggg

SEQ ID NO: 121704 - DNA, 707 bp, Homo sapiens
  misc_feature: GYAE6OF02IIAEU.41.2.A02.1.454.CMB.1.raw
  modified_base (157)..(157): a, c, t, g, unknown or other
  misc_feature (157)..(157): n is a, c, g, or t
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
  modified_base (232)..(232): a, c, t, g, unknown or other
  misc_feature (232)..(232): n is a, c, g, or t
  modified_base (402)..(402): a, c, t, g, unknown or other
  misc_feature (402)..(402): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccanaggancccactctcaggtncagctgatgcagtcgtgggctggaggtgaggacgccgtcgggctcagtgacgctcncctgacaacgtcttcgtagtacgtacgaggttccgaacgtacttacgtataacttaacgaccgttcggggtacgaccggtaacgaccgggtccccgtagaacgagggtaacgttcggaggttcgggagtgggacgtggacctacgaaccgtaaggcgttaggacgacacncgtcctcgcgaccacggtggaccgttacgagggaccgtacgggtaccacgtaagtggacggtcgggtacgaacccgacggccgaacgacggtccgaccggtaccaacgtacgtaccggttaaaccttccgaaaggtcgtaacggtacgttccgtaaagggtacccggaacgtttacccgggtttaccttttacgtcgggtaaccggtccggtaccggtaacccggttacccgacggggtttaccggggggaaccggggtttacccctaccggggtttaccggttacccgtaccgggtaacccggg

SEQ ID NO: 121705 - DNA, 833 bp, Homo sapiens
  misc_feature: GYAE6OF02HFBMT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatgactcggacctggaggatcctcttctggtggcagcagccacgaggacgcccactcctcgaggtgcagtcgtgagtcgacgtacgtcggtggggctcggaggtaggacgggaacggtcccgtaggggcccttaccggagtacggaacgccgttaccttaccgtacgacctaaacgtaccgtttacgtacgggaacttaaccggtaccggtttacgaaacccgttaaccgtttaccttaacttaacgttaaccgttacggttaggggtaccgtaccggtaaccgaaccgggtccccgttagggaccggtaaacggggttccgttagggaagggttacgggaaggttacggggtaacgttaggaaccggtttaaccaaaacccggttaagggtacggttacgggtacgaaaccgtacggttacccggcgttaccgtacgggaccgaaccgtaagggttacccggttaaccggaccgggtacggtaacgggtactaccggagttggacggttcggacggaccgtaccggaccgagaccggactcccggtacgtaaccgaagttacgtaaccgtactacggtaacgtacgttagaccggtacgtagggacccgttaaccggtttaccgtttcgttacggtcggtaccggtaccgtaaccggacccggtgggtacggggaacccggggttcaacccgggtttacgtacccggacggttacccggg

SEQ ID NO: 121706 - DNA, 635 bp, Homo sapiens
  misc_feature: GYAE6OF02HGSNH.41.2.A02.1.454.CMB.1.raw
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggancccactctcaggtncagctgatgcagtcgtggggctggaggtggaggagccgtggggcctcgagtgaacgctctcctgacaacgcttcgtggactacaggttcaacgtacttctagtatacacgtgggtagccgtacgaccggcccgtggaacgacgggtacttacggaggttcggagtcgggatgggactaccgtaaaccctaaggacggttaggacgacacgacgtccttcgacgaccacgaggtaccggttcgtacgggacgtacgggtaccaccgtagtgtagtcgggcgaccgacgggaccacggacgaccgaccgttaccacgtacgtacggtaacctaccgtagttacgtagtacgtcgtaggaccggtacgtaccggttaccgtttaacgttcgtcggtcgaccgtaaccgcccggtacggtaccggggaccggggtacctacggtaccgtacggtacgtaccggg

SEQ ID NO: 121707 - DNA, 717 bp, Homo sapiens
  misc_feature: GYAE6OF02JR89R.41.2.A02.1.454.CMB.1.raw
  modified_base (219)..(219): a, c, t, g, unknown or other
  misc_feature (219)..(219): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcagtgcagctgatgcagtctggggctgaggtgaggaagccgtggggcctnagtcgaagctcgtcctgcagtaacttcgtaggtatacgtacggttacaacggtacttactatacttaacaccgtggggtcgacggaaccacggaccccgttaggaaccgtagggtaaccgtttgggacgttacggtacggtagggacgtaggggtactacgaaacccgttaaggacggtttacgggtacgacgaaacgtacggaccgtttacgtaccgacgaaccgtaaggtaccgggtttaaccggaacgggttaccggaacgggtaccgaacgtacgtaggtaaggtcggttacgacgtaccgggacgtaccggaacgcgaaccggtaccacgtaacgtaggtaacctaccgtagtacgtcgtaaagtccgtaaggacgtaccgtacggtaccgttttacgtcgttacggttacgacggtaacggtacccccgtacggttacgggggtaacccgggggaccgttaacccggtacgggttaccggacgttacccggg

SEQ ID NO: 121708 - DNA, 867 bp, Homo sapiens
  misc_feature: GYAE6OF02GT5DV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccatctcaggtgcagctgatgcagtcgtgggctggtaggtaggaaggacgccgtcggggaccctagaggttagaacgtccttctccgagtaccgaacggtactttcgtacggacgttacgacggtttaccaaacgtacttacgtatactaacgtacgtgggtagaccgacgtacggtccccgtaggaccgacgggtaacgttcgaaggttcgggtaagtcgggtagtacggtaactaaccgtaaacccgttaaggtaggttagggtacgttaaaccgacggtaaccgtacccgtcgtacggtaaccgaacggtaacgggttaacccggttccggggtaaaccgggaccgggtaaccgggtttaacccgaaacccggtaaagggttcgggtaaaggggttaccggggtttaaaccggaacccggacccggggttaacccggtaaccgggaaacggtacccggtaacccgggtaacccgtaaacgtaacccgggttaacgggttaaaccccttaacccggtacgttaaccgtaccggttaaggtaccggttaagggaaacgtaacccggacccgtttacccgttttacggttccgtttaacggtaccggtaccggtaacccggtcccccggtaaggggtaacccgggggttaccggggaccgtttaaaccccggggtcggttacccggtaaccgggttacccgggg

SEQ ID NO: 121709 - DNA, 665 bp, Homo sapiens
  misc_feature: GYAE6OF02I2ZN1.41.2.A02.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgagtgaggacgcgtgggcctcagtgagctctctgacagtctacgtggatacgtagtcaacgtactctatatacacgtggtncgacgacggcccgtggacagggtctaggngtagagtgggtagacggtactaccgtaaccgtaagaggttaggtacgaacgtacgacgtcctactcggcacgtaggtacggttacgacggggtaccgtaggggtaccaaccggtagttagggtacggttagggttacgaaccgtaccgggtaccgaaccgtacggaccgtacccggtaccctaacgtaacggttaacggtaaccgttaaccggacgttcggtacgaacgttcgtaggacggtaccgtaccggttaccgttttactaccggttcgtaccggacggaaccccggtaccggaccgggttcggggaaccgggggttaccctaccgggtacccggtttacgacgttacccgggg

SEQ ID NO: 121710 - DNA, 723 bp, Homo sapiens
  misc_feature: GYAE6OF02FWWAC.41.2.A02.1.454.CMB.1.raw
  modified_base (368)..(368): a, c, t, g, unknown or other
  misc_feature (368)..(368): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtagaggaaggcccgtggggcctcgaggtgaacgctctcctgacaagtaccttcgtaggattacgaggttaccaacgtacgttactatactacagtgggtgcgacgcggccccgtggacgtacgggtacttagaggtggagtgggatggataccgaaacccgtaaggngtacgggtacgaacgacacgtccgttacgtagaccgaacgaggtacgggtttacccgaaggggtccgtaacgggtaccacgtaagtacgtaggttacgggtacgaaccgtaccgggaaccgtaacggacggtacccgaaccggttacccaacgtaacgttaacgggtaaacccttacggtacgttaccgtaaggttacggtccgttagggtaaccggtaccgtaccgggtttacctttacggttacggttacggtaccggtaccgggaacccggtccccggtaaggggtacccggggggtaacccgggggtaccttaacccgggtacgggttaccggtacggggttaaccccggg

SEQ ID NO: 121711 - DNA, 752 bp, Homo sapiens
  misc_feature: GYAE6OF02F7W3V.41.2.A02.1.454.CMB.1.raw
  modified_base (153)..(153): a, c, t, g, unknown or other
  misc_feature (153)..(153): n is a, c, g, or t
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (707)..(707): a, c, t, g, unknown or other
  misc_feature (707)..(707): n is a, c, g, or t
  modified_base (742)..(742): a, c, t, g, unknown or other
  misc_feature (742)..(742): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcganccanaggacncccactctcagggtcgcagtctgatgcagtcgtgggctggaggtagaggaacgccgtcggggccctcgaggtaggaacgtccgtaccttccggtacaccgaacgttaccttacgttaggaaacgttaaccggtaagggttaacccaaaccgttaccgtttacttaacttacgtacgtaacggttcggggttacaccggtaacccgaccggtacccgttaggaccggacgggtaccgttaggtaggtacggtaaggtgggtagtacggtaactacccgtaaaccgttaaggtaggttacggtacgaacctacggtaaccgtccgttagtaccgtacgaacctaaggggtacgttcccggaacggggacctcggggtaaaccctaccgtagttacgggacgggttacgtacgggaccccggacggtacccgaacggttacgccctaacggtcccaaggtacgtacggtaaaccttcgtgtactacgtagtaccgtagaacggaccgttcgttaccgttcgtacgtggaatccggaacccgtaccgnggttacccggggcgggttacctacggtacggtacncgggtaccgg

SEQ ID NO: 121712 - DNA, 742 bp, Homo sapiens
  misc_feature: GYAE6OF02HNUVX.41.2.A02.1.454.CMB.1.raw
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
tcagtctatactatcacgaccggtgctcgatttagactcatctacaggggagcatcacccagcaaccacatctgtcctctagagacgtcccctgagagctccgttcctcaccatgactggacctggaggatcctcttcgttggtggcaggcaggccacaggacgccccactcncaggtcgcacgctgatcgacagtcgngggctggaggtcgaggaagcgtgggcctcgagtcgaagtctcctccgtgcaaacgtcttcgaggactaactaggttaccgaaacgtcctttanattaacgtaaccgcgttggggacacccggaacacggttccccgnggaacggtacggttatcgggaagggtggtagtaggggtacttaggggaactacccgtaaaaccgttaaggtggtacggggtanaaaccgacgacgtacccgttacgactaccgaatacgggtacggtttaccggacgggtacgacgggtaccgaaccgtagtaggtacggtagggttacggacggaccggaccggaacgtacggaaccgaacccggttacgaaccgtacggtaccgggttaaaccttccggtaaaccgttacggtaacgtaacgtaccggtacgtaacgggaccgtaacgttacccgttttacgttaccggttacgcggttaccgacccggtaccccggtacgggacgggtaccggggtaccgtacccggtacggtaccggttacggtaacccggg

SEQ ID NO: 121713 - DNA, 846 bp, Homo sapiens
  misc_feature: GYAE6OF02FTK58.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggacgcccactctcaggtgcagctgatgcagtcgtgggctggaggtgaggagccgtggggcctacgagtgaacgtcctacctccgtagactaacgtacctttcgtggaactaccgtaaggttaccgaaaccgttactttactaattaacgtaactaacgttggggtacgccggtaaccgaccggtcccccgtagggaacggtacgggtactttacgggaggttaggaggttacgggacgtagggtaacgtaacccgtaaacccggtaaagggtacggttagggtacgaaccgtaacgtaaccggtccgtacgtccggacctaaccggtacgggtaaccggtttacccggaaccggggtaccgtaaccggggtaccctaaaccggttaggtaaggtaggggttaccgggtacggaacccgacggtacccgaaaccgggtacggacccgtaacccgggttaccccaacggttaacggttaacccggtaaaccgtttacccggaacggttaccggtaacggtaaccggtttcggtaacgggtaaaccgggtaacccgtacccgggtttacccgttttaccgttaccggttacgggtaccggaacccggtaacccggcccggttacggggtaccgggggtaacccgggggttcccttaacgggtacccggttaccggtacgggtacccgggg

SEQ ID NO: 121714 - DNA, 826 bp, Homo sapiens
  misc_feature: GYAE6OF02GEYR0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctaggaggtgaggaacgccgtcggggccctacgagtagaagtcctcctccgtgactaagtaccttcgtaggtactaacgtacggttaccaacgtaccttactaacttaactacctacggttgggtcgaccgacgaccgggccccgtagggaaccgagggtaccttagggtacggtgggtaggtgggtacggtaggtaactacccgtaaacccgtaagggtacggttggtacgtaaccgaactacggtacccttcggtacgaccgtaaccgacgggttaccggggttacccggaacgggggtccgtaaccgggggtacccgtaaacgtaggttaggggtacgggttcgggtaaccgggacccgggtaaccggaccggacgggacccggaaccggtacccggtaccctaacgtaacggttaacggttaaacccgttaccgtaagttacgtaacgggtaacgttccgaacgggtaacgggtacccgtaacccgggtttacccgttttacgttcggtaccgggtaacggtacccgtaaccccgggttaccccgggtaccggggttaaccggggggtacccgggggttacccgtaaccggggtttaacccggtcgggttaacccggtacccggggg

SEQ ID NO: 121715 - DNA, 677 bp, Homo sapiens
  misc_feature: GYAE6OF02GC5Q9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggacgcccactctcgaggtgcagctgatgcagtcgtgggctggaggtggaggaacgccgtcggggcctcgaggtagaacgtcctcctccgtgaccgaacgtaccttcggtaggtaactaaccgtaggttaccaaaccgtcttacgtaatactaacgtacggtgggtcgaccgtaccgaccggtcccgtaggaacgtacgggtacttggaggtggagtgggagtggactaacgtaaccgaaggtacgtggacacacgacgtctacagacgacgtacggtacggtacggaggtacggacggtaccacgtagtacggtcggtaggtacgaaccgtaccggaccgtaacggacgaccgtaccggtaccacgtaacgtacgtaaccgttacgtacgtacgtacgtacgtcgaggaaccgacgtaccggttccgttacgtcggttacgtcggtaccggaccgtaccccgggtgggtaaccgggggtaccgggtaccgtacggtaccggttcggtacggtaccggg

SEQ ID NO: 121716 - DNA, 745 bp, Homo sapiens
  misc_feature: GYAE6OF02JF6II.41.2.A02.1.454.CMB.1.raw
  modified_base (271)..(271): a, c, t, g, unknown or other
  misc_feature (271)..(271): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggtacgccgtgggcctgacgtgagtctctcctgacaagacttctggaactacgaggttacaacgtnttctaatactacgacgttgggtacgcgacgacggcccgtggaccgagggtaaccttggaggtcggaggtcgggagtggaacgtacccgaaaccgtttaaggacggttagggtacgaaccgtacgaccgtacccgtgtccggaacaccgtaacggtacgggtacccgtaacggggaccgtaacggggtacccaccgtaaggtcggtaacgggtagggtaccgaacgaccgggaccgacgggttaacgacccggtaaccggtttacccaaacggtacggtaaccggttaaacccgtaaccgtacggtttccgttaacgggtacgttacggtaacggtaaccgggaaaccgttaccgggttccgtttttaaccgtcggttccggtcggaccggtaaccccgggtacccggtacggggttacccggggggaaccgggttacccggtaacgtaccggggttccgtaaggtaccccgggg

SEQ ID NO: 121717 - DNA, 631 bp, Homo sapiens
  misc_feature: GYAE6OF02I6AOQ.41.2.A02.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (485)..(485): a, c, t, g, unknown or other
  misc_feature (485)..(485): n is a, c, g, or t
  modified_base (551)..(551): a, c, t, g, unknown or other
  misc_feature (551)..(551): n is a, c, g, or t
tcagtctatactatcacgaccggtgctcgatttagactcatctacagggggagcatcacccagcaaccacatctgtcctctagagagtccctgagagctccgttcctcaccatggactggacctggagactcctcttcgttggtggcagcagccacagggacncccatctcgaggtgctagctagntgcagtcgngggctgaggtgaggacgtccgtgggcctgtgacgaagtctcgtaccgtgacgaagtcttcgacgattacgcgttacacgtacttacgtatacgacacggtggtgacncgtaccggtccctaggacgtacggtaacgtgacgtaggtggtagggtcacgtactaccgaacgttaagnggttacggagtacagtaccgtcgtacgtacgactacgacgttcggtacgaggtcgacgtacacgtgacgtaggtacgtacggacgtccgacgtacgcgttacgcgtacctaagngttaaccgggaaccttcggacgtacgtaggtcctagacggacgtaacgccggtttccttaacggtntcccggtaagtacccgaccgtacccgggtggtacgggggtacccggttaccgaggttaaccggtcggtacgtaaccgggg

SEQ ID NO: 121718 - DNA, 777 bp, Homo sapiens
  misc_feature: GYAE6OF02J1DNS.41.2.A02.1.454.CMB.1.raw
tcagtctatactatcacgaccggtgctcgatttagactcatctacagggggagcatcacccagcaacccacatctgtcctctagagagtcccctgagagctccgttcctctaccatggactggacctggaggatcctcttcttggtggcagcgagccacgaggacgccctactcgtacgaggtgccagctcgatcgactagtcgtcgggctaggagggttagaggacggccgtcggggtcctcgaggtacgaacgtccgtcctccgtggaccgtaagtcctttacgaggtactacgtacgggttacctaacgtacctttagtaatacctacgtacggtggggttaccaccggtaccgaccggtacccgtaggaccggtacgggtaccttggacggtggtagggttcgggacttacgggtaacctaccgtaaaccggtaggtacggttacggagtaaccgacgtcgtccgtacgtacggaccgtacggtacggtacggtacccggaggtcccggtaacggtactcccggtaggtccgtagggtcggtacgaacccggtccggtaccggaccgacgttacccgtaaccggtcctaacgtaaccggtcgtaaaccctttacggacgttacccggtagtaccgttcggtaacggacggttacccgtaaccgtttccggtttaacgtcgggtcggtaacccgtaccggtaccccgggtaccccgtaggggtaacccggggacccggttacaaccggtttccggtacgtacccggttaccggg

SEQ ID NO: 121719 - DNA, 887 bp, Homo sapiens
  misc_feature: GYAE6OF02G1IEH.41.2.A02.1.454.CMB.1.raw
  modified_base (190)..(190): a, c, t, g, unknown or other
  misc_feature (190)..(190): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttgggtggcagcagccacgaggagcccactctcgaggtgcagctgatgcngtcgtgggctgaggtgaggaacgccggtcggggcctacgaggtagaacgtctctctcggactaaacgtaccttcgtaggtaataaccgtacggttaacctaaacggtactttaacgtaattacgtaacgtaccggttggggtaggtacccgaaccggtaccgggtcccccggtaagggaaccgggtacggggtaaccgtttagggaacgggttagggtaacggttacggggggtaatacgggggtaaccttaacccggaaaacccgtttaaagggtaacggggtttacgggtacgtaaaaccggtaaccgtaacggttaccccgtaggtttaccggaccggtaaccgaaacggggttaccgggttacccgggtacggggaccgtaacgggtccgaaacccgtaggtacgggttaggtgggttaaccggaccgaacccggggtcaaaccgggaccggtacggacccggtaaccgtaacgtacggttaaccgggtaaacccttaacggtaccgttacggtaggtaaaccgtttcgggaacggtaaaccgggaccgttaccgggtttacccggttttaacgttaccggtagggtacccggtaacggtaccccgggtacccgggtacccgggttaaccgggggtaaccgggggtaccctttaaccgggggtacccggttaccggtacgttaacccgggggg

SEQ ID NO: 121720 - DNA, 944 bp, Homo sapiens
  misc_feature: GYAE6OF02HMUZO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccagtggactggacctggaggactcctcttcgttggtggcagcacgccacgaggacgcccgactccttcgaggtcgacacggctaggactgcctacggtcggtcgggggtctgggagggtaggaagggacggtcccggtcgggggtacccttacggtacggttacggaaacgtccttccgttacccgtggtaaccgtaacggttaaccgtttcggttaacgggtacttaaccggttaacggttaccgtaaacggttaacctttcttaaacgttacttaaaccgttacgggtacggggttacaccggaaccggtaacccgggtccccggttaagggaaccggtaacgggggtttaaccgtttaggggttaacggttacggggttaacgggttaggggggtaacgttaaccgggggtaaactttaaaccccgggtaaaaacccgtttaagggggtaacggtttaccggggttaacggaaacccttaacgggtacccggttaccgtttacggtacggaccctaaaacgggtacgggttaccgggtttacccggacggggaccgttacggggtaccccaacgttagggttaaccgagggttcgggaaaccgtacccgggacgggaaccctacggggaacgtccgggaacccgtaccgtacgtaaggtacccgtaacgtttcccgagtttcgaacgttacgttacggacgtacggtaaccgttccggtttacgtttccgttacggttacggtaccgggtacccgtaccggtaccccgggtagggttacccgggggaaccgggttaccctacgggtacgtttaccggaccggttcccggg

SEQ ID NO: 121721 - DNA, 767 bp, Homo sapiens
  misc_feature: GYAE6OF02HF06E.41.2.A02.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
tcagtctatactatcacgaccggtgctcgatttagactcatctacagggggagcatcacccagcaaccacatctgtcctctagagagtcccctgagagctccgttcctcaccagtcgggactgggacctggaggatcctcttcttgggtggctagcgagccagacggacgcccacttctcgagggtncagctgatggacngtcgtgggtctggaggtcgagggtacgccggtaggggcctacgagtcggaatccgtactccgtnaccgtaagtctacgtacggattacgacggttacaacgtcttatactataccggacggtcgggttacgaccggaacggtcccggtacccgtacgggtaacggacggggttacttacgggtaggtaccgggtaaggtaggggttacgtacggacgttaacccgtaaaccggtaaggtcggtacggttaacgacccgtataacggtccttacgagtaacgaccgtacgggttcgggtaccgtagggtaccgtacgggtaccacccggttataacggggtcggtaacggtacggtaccgaccggtaccggtacggacctacggtaaccgtaccaacggttacggaaccgttacgtaaccgtcgtaacgtacggtaacgtcgtaccgggtaacggtaccgttaaccgggtacgtttacggtcgtaacggtcggaaccggtacccgtaccgggtacgggtaccggggtacccggtaggttacccggtccgggtacgtaggtacccgggg

SEQ ID NO: 121722 - DNA, 688 bp, Homo sapiens
  misc_feature: GYAE6OF02FWCWG.41.2.A02.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (298)..(298): a, c, t, g, unknown or other
  misc_feature (298)..(298): n is a, c, g, or t
tcagtctatactatcacgaccggtgctcgatttagactcatctacagggggagcatcacccagcaaccacatctgtcctctagagagtcccctgagagctccgttctcaccatggactggacctggaggatcctcttcttggtggcagcagccacaggagcccactctccaggtcgctagctgatcgcagtcgtgggctggaggtgaggaagccgtgggccncgagtagaagctctcngcaagtacttcgagactacgtacggttacaacgtcttataatactacgtacgtgggtacncgtacgccggtcccaggacgagggtacttggagtggagtggacgtacggactacccgtaaccgtaaggtcggtacggtacacgacgtaccgtccgtcgtacgaccgtaacgacgggtacggtttccggacgggacgtaacgggtacctaccgagtacgggaggttacggtacggaaccgaccggaaccgtacgaacggtcccgtaaccgaccctagaacgttaccggttaaccttaccgacggttactaacgggtaacgttcgaaggggtaacctaccgttacccggttacgttttacgcggttacggtaccggcccgtaacccggtcccggtagggtaccgggggacccgggttccttaaccgggcggtaaccgttgggtaaccccggg

SEQ ID NO: 121723 - DNA, 715 bp, Homo sapiens
  misc_feature: GYAE6OF02IQS27.41.2.A02.1.454.CMB.1.raw
  modified_base (171)..(171): a, c, t, g, unknown or other
  misc_feature (171)..(171): n is a, c, g, or t
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccacaggagcccactctnaggtncagctgatgcagtcgnggggctggaggtgaggagccgtgggcctgagtaggaacgctctcgtcgacgaagtacttccgtaggaactaccgtaaggttacaaacgtacttatataactactcggtgggcgtacgaccgtccggaccccggtggaacggacggtacgtaggcggtaggaggtgggagtaggacgtaccgtaaaccgttaaggcggtaggtacgacgaacgaccgtcgctacggacctacgaggtacggtcgagggacgtacgggacaccgtagcgtaggtcggacgaccgaccggaccgagcggacccgtaccgaccaacgtacgaacggtaaccttacgtacgttacggacgttaacgttccgtaacggggtaaccgtacgggttaacccggtttcccggttttaacgtttccggtaggtaccggtacccgggtacccggtaacccccggggtcgggttaaccgggggggtaaccggggttacccggttaacccgggttaaccggttacggttaaccgggttacccgggg

SEQ ID NO: 121724 - DNA, 656 bp, Homo sapiens
  misc_feature: GYAE6OF02I7QKX.41.2.A02.1.454.CMB.1.raw
  modified_base (143)..(143): a, c, t, g, unknown or other
  misc_feature (143)..(143): n is a, c, g, or t
  modified_base (162)..(162): a, c, t, g, unknown or other
  misc_feature (162)..(162): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (584)..(584): a, c, t, g, unknown or other
  misc_feature (584)..(584): n is a, c, g, or t
  modified_base (611)..(611): a, c, t, g, unknown or other
  misc_feature (611)..(611): n is a, c, g, or t
tcagtctatactatcacgaccggtgctcgatttagactcatctacagggggagcatcacccagcaaccacatctgtcctctagagagtcccctggagagctccgttcctcaccatggactggacctggagatcctctcttggngcagcacgccacgaggacnccccacgtctcgaggtgcagctgatgcagtcgtgggctggaggtgaaggacgccgtgggcctcgagtcgaatccgtctcgngacatcttgtaggntacgaggttacaacggtacttcgattaactacgcgtagggtcgcgtacgaccgggtcccgtggacgacgggtaccgttggaggtcggtagtggacgtcggtactaccgtaacccgtaaggtcgtaggtaacgacgtaacgacggtcctacgacgaccgtaacgtacggtacgggtacgaacgggccggtaacggtccgtaacgacgtacgggtcggtaccggtagaaccggtaaccgcggaaccgcgtaaccgcgtaccacgtacggtcgtaacgtaccgtagtaccgtagtaacggtcgaggtacggacccgtacggttacctttntacggtcgtcggtacgcgtaacccggnggtaccgggacgggtacctacggtcggtaccgacggtaacccggg

SEQ ID NO: 121725 - DNA, 702 bp, Homo sapiens
  misc_feature: GYAE6OF02GIHOF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacaggagcccactctcaggtgcagctgatgcagtcgtgggctggaggtgaggacgcggtgggcctcgagtcgaagtcctcctccgtagacgaacgtactttcgtggtaagtacgtaacggttaccgaaaccgttacttactaagtactaacgacgttggggtcgaccgacggaccggtcccgtaggaccgaggggtactaggtacggtgggagtgggtagtacggtaacgtaaccaaaccgtaaggtaggttacggtaacacgtaacgacgtccctcgtagaccgtaacgtaaggtacggggttaccgacgggtcggacgggacgtaaccgtaggtaggtagggtcggtaacgaccggaccgggaccacggacgaccggaccgtactaacgagttaaccggtaaccttaccgtacgtcgtaacggtaacgtcgaacggacggtaccgttcggttaccgtttacgttcgtacggtcgaccggtaaccgacccggtagggtacggggaacccggggtacttaaccggtacggttacggagttacccggg

SEQ ID NO: 121726 - DNA, 668 bp, Homo sapiens
  misc_feature: GYAE6OF02HPUSR.41.2.A02.1.454.CMB.1.raw
  modified_base (175)..(175): a, c, t, g, unknown or other
  misc_feature (175)..(175): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtncagctgatgcaggtcgtcgggctggaggtgaggaacgccgtggggcctgagtgacgctctcctgcaagtacttcgtaggtactacgagttacaacgtacttactaatactaccgagtgggtcgacgacgccgggccctggaccgtagggtacgttggaggtggtagtagggatggactaccgtaaccgtaaggcggtaggacgaccgacgaacgtccgttcgtacgaccgaagtaccggtacgggttaccggaacggggtccgtaacggggtaccaaccggtagtcggtagggtggtaccggaaccgtaccggacccgtaacggaccgtaaccggaccggtaccagtaacggtaccgtaacctacgtacgtacgtagtacgttccgagccgtaacgtcccgttacgtttactcggtggaccgaccggtacccggtacccggaggtaccgggggtaaccgggcctttaaccggtacggtaccgtcggttacggg

SEQ ID NO: 121727 - DNA, 848 bp, Homo sapiens
  misc_feature: GYAE6OF02HWYD7.41.2.A02.1.454.CMB.1.raw
  modified_base (148)..(148): a, c, t, g, unknown or other
  misc_feature (148)..(148): n is a, c, g, or t
  modified_base (720)..(720): a, c, t, g, unknown or other
  misc_feature (720)..(720): n is a, c, g, or t
  modified_base (787)..(787): a, c, t, g, unknown or other
  misc_feature (787)..(787): n is a, c, g, or t
tcagtctatactatcacgaccggtgctcgatttagactcatctacagggggagcatcacccagcaaccacatctgtcctctagagacgtcccctgagagctccgttcctcaccatggactggacctggaggatcctcttcttggtgcngcagccacgaggacgcccactctacgaggtgcagctgatcgcgacggtcggtcggggtctggtagggtaggaacgggaacggccgggttacggggccttacggaacggtacggtaacggtcccttaccgtaccgttgaaccgtaaacggtttaccgttaccgttaaggtaaccgttaaacggtacggttaacccgtaacggttacctttaacgtaacttaacgtaacgttacggtcggggttaccgaaccggaccggtacccggcccgttaggaaccggtagggtaccgttagggtacggtacgtagggtacggtcggtacgtaacgtaacccgtaaccggtaaggtacggtacggtaaccgacgtaccgacgtcccgttcgaggtacccgtagggtaaccggttaccggtaccgggaccgggtaacgggtaccggtaaccgaccggtaggtaccgggtaagggtaccgggtacccgaacggacccggacccggtacggaccggtacccggaacgtaccaaggttacggaccgttaaccgtacgtcgttaacgtacggtacgtcgaaacggnggttacccgttaccggtttacgtttccgtacggcgggttaacccgccgggtaacccggtacccgggnggggttaccgggggtacccgggttaccttaacggtacccgggtttcgtaaccggtcccggg

SEQ ID NO: 121728 - DNA, 833 bp, Homo sapiens
  misc_feature: GYAE6OF02G8VRK.41.2.A02.1.454.CMB.1.raw
  modified_base (175)..(175): a, c, t, g, unknown or other
  misc_feature (175)..(175): n is a, c, g, or t
  modified_base (239)..(239): a, c, t, g, unknown or other
  misc_feature (239)..(239): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtncagctgatgcagtcgtgggctggaggtgaggagccgtggggcctcgagtgaacgtctcttccgngtacaacgtacttcgtaggtactacgacggttacaaacgtccttactattaactactacggtggggtacgaccggaacgtaccgggccccgtagggaaccggtaggggtacttgggacggtggtaaggtacggggtagtacggtacgtacccgtaaaacccgtaaggtacggtaggtacgaaccgtacggaaccggtccgttacgtacggtaccgaacgtaacgggtaccggttaccgggacgggtaccgtaaacggggtccaaccggttaacggtcggtaaacggggttcgggtaacggtaacccggtaaccggggaccctaaaccgggtacgaacccgggttaaccggtaaccgtaacgtaacggttaccgggtaaaacccctttcggtaaccggttggttaacgtaaacgggtttccggtaaacgggaaccgggttaaaccggacccgggtttttaccgttttaccgttacggtggtttacccgggaaccgtaaccccgggttaccccggggtacggttaaccggggggggaacccgggggttacctaacccggggtttaaccggtaccggtttaacggtaaccccggggg

SEQ ID NO: 121729 - DNA, 716 bp, Homo sapiens
  misc_feature: GYAE6OF02GA5QE.41.2.A02.1.454.CMB.1.raw
  modified_base (448)..(448): a, c, t, g, unknown or other
  misc_feature (448)..(448): n is a, c, g, or t
  modified_base (595)..(595): a, c, t, g, unknown or other
  misc_feature (595)..(595): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggccagcagcccacaggagcccactctcaggtgcagctgatgcagtcgtggggctgaggtgaggtaacgccgtggggccctacgaggtagaacgtccctaccgtccgtagaccgtaaacgttccttcggtacggaacttacggttaacggttaccaacgttacttactaagtactactacggtgggtacgacgtacgcccggccgtaggacgtacggtacgttggaggtggaggtgggacgtaggtacctaacccgtaaacgtaaggtacggtacggtacgaaccgtacgaccgtccgtaccgngaccgtaacgtacggtacggtaacccgaaggggtcccgggtaacgtacccaacgttaggtagggttacgggttacggaccgtaacccggacgtaccgaacggttccgaaccggtacccgtacaacggtacgtaaccgaaacccgttnacggtcgtaaggtactcggtagaccgtacgtcggtttaccctggttcgtcggtaaccgccggaaccgaccgggtacgggtaccggggaccggtaccttaccgtcgtacggaccggtccggg

SEQ ID NO: 121730 - DNA, 677 bp, Homo sapiens
  misc_feature: GYAE6OF02I9YRK.41.2.A02.1.454.CMB.1.raw
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (229)..(229): a, c, t, g, unknown or other
  misc_feature (229)..(229): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctggtggcagcagccacaggacgcccactctcaggtncngctgatgcngtcngggctgagtgagacgcgtgggcctcacgtgacgtctccnccgtgacaacgtactcgtggatacgacggttcaacgtcttagtctatacgacgtggtcgcgtacgacggcccctaggtccgaaggtcgtagtagtcggagttaggactggactaccgaacccggtaagaggttcggtcaataaccgngtcctntacggctacgaggtaccggtacgacggactagggtaccncgtaacgtggacgttacggggtacgaccggacgtacccgaaccggacgaccgtaacgggtccacgtacggtaccggtaacttaccgcgttaccgtaaggtaacgtaccggtacgtaacgacccgggtaccggttacccgtttaacggttcgttcggttaccggacggttaaacccggtacccccggacggttacccggggggtaacccgggggtccccgttaacggtttacccgggagttacccggttaacccggg

SEQ ID NO: 121731 - DNA, 694 bp, Homo sapiens
  misc_feature: GYAE6OF02F57XN.41.2.A02.1.454.CMB.1.raw
  modified_base (166)..(166): a, c, t, g, unknown or other
  misc_feature (166)..(166): n is a, c, g, or t
  modified_base (601)..(601): a, c, t, g, unknown or other
  misc_feature (601)..(601): n is a, c, g, or t
  modified_base (640)..(640): a, c, t, g, unknown or other
  misc_feature (640)..(640): n is a, c, g, or t
  modified_base (686)..(686): a, c, t, g, unknown or other
  misc_feature (686)..(686): n is a, c, g, or t
tcagtctatactatcacgaccggtgctcgatttagactcatctacagggggagcatcacccagcaaccacatctgtcctctagagagtccctgagagctccgttcctcaccatggactggacctgggaggatcccttcttcttggtcggcagcagtccacaggacncccactctcgaggtcgcagctagatcgctagtcggtagggtctaggacggtagacggaacggtccggtggggccttaggaaggtacgaacgtcctctaccgtgacgtaacgtcttcgtaggtaactaacgtcggttaccaaacggtcttacgtatacgtacgtacggttcggtacgcgaacgtccgtaccggtaggacgtacggttacgtaggaccggtaggtaacggtcggtaagtacgtaccgttaaccgaaaccggttaaggtcgggtaacgtacggtaaccgacgtaccgtccgttacgtaacgaccgtaaacggtacggttacgggtaccgacgggccgtaacgggtccaacgtacggttaggacgttcggaacgtacccgtacgggactacggacgtccgaacgtccaacggtcgtaacgtactacgtnacgtacgtgagtcggagtccgtacgttccgtctacggtncggaccgtccgacggcggtaagggccggttactacggtcggtacgnggtaccgg

SEQ ID NO: 121732 - DNA, 654 bp, Homo sapiens
  misc_feature: GYAE6OF02HPYW5.41.2.A02.1.454.CMB.1.raw
  modified_base (176)..(176): a, c, t, g, unknown or other
  misc_feature (176)..(176): n is a, c, g, or t
  modified_base (313)..(313): a, c, t, g, unknown or other
  misc_feature (313)..(313): n is a, c, g, or t
  modified_base (593)..(593): a, c, t, g, unknown or other
  misc_feature (593)..(593): n is a, c, g, or t
tcagtctatactatcacgaccggtgctcgatttagactcatctacagggggagcatcacccagcaaccacatctgtcctctagagagtcccctgagagctccgttcctcaccagtggactggacctgggaggactccctctttcgttgggtcggcagccacgcccttacgagggcncccctactctcgagggtcgcagtctgatgctaggtcggtggggctggagggtggaaggacgccgtcgggactcgaggtgaacgtctccgtcgtgacgaacgacgttcgaggtattacgaggttacgaacgtacgttntatacactagtggtcgcgacgcgccctaggaccgtagggaccttgggacgtggaggtaggacgtagactacccgaacgtacggtgttaggagaccgtaaacgccgccgttacgtggaccaggtaacggtcggtaccggaacgggtcgtaaccggggtccaacgtaggtaggacggttggtacggcgaccgaccgagtacgcgtaacgcagtacgacgtaaccgtcgaagttcgacgtaacgtcgaaggtaaccgtaccgacggttcccgttagttaccgnggttcgaccggtacccgaccgtcggtacggggaaccgggctaacggtcgtcgacgtcccgg

SEQ ID NO: 121733 - DNA, 732 bp, Homo sapiens
  misc_feature: GYAE6OF02IV86N.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactcctcaggtgcagctgatgcagtctgggctgaggtgaggacgccgtagggcctcgagtgaacgctctcctgactaagtcttcgtaggtattaccgaggttaccaacgtctttactataacttacgacgttgggtcgtaccgaccgaccgggtccctaggggaaccgtacgggtaaccgtttgggaacggttggggtaacggttcggggtaagttcgggtacctaaccgaaaccggttaacggtgggtacgggtacgaaccgtacgaccgttacccgtgtaccggaaccgtacgaacgggttaccggtccgtaacggggtaccggtacgggtacctaacggtacgttaggtacgggtacggtaaccgtacccggaacccggaccgaaccgacggtaccgtacccgtaccaacgtacgtaacgtaaccttaccgtacgtcgttacgacgtacgtcggtaacgtacgtaccggttaccgtttacgttcgtcggtcgaccggtaccgtacccggaccgggttaccgggaccgggggttcctaaccggttacggtaccgtaggtacccggg

SEQ ID NO: 121734 - DNA, 776 bp, Homo sapiens
  misc_feature: GYAE6OF02FOOU9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccagtgactcggacgtggaggatcctcttcgttgggtggcgagcacgccacgaggacgccccacttctacgaggtcgcagctgatcgacaggttcggtagggtctggagggtacggaagggaacggccgggtcggggccctagaggtaggaacgtccttcctcctgactaacgtacctttcgtaggtaactacgttaacggtttaccgaaacggttacctttactaacttaactaaccgtacggtggggttacgaccggtaaccggacccggtcccccggtaggaaccggtacggggttacgttacggtaggtacggtaggtagggtaggtacggtactaccgaaaccgtaggaggttggacacgacgactcctcgtgaccgacgacggtacgtcgagggacgcggtaccacgagtaggtacggttggaccaccggaccgaccgaacgggtaccaccgaccgggtaccactaacggtacggttaacccttaagaccgtttacgaacgttaacgttacgacgggtaacgacccgttaccgggtttacgttttaacgttcgggtccggttacggaacccggtacccggtaccccggttaccggggtacggggggttaaccccggggtccgttaaccgggttccgggtttaccgaacgggttcccgggg

SEQ ID NO: 121735 - DNA, 772 bp, Homo sapiens
  misc_feature: GYAE6OF02G5RRA.41.2.A02.1.454.CMB.1.raw
  modified_base (192)..(192): a, c, t, g, unknown or other
  misc_feature (192)..(192): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccttcttcttggtggcagcagccacaggagcccactctcaggtgcagctgatgcagtcgnggggctgaggtgaggacgcgtcgggctcgagtgacgctctctgacagtacttcgttggacttacgaggtactaaccgtacttactactactacgacggttcgggtagccgtaacgtaaccggccccgtacggtaacgaacggggtaccgttaggaggttaggagttggggagttacgggacttaaccgtaacccgtaaaggtacggttagggttacgacgtaaacggtcgaccgttcgttcgaaccgtacgaacggtaacgggttaccggagggtacggtaccgggttccaaaccgtaggtacgggtaacgtgggtacggaaccgccgggaaccgacggaacgccgtaaccgtccgtaaaccgtggtaaccgggtaacccttaaccggtacggttaactacgggaaacgtttccggaacgggtcggtaacccgtacccgggttacccgttttaccggtttacggtaacggtttccggaaccgggaccccggtacccgggttaacgggtacccggggggtaacccgggggttaaccccggttagggttaaccccggttggttaacccggttaccccggggg

SEQ ID NO: 121736 - DNA, 698 bp, Homo sapiens
  misc_feature: GYAE6OF02JVW85.41.2.A02.1.454.CMB.1.raw
  modified_base (160)..(160): a, c, t, g, unknown or other
  misc_feature (160)..(160): n is a, c, g, or t
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgacgagctccgttcctcaccagtggactggacctggagactcctcttcgttggtggcgagcagccanaggacgcccactctcaggtgcagctgactgcagtcgtgggctggacggtgaggacgccgtcggggcctcgagtgacgtctctcgtgactaagcttctggaactacgagttaccaacgtcttactatactacgtacgtggggtctccggaacgtaccggacccgtggaaccgtaggggtacctttagggngtcggtaagtcgggataggactacgaaccgtagagtggtacgaccagacgtcctcgtgacctacgtaggtaccggttacggacgggaccgtaacgggtacctacggtagtacgggtaggtcggtacggtaacggaccggtaccgacggttaaccggaccgacccgtaccgtacgtaacgtaaccggtaaccgtaccgtaaccggttacgtaggtaaacccgtcggtacggacgttaccgggtaccgttaccgtttacggtacggttcggtaccggtacggtacccggacccggttccgggacggggtaccggggtaccgttaccgggtaccgtacgggtcgtacccggg

SEQ ID NO: 121737 - DNA, 656 bp, Homo sapiens
  misc_feature: GYAE6OF02GD47X.41.2.A02.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
tcagtctatactatcacgaccggtgctcgatttagactcatctacagggggagcatcacccagcaaccacatctgtcctctagagagtcccctgagagctccgttcctcaccatgactggacctggagatcctcttcttggtggcagcacgccaacgaggacgcccactctcaggtcgcagctgatgcngtcgngggctggaggtgaggacggccgtggggcctgagtgagtctctcgtgacaacgtctcgtagactacgtagtacgtaagtcttagtatatacgacgtggcgacgacgaccgcccgtggacgagggtctgaggtggagtaggtacgaggtaacaccgtaaaccgtaggtcgtaggtacgaacaactcgtcccttgacgctaacggacggtacggtaccggagggtacgacggtacacgtggtaggtggtacggtaccgacggaaccggaccgtacgacgcggaaccgtcaacgtacgtaactaaccgttacgtcgttaacgtaggactcgtacggtaacgttacccgtacggttttacccgtttattacggtccggttaacggccggtaaacccgtccgggttacgggtaaccgggggtaccggggttacccttacgggttaccgggtttcgacgggttaccggg

SEQ ID NO: 121738 - DNA, 725 bp, Homo sapiens
  misc_feature: GYAE6OF02G6XFQ.41.2.A02.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggacgcccactctcgaggtncagctgatgcagtcgngggctggaggtggaggacgccgtcggggcctcgagtagagctctcctgacgtaagtcttcgtaggtacgtacgtacggttacaacgtacttctaattataccgacgtggtcgacgacgacggtccccgaggaccggacgggtacgtaggacggtggtagtagggacgtaggtaccgtaaccgtaaacccgtaagggtaaggttacgggtacgaacctaacggtacgtacccgttacgtacggaccgaacggtaacggtaccgggttaccgaacggggaccggtacggaccgtaacgagtggtaggtcggtacggaccgtacggacccgaaggcaccggtacggtaccacgtaacgtaccggtaacctacccgtagttacgtacggtaacgtgtacggaaccgttacgaccggtttacccgtttattaccggtggtacccgggtaccggtaacccgtcccggggtacggttaaccggggggaacccgggttaccttaacccgggttcggtaccgggtacggttacccgggg

SEQ ID NO: 121739 - DNA, 890 bp, Homo sapiens
  misc_feature: GYAE6OF02FV66N.41.2.A02.1.454.CMB.1.raw
  modified_base (197)..(197): a, c, t, g, unknown or other
  misc_feature (197)..(197): n is a, c, g, or t
tcagtctatactatcacgaccggtgctcgatttagactcatctacgagggggagcatcacccagcaaccacatctgtcctctagagagtcccctgagagctccgttcctcaccatggactggacctggaggatcctgttcttggtggcagcgagccaccgaggacgcccctacttctacgaggtgctagctggatgnacgtcggtcggggctggagggtgacggtaacgccgtcggggtcctacgtagtaggacgtccgtccttccgtacgtacgaacgttaccttgtggtaagtaccgtaggttaccaaacggtacttacgtaactattaccgtaagtggtcgaccgacgccggtacccgtaggacgacgggtatacggtaggtggaaggtcgggtataggacctaacgtaacccgtaagacgggttacggttacgactacggacgttaaccgtcggtacggactacggtaacggtcgggtttaccggagggtaccgtaacggggtcccaaaccgggtagttacggggttacgggtacgggttaccgggaccgggtaaacccggtacccggaaaccgggacccgggttacccgggtaaacccgggtacccccgttaagggtaaaccgtttaaacccggggttaaaccgtttacccccggtaacgggtttaccgaacgggttaacccgttagggtaaccggttaaacgggaccccgggttaaccggtttttaccccgggttttacgttacccgggtttccgggttaaccggaaccccgggggttaaccccgtccccccgggggtttacggggtaaccccggggggtaaccgggggtttacccgtttaacccgggtcccgggtttaaccgggttacgggttaccccggggg

SEQ ID NO: 121740 - DNA, 666 bp, Homo sapiens
  misc_feature: GYAE6OF02FRPZG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcacgccacaggacgccccactcctcaggtgcagctgatgcagtcgtggggctggaggtgaggaacgccgtggggcctcgagtgaacgctctcctgacaagtacttcgtaggatacgtaggttacaacgtacttactatactacacgtgggtcgcgacgaccggcccctaggaccgagggtaccttagaggtggagtgggatggataccaaccgtaaggagtggtagacacgacgcctacgtcgaccaacgacggtacggttacccgagggtacgtacgggtccaaccgtagtggacggttaggtacgaccgacggaccgacggacgtccgaaccgtccgaacgacgttaggtaaccttaccgagttacgttacgaacgttcgacggaacgaccggttaccggttaccgtttaccgttacgttcggttacggaccgtaacccggtaccccggtcggtaacccggggggtacccgggggtaccctttaacgggttaccgggtacgttaccggtaccggg

SEQ ID NO: 121741 - DNA, 921 bp, Homo sapiens
  misc_feature: GYAE6OF02IWI4H.41.2.A02.1.454.CMB.1.raw
  modified_base (171)..(171): a, c, t, g, unknown or other
  misc_feature (171)..(171): n is a, c, g, or t
tcagtctatactatcacgaccggtgctcgatttagactcatctacagggggagcatcacccagcaaccacatctgtcctctagagagtcccctgagagctccgtcctcaccatgactggacctggaggatcctcttcttggtggcagctagccaccaggacgcccaactcnctaggtcgcgtagcttaggatgaccgaggttccgtaggggcgtaggtagggtaggacgggaacgcccggtagggggcccttacgaggtagtaaggccttaccgtcccgtagaccgaacgttaccgttacggtacggtaacttaacgtaacgggtttaactaaaaccggttactttaccttaagttaaccttaacgtaacggtgggtaacgaccggtaaccggaccgggtaccccgttaggaaccgtaaggggttaccgtttaggaacggttagggaagttacggggtaactacggtaaacgttacccgaaaacccgtaaaggttacggtagggtacgaacaaccgaggtcccttacgtacggaaccaaacggtacgggtacgttaaccggaccggtaccggtaacgggacgtaaccccgtaaggtaacggtagggttacgggtaaccggtaacccggtaacccgggaaccgaaccggaccggtacccggtaaacccggtaccccgtaacgttaacggtaacccgggttaaaccgttaccgtaaacggtaccgggtttaaggaaacggttaccgtaacgggaaccggtttaaccgggacccgggttttaccccgtttaaccggtttaccggttaaccggtttacggtaacccggaacccggttaaccccgggacccggtttaacgggggaaccccgggggttaacggttaacccgggttaaccggtttaccggtaaccggttaacccgggg

SEQ ID NO: 121742 - DNA, 844 bp, Homo sapiens
  misc_feature: GYAE6OF02I0XYG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttgtggcagcacgccacacggacgcccacttcgtcaggtcgccaggctggatcgacgtagttccggtcggggtcgtagggtagggtaggaggtacgggaccgggttcggggcccgtacgacgggttacgacggttccttcccgttccgacggtaaccgtaaccgttaccggttaccggttacgggtaacttaccggttaacgggttaaccgttaaaccccgtaacggttttacctttaagttaaaccttaccggttaacgggttcggggtacggttaccgaaaccccgggccccgggttaccccggtaaccggggtaaccgttacggggtaacgtttggtaccggggttagggttacgggtacgggtacggttacgaacggttaacccgttaaacccggtagggttaacggtcggtaaccggaaccctcggtaacccgtccgtaaccgttacggacgttacgtacgggtacggtaccggtacgggtacggtacgacccggtacgtagtcgggtaggttcggaacggtaccgacggacgtacgaccgacggacccgtacgaccgtaggtacgtaaccgtacgtacgtacgtacgtcgtaggtaggaacggtccggcgtttaccgttcgtacgtcgtacggccgtacccggtccggtaccgggtacggggtccggtaccgtaacggtcgtaacggtcgtacccggg

SEQ ID NO: 121743 - DNA, 625 bp, Homo sapiens
  misc_feature: GYAE6OF02FT6DH.41.2.A02.1.454.CMB.1.raw
  modified_base (161)..(161): a, c, t, g, unknown or other
  misc_feature (161)..(161): n is a, c, g, or t
  modified_base (246)..(246): a, c, t, g, unknown or other
  misc_feature (246)..(246): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccgtcttcttggtggcagcagccacaggngcccatcgtcaggtgcagctgatgcagtctggggctgaggtgaggaagccgtggggcctcagtgaagcctctcctgcaagcttgnggatacaggttcaacgacttcgtatatacacgtggtgcgacncggccctggacngggtacttgacgtggagtgggagtggactaccgaaccgtaagaggtggtagaacgtaccagtccttcgtagacacgaggtacgggttccgaggggacgtacgggtcaaccgtagtcggtaggtcggtagtaccggaccggcacggacgaccgaccggtaccacgtactaacggtaaccttacgtaccttcggtagaacgttacgtaggaacggaccgtaccggtttaccgttacgttcgtcgtaccggaccgtaccggtaccccgacggttacgggggacccgggggttacctacccggttacgggttccgtaaggttcccgggg

SEQ ID NO: 121744 - DNA, 800 bp, Homo sapiens
  misc_feature: GYAE6OF02G4HKY.41.2.A02.1.454.CMB.1.raw
  modified_base (144)..(144): a, c, t, g, unknown or other
  misc_feature (144)..(144): n is a, c, g, or t
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
tcagtctatactatcacgaccggtgctcgatttagactcatctacagggggagcatcacccagcaaccacatctgtcctctagagagtcccctgagagctccgttcctcaccatggactggacctgggagatcctcttcttggnggcagcagccacaggacncccatctcgaggtncagtctgatgacgagtcgnggggtctggaggtagaggaacgccgtggggcctnaggtcggaactcgtctccgngaactaacgtcttcgtggaactacgtagttacgaacgtacttacgtaactaacgtaccgaacgttggggtctaaccgggacgtacccgggtccccgtaggggaaccgtacggggtaaccttgggtacgggtacggtaggttacggggtatacggggtaaacttaaccggtaaaacccgtaggtaacgggttcgggtaacgaacctaccggtacgtaccccgtttacgacgacccggtaacgtaacgggtacgggtttccccggaaggggtaccgtaacggggtaaccccacggtaggtacgggtacgggtacgggttaacgacccggtaccgggaccgttaaccggaggtacccggtacccgtactacggttaactaccgggttaaccctaggtaccgtagttaacggattcggaacgttaacgggtacccgacggttttacccgtttacgtaccggtcggtccggtaaccggtaaccccggtccggtaacgggtacccgggggttaccgggaccctttaccggggtacgttccgggtaggttaccccggg

SEQ ID NO: 121745 - DNA, 758 bp, Homo sapiens
  misc_feature: GYAE6OF02G4UWV.41.2.A02.1.454.CMB.1.raw
  modified_base (53)..(53): a, c, t, g, unknown or other
  misc_feature (53)..(53): n is a, c, g, or t
tcagtctatactatcacgaccggtgctcgatttagactcatctacagggggancatcaccagcaaccacatctgtcctctagagacgtccctgagacgctccgttcctcaccatggactggacctggagatccttcttcgttggtggcagcagccacgaggacgccctactctcagggttgcagctgattcggcacgtcggtggggtctaggacgggttagaggtaacgtccggtcggggtccctaggtacggtgaacgtccgttcctccgtacgaactaagtcccgttgtcggaactcgtaacggtttacaaaccttactttacgtaattaactaaccgttacgggtcgggttacgaccgaaccgtaccggggtccccttaggggaacgtacggggttactacgggaaggttggtaacggttagggaacttcgggaaacttaacccgaaaccggttaaggggtccgttacggtaacaaaacctccgtagtcccctttagaaccgcctaacggtaggttaaccgtacggacgggttacgaaacgggtccctaacggagttacgtagggtacgtccgacgtaccgacggacgaacgcgtaaaccgtcgaaagtacgtaccgtaatccgtattcgacgtaacggtctaaacggacggttacgccgtttacctttacgtcggtacgtcgggtacgaccggttaccgtaccgggttacgggaccgggtttacctcccggtagggttaccgaaccgttccggg

SEQ ID NO: 121746 - DNA, 884 bp, Homo sapiens
  misc_feature: GYAE6OF02F9CW5.41.2.A02.1.454.CMB.1.raw
  modified_base (161)..(161): a, c, t, g, unknown or other
  misc_feature (161)..(161): n is a, c, g, or t
tcagtctatactatcacgaccggtgctcgatttagactcatctacagggggagcatcacccagcaaccacatctgtcctctagagagtcccctgagagctccgttcctcacatggactggacctggagatcctcttcttggtggcagcagccacgaggacncccatctcgaggtcgcagtctagagtcgctagtcggtagggtctggtaggtagaacggacgtccgggtcgggacctagaggtacggaacgttcctaccgtccgtacgtaacaaacgttccttggtaaggtactaacggttaccggttaccgtaaaccgtttacttaacgttaacttaaacgtccggtaacgggtttaggggaccgtaacccgtaccggggaaccccggttacccgggagggtaaaccgggtaacgggtaccgtttagggaacggttgggtaacggttacgggtaacgtacggtaaccttaacccggaaaccgtttagggagggtttacgacctaagacgtaaccgtcgtacggcttaacgaccggtagggtaccgggtacgaacgggtccggaagtccgtaaacgtggtaagggtacggttagggaccctaacccggcgggttaaacccggacgaccgggtaacccgttaaccgaccggtaaaggttacggtaaacccgttaaaccgttcctaaccgggtttaggtaaccgtttaagggtacccctaaggggttaaacccggacccgggtttaacccgtttttccggtttaccgttaagggtttcccgtaccgggaaccggtaccccggttacggggttacccggggttacggggggttacccccggggaaactttacggggttaccccgtaggtaacccggggttcccgggg

SEQ ID NO: 121747 - DNA, 1033 bp, Homo sapiens
  misc_feature: GYAE6OF02G7TA0.41.2.A02.1.454.CMB.1.raw
  modified_base (164)..(164): a, c, t, g, unknown or other
  misc_feature (164)..(164): n is a, c, g, or t
tcagtctatactatcacgaccggtgctcgatttagactcatctacagggggagcatcacccagcaaccacatctgtcctctagagagtcccctgagagctccgttcctcaccatggactggacctggacggatcctcttcttggtggcagcagccacgaggacnccactctcaggtgacagctgatagcaggtcgtagggctggaggtagagggacgtccggtcggggacctagaggtagaacgtcctctaccgtgacgtacgtacgttacggtacgtaacgtaacggtaacggttaacgtaaccgttactttacgttaacgttacgtacgtacgggtacgggtacgaccggtaaccgggtacccgggtacccggtacgggtaaccggtaaccggggtaccggtacggggtacgggttaacgggtacggggtacgggttacgggtaccggtaaccgttaacccggttaaaccgggttaaggggtaacgggtaacggtaaccggtaaccgtaaccggtaaccgttaccgttaccgtaaccggtaaccggtaaccgggttaacgggttaaccggggttaccgggtaaccggggtaccggtaaccgggttaacccggtaaaccgggttacggggttaacggggtaacggggttaccgggtaacccgggaacccgggtaacccgggaacccggtaaccggggtaacccggtaacccgggtaacccgggtaaccgtaaaccgggttaaaccggttaaccgggttaacccgtttaaccggttaaccggtttaaccgggttaacggttaaccgggttaaccggttaaccgggttaacccgggttaacccgggttttaacccggtttaccggtttttaccggttaccgggtttaccgggtaacccgggttaacccgggtaaccccggggtacccgggggttaacccggggggtaacccggggggttaccccgggggttaacccgggttttaacccggggttacccgggtttacccggggttaaccccggggttaccggggg

SEQ ID NO: 121748 - DNA, 788 bp, Homo sapiens
  misc_feature: GYAE6OF02G02TU.41.2.A02.1.454.CMB.1.raw
  modified_base (174)..(174): a, c, t, g, unknown or other
  misc_feature (174)..(174): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacatgagcccatctcaggtncagctgatgcagtcgtgggctgaggtgaggaagccgtggggcctcgagtagaacgctctcctgacaagaccttcgtaggactacgaggttaccaacggtactttactaagttactaccgaacgttggggtacgaccggaacgaccgggcccccgttagggaacgacggggtaaccttggtacgttaggggacgttggggacttagggacttaccgtaaacccggtaaggacggttaggtcggaaacgtacgaaccggtccgttcgttagaccgtaaccgacgggtacgggttacccgtacgggggaccgttaggggtaccaacccggtagtacggtacgggttaggttaccggaccggaccgggaccgtacgggaaccggccgaccggtaccctaacctacgggtaaaccggtaaccgtttaacccgtacgggtttaccgtacgggttaaaccgttcggtaacgggtaaccggacccgtaccggggtttacccgttttaacgtttcccggttacgggttaccggtaccgggtaacccggacccccggttacggggtaccgggggtaacccggggggttaccctaccgggttaccgggttacccgttaacggggg

SEQ ID NO: 121749 - DNA, 715 bp, Homo sapiens
  misc_feature: GYAE6OF02HXMIZ.41.2.A02.1.454.CMB.1.raw
  modified_base (164)..(164): a, c, t, g, unknown or other
  misc_feature (164)..(164): n is a, c, g, or t
  modified_base (318)..(318): a, c, t, g, unknown or other
  misc_feature (318)..(318): n is a, c, g, or t
  modified_base (379)..(379): a, c, t, g, unknown or other
  misc_feature (379)..(379): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggactccttctttcgtttggtggctagcagcccanaggacgcccactctcagggtgcagctgactgcagtcgtgggctggaggtgaggacgtccgtggggtcctcgaggtagaacgcttaccgtcgtcgtacaacgtacgtttcgaggtactacgtacgttactaacgtacttactaattacgtaaccncgtgggttacgaccgtacggaccggcccgtggacgaagggtcttggaggtcggagtacggngtgaactacgaaaccgttaggtaggtacgtacgacgacacgtcgtactcgaccgaggacgttacgggtcgagggtacgtacggtcaccgagtacggaggtacggtacgacgtaccgaccggacgtacgaccggtacgtccggaacttacggtaaacggtaccttaacgtacgtacgtacggttaacgtccggaaggacccggtaggtacccggtttaccgtttaccgttacggtcggtaacggaccgggtaacccggtacccggttaccggggacgggggtaacccgggggttaccttaacccggggtaccggttaccggtaccggttacccgggg

SEQ ID NO: 121750 - DNA, 738 bp, Homo sapiens
  misc_feature: GYAE6OF02HLR3J.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggacgccgtgggcctcgagtgaacgtctctcctgactaagcttcgtggaactacgtacggttacaaccgtacttacgttaataactaacgtaacggttggggtacgaccggtaacggaccgggtcccctagggaaccggacgggtacgttaggacggtagggtagacggggataggacttacccgaaacccgttaaggtaggttacgggtacgaacgtaccgtaggtacccgttcgtaccggacctaacgtacgggaccggtttacccgggacggggtaccgtaaggggtcccctaaaccggtaggtttaaggacgggttcgggtaaccgaaccggtaacccgggaccgaacgggacgtacccggaaccggtacccgtaacgtaagtaacccgggtaaccttaaccgtagttacgtacggtaaagtccggtagacgtaaccggtacgttaccgttttacgtcgtcggtcggacggtaccgtcccggaagggtaccggggtaccgggccttacgggtaccgtacgagtacccggg

SEQ ID NO: 121751 - DNA, 916 bp, Homo sapiens
  misc_feature: GYAE6OF02JIIMN.41.2.A02.1.454.CMB.1.raw
  modified_base (168)..(168): a, c, t, g, unknown or other
  misc_feature (168)..(168): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccctctttcgtggtggcagcaggccaacgagggacncccactctcagggtgcagctgataggcagttcgngggtcnggaggtggaaggaagcccggtggggccctacgagtacgaacgtccttccgtccgtagaccgaagtacctttcgtaggtaataacggtacggttacctaaaccgtctttaacgtttaactaactaaccgtacggtggggtccggtacgtaccgtacccggggtaccccgtagggaccggtaaacgggttaccgttaggtaggttacgggtaggtacgggaaggtaggtaaccgtaaccctaaaacgggtaacgtagggtacggttaacgaacccgtacgaaccgggtcccgttcgtaacggtacccgaaccgggtaagggtttacccgggtaccgggtaaaccggggtaccggggtttaaaccggcccggttaaacccggtaggttacggggtaaacggggttacggggtaaccgggtaacccggtacccggggaaccgtaaaccggtaaccgggaccccggtaaccgggttacccgaaccgttaacggtaaaccggtaaacccttaccggtaacggttaaccgttacggtaacgttaccggtaaaccgggaacggttaaccggttacccgggttacccgttttaacggtaccggttaacggtacccgggttaacggaccccggtaaccccggttaggggaacccggggtaaccgggggttaacccctaacgggtttacccggtacgggttaccggttaaccccggggg

SEQ ID NO: 121752 - DNA, 852 bp, Homo sapiens
  misc_feature: GYAE6OF02GMVUL.41.2.A02.1.454.CMB.1.raw
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (257)..(257): a, c, t, g, unknown or other
  misc_feature (257)..(257): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccctcttcgttggtggacagcagccacgaggcgcccactctcgaggtgctacggntagntgcgtagtcggtgggctggagggtgaaggacgtccggtcggggtcctgagtcgaacgtcctctccnggacaacgtaccgttcgtagaacgttacgtacggttacgaaccgtacgtttactaattactaactcgggtcggtacggactaaccggacggtccgtacgggtacggtacgggtacgtttcgggaagggtggtaacggggtgggtaagtggtaaccttaaccggtaaaccgtaagggttaggtacggtaaggaccgtaaacgtctacccgtacggtacgtaccgaaacgtacggggtaaccggttacccggaacggggtacggttaaccgggtaccgaaaccggtggtacgggttaaccgggtggggtaaccgaacccgggtacgggaacccgaagggtaccgaccggtaaaccggtcccgaactacggtttaacggtaaccctacggttacgtaccggttacgggtaacgttaacggtcgggaaacggttaacccggttccgggtttaacccggttttaccgacgggtttaccgggagggtaaccccgggtaaaccccggttccccggggttaacggggggaaaccccggggggttcccggggttaaaccctttacccgggtaaacggtttccggtaaacccggggttcccgggg

SEQ ID NO: 121753 - DNA, 666 bp, Homo sapiens
  misc_feature: GYAE6OF02GVDTO.41.2.A02.1.454.CMB.1.raw
  modified_base (158)..(158): a, c, t, g, unknown or other
  misc_feature (158)..(158): n is a, c, g, or t
  modified_base (199)..(199): a, c, t, g, unknown or other
  misc_feature (199)..(199): n is a, c, g, or t
  modified_base (565)..(565): a, c, t, g, unknown or other
  misc_feature (565)..(565): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccgtcttcgttggtggcagcagccanaggacgcccatctcagggtcgacagctgatcgactagtcgnggggactggaggtgaggacgtccgtggggcctgaggtagaacgctccgtccgtagactaagtaccttcgacggtaactacgtaggttaccaaccggtactttactaacttacttaacgacgttggggtcgacgtacgtaccggcccgtagggacgtagggaccttggagtcggaggtcggtagtcggaactaccgaaccgttaagcgggtacgtcgaacgacgtacgtcctaccgtagccacgtacgtacgggtaccgagggtaccgtacgggacctaaccggtggtaacggtgggtaacgtacgacggccgggaactacgggacaccgaccgggtaaccacgagttaccggtaactacgacgttnaacgtagtcgacgaacgacggtacgttcgttacgtgtcgtagtaccggacctccgaggggtacgggtcgggtaccctacgggtacgttcggtacgtacggg

SEQ ID NO: 121754 - DNA, 756 bp, Homo sapiens
  misc_feature: GYAE6OF02GRMBN.41.2.A02.1.454.CMB.1.raw
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccttcttcttggtggcagcagccacgaggacncccactctcgaggtcgcagctgatgcngtcgtgggctaggaggtgaggacgccggtgggcctgaggtgacgtctctcctacgacaacgtacttgtacgactaacgtacgttacgaacgttaccttactaacttactaccgtaggttcggggtactaccgaccgtaccggtccccgtaggaaccggtagggtacgttacggaggtaggtaggtaggtacgtacggtaactaacccgtaaaccgtagggtacggttacggtacgaaccgtacgacgtccgtcgacgtaccgtaacggtacggttaccgggtaccggagggtacccgtacgggacctaacggtaggtggtacggtacgggtaccgaaccggtacggtcccgaaggtaccgtaacccggttaccggacccgtaagtaccggtaaaccgttaccttacgtacggttacgtaacggtacgttacggtacggaacccggtacgttacccggttacgttacgtttcggtcgtaccggacccggtaccccggtacccggttacgggggtacccggggaccggggttaccctaaccgggtacgttacggaccggttcccggg

SEQ ID NO: 121755 - DNA, 901 bp, Homo sapiens
  misc_feature: GYAE6OF02IGAVJ.41.2.A02.1.454.CMB.1.raw
  modified_base (154)..(154): a, c, t, g, unknown or other
  misc_feature (154)..(154): n is a, c, g, or t
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
tcagtctatactatcacgaccggtgctcgatttagactcatctacgagggggagcatccacccagcaaccacatctgtcctctagagacgtcccctgagagccttcccgttcctcaccagtggactggacctgggaggactcctcttcgttggngacagcagcccacgaggacgcccactcctcgaggtcgcacgtctgntcgccaggttccggaggggtntggaaggtcggaaacggtacggccggttcggggccttacggaaggtcggaaaccgtcccgttaccgtcctacgaaccgtaacgttaccgttcgttaggaacttaacggtacggtaacgtaaccttcttaagtacttagtaacgtcggtaggccgacgacgtaacccggcccgtaacgggaacggacggtaccgttagggaagtcggtaaggtggtaaaggttcggaaaccgacccgttaaaaccgtaagggacggttagtaccggtaaaccaacggtaccttcccggtacgtacgaaaccggtacgggtaccggggttaaagtacccgggaagggtttaacgtaaccggggtacccaacccggtaaggttaaggggtaccgggtacggttaccgggaaccgtaaccggaaaccggaacgggaccgttaacggaacccgttaaccggtaaaccggtaccgtaaccgggttaaaacttacccgtaaacggtaacccgttaagggtaagtacccggttaagggaacccgtaccggtttaaccgtttacccggtttaacgttaccggttacgggtaccggtaaccccgggtacggaaccccccgggtagggtaaaccggggggttacccggggtaacccgttaacgggtttaccccggtaccggttaccgggttaaccccgggg

SEQ ID NO: 121756 - DNA, 657 bp, Homo sapiens
  misc_feature: GYAE6OF02FU7VU.41.2.A02.1.454.CMB.1.raw
  modified_base (98)..(98): a, c, t, g, unknown or other
  misc_feature (98)..(98): n is a, c, g, or t
  modified_base (164)..(164): a, c, t, g, unknown or other
  misc_feature (164)..(164): n is a, c, g, or t
  modified_base (226)..(226): a, c, t, g, unknown or other
  misc_feature (226)..(226): n is a, c, g, or t
tcagtctatactatcacgaccggtgctcgatttagactcatctacagggggagcatcacccagcaaccacatctgtcctctagagagtcccctgacgngctccgttcctcaccatggactggacctggaggatcctcttcgttggtggacagcagccacaggancccatctcgaggtgcagctgatgcagtcgtggggctgaggtggaggagccgtggggcctcgngtagacgctaccgtcgtgacagtacttcgtaggtatacgtaggttaccaaacgtacttcgttaatacgtaacgcggttgggcgcgtaccgtaaccgggccccttagggaacgacggggtagttacgtagggtacgggtaggtagggagttcgggtaactaccccgtaaaccggtaaagaggttacgggagaacggtaaccacggctacgtacacccgtacgaggttaccgggttcgaacgggtccgacgggtaccacgtagtcggacggttggacgacggaccggtaccacggacgtccgaaaccgggtccaagaccgtacggtaaccttaccgagttcgagtaccgtgcggtagaccgtcgttcgttacgtccgttgaccgcggaacgccggtaggacgggccgggtcgtacgtacgtacgtgtaccggg

SEQ ID NO: 121757 - DNA, 806 bp, Homo sapiens
  misc_feature: GYAE6OF02F8H3Q.41.2.A02.1.454.CMB.1.raw
  modified_base (184)..(184): a, c, t, g, unknown or other
  misc_feature (184)..(184): n is a, c, g, or t
tcagtctatactatcacgaccggtgctcgatttagactcatctacagggggagcatcacccagcaaccacatctgtcctctagagagtcccctgagagctccgttctcaccatggactgactggaggatcctcttcttggtggcagcagccacgaggacgcccactctccgaggtgcacgctgngtcgacgtcgtcgtgggtctgggtaggttaggaacggtaacggccggttcggggcccttacggaggtggtaacgtccgtcgtacccgtagtacgaagttaccgttcgaggttaacgtaacgtacgttacctaaacggttaccttacgttaactaactaccgtaccggttagggttcgaccgtaaccggaccggttcccgaggaccgtaagggtccgttaggtaacggttcggtaggtacggggtacgtggtaaccgttaaccggtaaccgttagggtaacggttcggtaccggtacgtaacggccgtacctacggtaccgaacgtacggtaacggttacgtccggaacgggtaccggtacggtacgtacgtacgtggtaaggttccggagacccggtacggtaccaacgggtacgaaccggtaccgacgtaacgacggttaaccgaaccgtttaccgtactaacggttaccgaacgttaccgggtaacgaaccggtaccgttaccggttaccgtttaccgtcggttacgtaccgggacggtaaccccggtcccggtacggggtaaccggggtaccgggtacccggttacggtaacccggtttaccggaggttaaccccgggg

SEQ ID NO: 121758 - DNA, 805 bp, Homo sapiens
  misc_feature: GYAE6OF02G4VTC.41.2.A02.1.454.CMB.1.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
tcagtctatactatcacgaccggtgctcgatttagactcatctacagggggagcgatcacccagcaaccacatctgtcctctagagagtcccctgagagctccggttcctccaccatggactggacctggaggatcctcttcttgggtggcagcagccacaggagcccactctcaggttgcagcctgatgcagtctggggctgaggtgaggaacgccgtggggcctnagtgaagtcctctcctgcaagaccttntcggactacgacggttacaaaccggtactttacgtacttaactaacctacgttacgggtggtaccggtaacgtaacgggtcccccttaggaccgtacggggtaacttcggaaggttaggtaagtggggaagttgggaacttaccaaacccgttaaggtacggtgggttaagaaccgtaaccgacggtcccttacgtcgaccgactaagggtacgggttacccgagggtccgtaacggggttccaaacccgttagtacggtacggttacgggttacggaccggtaacccgggacctaaccggaaggacccgtaacgggtacccgaaaccgtaacgggtttaccggtaaacccgtttaaccggtacgttaccgttaacgggttaaaccgttcggtacggttaaacgggacccgttaaccgggttacccggtttttaactttaccggttcgttccgggtaaccggccgggtaacccccggccggttaacgggggaaaccggggggggttaccccttaaccgggtacccgggttaccggttaacggtaacccggg

SEQ ID NO: 121759 - DNA, 898 bp, Homo sapiens
  misc_feature: GYAE6OF02G2JBO.41.2.A02.1.454.CMB.1.raw
  modified_base (205)..(205): a, c, t, g, unknown or other
  misc_feature (205)..(205): n is a, c, g, or t
tcagtctatactatcacgaccggtgctcgatttagactcatctacagggggagcatcacccagcaaccgcatctgtcctctagagagtcccctgagagctccgttcctcaccatggactggacctgggaggatcctcttcttgggtggcagcagccacagtgacgccccactctccagggtgcagctgagtgcaggtcgtggggntggagggtggagggaacgccggtggggcctacgaggtaggaacgtcctcgtcctaggacaaagtacttcgtaaggtactacggtacggtttacgaaacgtaccgtttataacttaacgtaacggtacgttacgggggtacgccggtaaaccggccgggtacccccggtaggaaccggtaaggggtacccttttaggggaaggtttacgggggagttacggggggtaattaccggggtaaaccttaaacccgggtaaaaccccggtttaaaaggggtacgggtttaacggggtaaccgtaaaccggaaccccgtaaacggggtttcccccttacgggtaacggttaacccgaaccggggttaaacggggtaccggggtttaacccggggtaacggggtaccggggtaacgggggttaacccaaaccggttacggtacggggttaacgggttcggggttaacgggaaccgggtaacccgggaacccgacgggaccggtaaccggtacccggtaaccgaacgtacggtaaaccgttaaccggttaaccgtacggtacgttaagggtaaccgtagtaccgggaacggtaccgttaccgggtttacgttaccgttccggtacggttaccggacgtacccggtaccgggtacggtaccgggggaccgggttacctaacggttccggacgttaaccgggg

SEQ ID NO: 121760 - DNA, 858 bp, Homo sapiens
  misc_feature: GYAE6OF02GIBX1.41.2.A02.1.454.CMB.1.raw
  modified_base (213)..(213): a, c, t, g, unknown or other
  misc_feature (213)..(213): n is a, c, g, or t
tcagtctatactatcacgaccggtgctcgatttagactcatctacagggggagcatcaccagcaaccacatctgtcctctagagacgtccctgagacgtctccgttcctcaccatggactggacctgggagatcctcttcttggtcggacagccacgccaacgaggacgcccacgtctacgaggtcgccagtctagagtcgcgtaggttccgnggggtcttaggcgggttagaaggacgccggtcgggacctagaggtacggaactccgtctccgtgaacgaacgtccgttcgtagggaactacggtaggttaccaaacggttcctttagacgttaaactacggtaacggttgggtaccgacgggaaccgtaccggtacccgtacgggaaccggtaagggtcccgtttaggacgggttcggtacggttggacgttacggaaacgttacccgaaaccggtagtaccgggttaggaccgtaaaacgcccgttaacggttccaccggggttaccaagggtaaccgtttaacggtcgggtacccgtaacggggtccgtaacggggtaaccctacggtaacggttggggtaaccggttaacggaccgggtacccgaaccgggacggaacccgtacggtaaccggttaccccgggaacaaccgggttaacggtaccccggttaagtccccgtaaacgggtttccgaacggttaaccgcgttacggggaacccgttaccttaccgggttacgtttcccgtttagggaaccgccgggttaacccgacccgggttaccccggacggggtaacccgggggtcccggtaaccgtttaccggtaccggggtacgaccggggtttaccggg

SEQ ID NO: 121761 - DNA, 718 bp, Homo sapiens
  misc_feature: GYAE6OF02H58FK.41.2.A02.1.454.CMB.1.raw
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (503)..(503): a, c, t, g, unknown or other
  misc_feature (503)..(503): n is a, c, g, or t
tcagtctatactatcacgaccggtgctcgatttagactcatctacgagggggagcatccaaccccagccaaccacatctgtcctctagagacgtcccctgagagcttcccgtttcctcaccatcggactggaccgtggaggatccttcttcgttggttggcagccngccagaggcncccacgtctcgaggtgacngctgatgtacgaggtccggtgggtcgtggaggtaggaacggtacggccggtcggggtacctcgtaggacgacgtcgtacctcgtacggactaacgtacttcgagacttacgtaggtacaacgttcttactaatacgtaacgtcggtaggccacggtaccgacgtcccgaggacggtacggtaccgtggngttagggagtacggngtacggacctaaccgttaaggaacggtagtacggtaacgacgtaactcccgtcgtctacccggtgaaacggtccggtaaggtaccgacgggcgtaccgggaccncgtaagtaggtacgtcgggtacgaaccgcggaccgtaacgaccggtcgaccgataaccggtacgtaacggaacccgttgacgttacgtaggtacgtacggtaacgaccggaccgtacggtttccttaccgttggtacgtccggaccggacccggttaccccggagggtcggggacccggtccgttacgggtacggtttacggacgggttacccgg

SEQ ID NO: 121762 - DNA, 770 bp, Homo sapiens
  misc_feature: GYAE6OF02II7N2.41.2.A02.1.454.CMB.1.raw
  modified_base (164)..(164): a, c, t, g, unknown or other
  misc_feature (164)..(164): n is a, c, g, or t
tcagtctatactatcacgaccggtgctcgatttagactcatctacagggggagcatcacccagcaaccacatctgtcctctagagagtcccctgagagcctccgttctcaccatggactggacctggaggatccttcttcgttggtggcagcagccacaggacnccctactctcgaggtgcagtctgatcggcaggttcgtagggctaggaggtgaggacgccggtggggcctcgaggttacgacgtctcctcgtagcaacgtacgttcgtggtactacgtacggttacaacggtactttacgttataacgtacgtacgttcggggtacgaccgtaccggtaccggtaccccgtaggtacgtaacggggtacgttaggtaacgggtagggtacgggtagggtagtcgggtaacctaaccgtaaaccggtaaagggtacgttacgggtaaccggacgaacccgtaacggttcccttacggttaccggacccgttaacgtaccggggtaacgggttacccgggtacgggtacggaacgggtaaccgtaacccggaagttacgggtacggggttaccggacggacccggtaaccgggaccgacggtaaccggtaccgaccggtacaccggtacgtaaccggtacctaacgtacgttagtaccgagtcgtaggaccgtacgtaccgttccgttacgttcggtcggtcggacgaccggtacccggtagggtaccgggtacggggtcccgtaccggtaccggtcgtaggtaccggg

SEQ ID NO: 121763 - DNA, 636 bp, Homo sapiens
  misc_feature: GYAE6OF02H5NG5.41.2.A02.1.454.CMB.1.raw
  modified_base (373)..(373): a, c, t, g, unknown or other
  misc_feature (373)..(373): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagccccactctcgaggtgcagctgatgcgagtcgtggggctggaggtgaggagccgtggggcctcgagtgaagtctctcctgcaagtacttcgtaggactacgacggttaccaacgtacttcgtatactacacgtgggtcgcgacgacggccccgtaggacgagggtactggagtggagtggatggactaccgaacctaaggagtggagacanacgcctctgacacgagtacggtcgaggtacgtagggttacagtgtaggtcggtagacgacggccacggacgccgaccggttaccacgtaagacggtaacctaacgacggtacaggtaacgttcgagggacgtacccgtaacggttcccgttttacgttacggttcggtacgtcccgggtaccgtacccggtacccgggttaacggggacccggggggtaccttaccggttacccggttcggttacggtaccgggtcccggggg

SEQ ID NO: 121764 - DNA, 709 bp, Homo sapiens
  misc_feature: GYAE6OF02GPFK6.41.2.A02.1.454.CMB.1.raw
  modified_base (356)..(356): a, c, t, g, unknown or other
  misc_feature (356)..(356): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctggaggtgaggaagcctggggcctcgagtgaagctctcctgcaagtacttctggatacgaggttacaacgtacttctatactactacgtggtgcgacgacggcccgtaggacgagggtacttaggagttcggagtcgggattaggactacgaaaccgtaagnggtaggtagactacgacgtcctactcgacacgtacgtacgggttaccgacgggtaccgtacggggtacctaacccgtagtcgggtacggttacgggtacggaacccgtaccgggacccgaaccggaacggtaccgaaccggtacccaaacgacgttacgggtaaacctttacccggaacgtttacgtaggtaacccgtagtaccgggaaggtacccggtacccgggttaccgttttaccgttcggttacggtacggtaccggtaacccggtccccggtagggttacccggggggaaaccggggggttacccttaaccgggtacccgggttaccgttaacggggtaacccgggg

SEQ ID NO: 121765 - DNA, 771 bp, Homo sapiens
  misc_feature: GYAE6OF02JNJ8N.41.2.A02.1.454.CMB.1.raw
  modified_base (610)..(610): a, c, t, g, unknown or other
  misc_feature (610)..(610): n is a, c, g, or t
  modified_base (632)..(632): a, c, t, g, unknown or other
  misc_feature (632)..(632): n is a, c, g, or t
tcagtctatactatcacgaccggtgctcgatttagactcatctacagggggagcatcacccagcaaccacatctgtcctctagagacgtcccctgagagctccgttcctcaccatggactggacctgggaggactcctctttcgttgggtggcagcacgcccacgaggacgtccccactctcgagggtgcagtcgtggactcgccgtaggtcggtagggggtcttagggaggggtacggaagggtaaccgtccgggtacggggtacccttcgaaggtacggaacgtccttccgttaccgtcggaactaacggtaccgttcgtaggtaacgtaacgtacggttacaaccgttactttactataacttacgtacggtcggtacgaccggaacgtcccggtccgtaggaacggtacggtacgttggaacgttgggaggtgggtactaggtaacgttaccggaaacgttaagggcggttacggaacgacgagtccgtacccgtgtacgaccgtagtacggaccggtacggtaacgggtcgtacggtacacgtaggtaggtcggtacggtaccgacggaccggttacgaacgggcgtaacccggtacggtaaccncggtaacgtacgggttaacccncgtacggtacgtacgttaaggtccgaggtaccggaaccgtcggtttctttaggaccggtgaccggtaccgacccggttacccgggtacggtccgggggtaccgggtacttcgggtaacccggttggtaacccggtcggg

SEQ ID NO: 121766 - DNA, 719 bp, Homo sapiens
  misc_feature: GYAE6OF02JC9H3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtggggcctcgagtgagctctcctgacaagacttctaggtactacgaggttcaacgtactttctaatatacagtgggtgcgacacggccctggacgaggacgttgaggtggtagtgggagtggacgtacgaaccgtaggtagttagggcgaacgactacgtacctcggtacacccgaacgtaggtccggttaccggaggggaccggtacgggtaaccgaccgtacgtagggtaacggttaggtaccggaaccggtaccggaccggaaacggacggtaccgaaacccggttacccaacggtacgtaaccggttaaaccgttacccgtaacggttcccgttaaggtacggtttaccggtacggtaaacggaccggttaacccggtttaccgtttacccgtttacggtcggttaccggtaaccggtacccggtacccgggtaccgggttacggggggtaacccggggggtacccttaaccgggttaccgggtacggttacggttaacccggggg

SEQ ID NO: 121767 - DNA, 844 bp, Homo sapiens
  misc_feature: GYAE6OF02HIC0J.41.2.A02.1.454.CMB.1.raw
  modified_base (183)..(183): a, c, t, g, unknown or other
  misc_feature (183)..(183): n is a, c, g, or t
  modified_base (201)..(201): a, c, t, g, unknown or other
  misc_feature (201)..(201): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtcggcagcacgccacgaggacgccccactcctcgaggtcncgagctgatcgcagtcgngggcgtggacggtgaacgggacgtccggtcgggtcctacgaggtacgaacgtccttccgtctcgaactaacgtaccgttcgtaggtactaacgtaggttaccaacgttacttactaatactacgacgttgggtcgaccgaccgaccggtcccgtacgggaacgtacgggtacgttggacggttaggagtggtaagtacggaaactacccgtaaaaccgtaaggtcggtacggtagaacctacggactccgtacgcgaacctacggtaacgggttaccgggtaccgaacggggtcgtaaccggggttacccacggtaagtacggggtaacgtacggggtaccggtaaacccggccggtaaacccgggacgggtaacccggtccgaaccccgggttaacaacccggtttacggtaaccgggttaaaccccttggtaaccgttacgttaaccggtaacgttcccggaaagggttaaccgaacccgggttttacccgggtacccttttttacgtacccgggttaggtaccccggtaaccggtaacccccggtacccggggttacgggtaacccggggggggttacccggggttacccgtttaacccggggtaacccgggtttacggtaaccgggtttaccccggggg

SEQ ID NO: 121768 - DNA, 1050 bp, Homo sapiens
  misc_feature: GYAE6OF02GS1VQ.41.2.A02.1.454.CMB.1.raw
tcagtctatactatcacgaccggtgctcgatttagactcatctacgagggggagcatcacccagcaaccacatctgtcctctagagacgtcccctgagagcttccgttcctcaccagtggactggaccgtggaggacttcccttcttcgttgggtggcgagcgacgccacgacggacgcccactctcgaggtgacacgctgagtcgcgtacgtcggtcggggtacgtgggtaagggtacggaagggaacggtcccgggtcggggtacccttacggtaaggttacggaaccggtccgtttaccgttacccgtacggaaccgtaaacggttaaccgttttacggtaacgggtaaaccgttaaccggttaaccgggttaaccgtaaaccggttaacctttaacttaaacgtttaaccggtaaccggttacggggttacgggggtacggtaaccggtaacccgggtaaccccgggttaccccgggtaacggggtaaccgggtaaacggggttccgtttaggggtaacgggttagggttaagggttaacggggtacgttacgggtaaaccgttaaaccccgggtaaaaacccggtttaagggtacgggttaacggttaacgaacccgtaccgttaacccggttaccgttacccggtaaccggtaccggtaacccggttaacgggggttaaccggttccgggaaaccggggttaaccggaaccggggttaaccctaaacgggtggttaaccggggttacgggtacccgggtaaccggaaacccgggttaacccgggcgtaaaccggtaccgtacccgggtacccgtacgaaacccgtcgggttaaaccgtaaccgttaccgtaacggtacggaaccgttaaggtaccggtacggaacggttacccgttaacccggtttacgtttacccggttcgtaacgggtaaccggtaccccggtaacccggggtaacccggttacccggggggtaaccgggggttaacccgggttacccttaacccgggtttacccggttaaccgggacccgggttaccgggg

SEQ ID NO: 121769 - DNA, 699 bp, Homo sapiens
  misc_feature: GYAE6OF02G4D0V.41.2.A02.1.454.CMB.1.raw
  modified_base (566)..(566): a, c, t, g, unknown or other
  misc_feature (566)..(566): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtgggctggaggtgaggagccgtcggggcctcgaggtacgaacgctccgtcgtacgacgtaacgtcttacgtaggtaactaaccgtacggttaccaaacgttacttactaacttaactaccgtaacggttcgggacgtaccggtaacgaacccgggccccgtaaggaccgaagggtactcgggaaggtcgggtaggtcggggtagtacggtaactaaccggtaaaccgtaggtacggttagggacgaacgacgaacgtccttcgacgaccgaacgtacggtaacggttcggaacgggtcggaacggtccacgtaggtcggtaggtcggacgacgaccgacgaagcgtacgaccgtacagacgtacgtactaacgngtactacggtacgttacgagaaccgggtacgtacgggttttaccttcgttacggtcgacggcccgtacccggacccgggtggtaaccgggggtacccgggttccttaacggacggttaccgacggtaccgggg

SEQ ID NO: 121770 - DNA, 727 bp, Homo sapiens
  misc_feature: GYAE6OF02JEN5I.41.2.A02.1.454.CMB.1.raw
  modified_base (264)..(264): a, c, t, g, unknown or other
  misc_feature (264)..(264): n is a, c, g, or t
tcagtctatactatcacgaccggtgctcgatttagactcatctacagggggagcatcacccagcaaaccacatctgtcctctagagagtccctgagagctccgttcctcaccatggactggacctggaggaatcctcttcttggtggcagcagccacgaggacgcccactctcaggtgcagctgatgcaggtcgtggggctggaggtaggaaggacggccgtcggggcctcgagtagaacgctcctcctgacaaagtacttcgngaatacgaggttaccgaacgtacttactaatatacgacggtggtcgcgtacgaccggtacccgtggacgacggtacgtggagtggtagtcggtatcggactaaccgaaaccgtagtacggtagggtacaacgtacgacgtccgtacgtacgaccacgtacggtacgggtaccgaggggaccggtaacgggtaccaacgacggttagggtaacggttggggtaaccgacccgggaacccgggaccgaacggtaaccgaccggtaaccggtacccacgtaacggttacggtaaacccttcgacggtttacgaacgttaacgtcgtaacgggaaccgtaccgttaccggttttacgtttacgttacggttacggaccgggaccgtaacccgggtacccgggttagggtacccggggggtaaccggggtcccttaacggggtaaccggttacggtaccggtacgggg

SEQ ID NO: 121771 - DNA, 1038 bp, Homo sapiens
  misc_feature: GYAE6OF02GDTJI.41.2.A02.1.454.CMB.1.raw
tcagtctatactatcacgaccggtgctcgatttagactcatctacagggggagcatcacccagcaaccacatctgtcctctagagacgtcccctgagacgcttccgttcctccaccatcggactcggacctggaggactcctcttcgttggtggcagcacgccacgaggacgcccactctcgaggtcgcagtctggattcgcgtacggtcggtacgggggtctagggtagggtggaacgggaacggtcccggttcgggggacccttacggtaaggtacggaaccgtccttaccgttcccgtaggacctaaacggtaacctttcggtacgggtaacttaaccggtaacggttaacccgtaaaccgttaccgtttaacttaacgttaaactaacccgtaacggttcgggggttaccgaaccggtaaccgtaaccccggggaccccggttaccgggaaccggtaacgggggttaacccgttagggtaccgggttaagggtaacggttcgggggtaacgtgggtaaaccgtaacccgttaaaaccccgtaaaggggtacggttaaggggttaccggaactaacggtaccgtacccttacggtccggaacctaacggtaaccgggttacgggttaacccggaacgggggttaaccgtaacgggggttacccgaaaccggtaacggttacgggggttaacggttacgggggttaccgtaaacccgggacccgggtaacccgaaccggggacggtaccccgggtaaacccgggttaccccgtaaggtaacccgggttaaaccgggttaaaccgtttaaacccggtaccggttacggttaacggtaaacggtttcccggttaacggggtaaacccggtaccggtttaaacccgggtttccccgttttaaacggttcccgttaacggggttccggaaacccgggtacccggtacccccggggtagggggttaacccggggggaacccggggggttaccggttaaacccgttacccggggttaccggttaccgggttaaccccggggg

SEQ ID NO: 121772 - DNA, 668 bp, Homo sapiens
  misc_feature: GYAE6OF02IMUD4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcgagtgaagctctcctgcaagtacttctggatacgtacggttacaacgtacttactatatacagtgggtcgcgacgacggtcccctgggacgacgggtcttaggagtaggagtgggatgggactaccgaaaccgtaaggagtcgggtagaccgtaacgacgtcccgtatcgacaacgtaggtacgggttaccgacggggtacgacgggtaccaaccgtagtagggtaggtggtacggccgaacggacccgtacggacgaccgtaccggtaccaacgagtacggtaacccttacggtaagttcgtacgtaagttccggaggaaccggtacgtaccggttacccgttttaacgttcgtaggtccggtaccgggtacccggtaccccggttacgggtaccgggggtaccgggggtacccttaaccgggtaccggttcgtacggttacccggg

SEQ ID NO: 121773 - DNA, 792 bp, Homo sapiens
  misc_feature: GYAE6OF02FP1AY.41.2.A02.1.454.CMB.1.raw
  modified_base (218)..(218): a, c, t, g, unknown or other
  misc_feature (218)..(218): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctnagtgagctctcctgacaagtcttcgtggactacgtaggttaccaacgtacttatatactactacggtgggtcgacgacgaccggtacccctagggaaccgtagggtaccgttggaggttggacgtagggtacgtacggtactaaccgtaaacccgtaaggtacggtagggttacgaaccgtaacgaacgttcccgtcgtacgaccgtaacgacgggttaacggtttacccgggaaggggtaccggtacgggtaacccgtaccgtaaggttaccgggtacgggttaagggaacccggtaccgaaccgggggtacccaaaccgggtaccgacccggttacgggttaaccccaacgggttaaacggttaacggtaacccggtttaacgtacgggtttaaccacggtttaaccggtcgtaaacggtaaccggggtaacccttaccgggtttacccgtttttaccggtccggttcggttacccggaccggttaacccgggtacccggttacgggacccgggggtaacccgggggttacccctttaagggacccggtttccggtaacgggttacccgggg

SEQ ID NO: 121774 - DNA, 777 bp, Homo sapiens
  misc_feature: GYAE6OF02H5SQP.41.2.A02.1.454.CMB.1.raw
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagtctatactatcacgaccggtgctcgatttagactcatctacagggggagcatcacccagcaaccacatctgtcctctagagacgtcccctgagagctccgttcctcaccatggactggacctggaggatccttctttcgttggtggcacgcagccacgaggacgcccactctcgaggtgcagctgatgctagtcgtgggactggaggtggaaggaggtccgtgggcctacgaggtgaacgtctccgtcgtagactaacgtacttcgaggtacttaggtacgttacaacgttccttagtaatacgtaagcgggttaggagccggaacgtccgggcccgtaggaccggtacggtacgttagggngtaagggnggttagggaagtacggtaacctaaccgttaaaaccgtagggtacggttacggtaacgaaccgtaacgtaccgccttggacgacctaaacggcggtttaaccggtacgggaacgggtacgccggtaacacggtaggttagggtcgggtacggtaaccgacgggaaccggaccgtacgtaacgggcctaaccggtccaagttaaacggtacccgtaaaccttaccgggtcgtaaacggtttaagtccgttaacggtaaccggaacgtaacccgggttacccgtttacgttttcccggtaggtccggtaccggacccgggtaacccggtaccggtccgggggttaaaccgggggcccgggttaaccgtttaccgggtttaaacggccggtttaaccgggttccggg

SEQ ID NO: 121775 - DNA, 731 bp, Homo sapiens
  misc_feature: GYAE6OF02GOUYD.41.2.A02.1.454.CMB.1.raw
  modified_base (354)..(354): a, c, t, g, unknown or other
  misc_feature (354)..(354): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcaggcacgccacgaggacgcccactctcgaggtgcagctgatgcagtcgtgggctggaggtgaggagccgtggggcctcgagtgaagctctcgtgacaagtcttcgaggaactacgtacggttacaacgtacttactagtaatacgtacggtgggtacgacgacgaccggtccgtaggaacgagggtactggaagtgggaagtgggngtacgacgtacaaaccgtaagtgtaggtacgactaacgcgtcctaggtcacgaagtacggtagggttccggacgggacgtaacgggtaccaacggtacgtagggtacgggtacggggtaacgaccgggtaaccggaccgaacgggaccgtaaccggtaacccggtccgaaacgttacggtaaaccggtaacgtttaacccggtacggttaacgttaggtaaacgttcggtaacggaacggtaaccggttacgtttacccgtttcgttacgggtcggttaaccggaaccgggttaccccggtaacccgggtccggggtaacggggggacccggggttaccgtaacggtttacgggtaccggtacgggttaacccgggg

SEQ ID NO: 121776 - DNA, 716 bp, Homo sapiens
  misc_feature: GYAE6OF02FW76H.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtggaggaagccgtcggggcctcgagtgaagctcggggggtcctgcaagtacttcgtggactacaggttcaacgtacgttctatatacacgtgggtcgcgacgacggccctaggacgagggaccttggacggtggtacgtagggagtggacgtactaaacccgtaagaggtggtagaacacacgacctctcgacacgacgtaggtttaccgaggggtacacggggtcaaccgtatcgggtaggtcggtagaacccgtacgggacccgaaggacgacccgtaacgggtccccacgtaacgtaaccggtaacgtttaacccgagttaccggtacggttaaacgtacgttaggtaaacgggtaaccgtaccggggtttccgttttaaacccgttcggtttcggttacgggacccggtaaccgggtaccccccggagggtttaacccgggggggtaacccgggggggttacccctaaaccggggtttacccgggttaccgtaaccggggttaaccccgggg

SEQ ID NO: 121777 - DNA, 871 bp, Homo sapiens
  misc_feature: GYAE6OF02HABLM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggccagcagccacgaggacgcccactctcgagggtgcgacggcttgatggctacggtcggtggggcgtggaggtcgagggaacgccggtacggggcctacggaggttacggaacgtccttccgtccgtacgaccgtaacgtacctttggtaggtaactacgtacggttaccgaacggttaccttacttactaactaaccgtacggtcggggttacgaccggtaaccggaaccggggtccccgtacggggaaaccgggtacgggggttaaccgttacggggtagggttacgggtaggggttaggggtacgtacggtaaccgtaacccgaaaaccgttaagggtacgggttagggtaacgaacgtaaccgtacggtcccgtctacggaccgaacggtcggtacgggtaccggaaggggtccggtaacggtacccaaacggtagtcgggtaaggtcgggtaacgtaccggaccgggaaccgaacggtaccggtaccgtaaccggtacccgtaagttacggtaaaccgggttaacccttacggtaacgttccgttaagtaacgttaaccggaggtaacccgggaccggttaccgggttacctttttacggtaccggttcggttaacggacccgggtaaccccggtcccgggtaaccggggtaccgggggggtacccgggttacccgttaacccgggtaaccgggttaccgtaccggggtttaacccggggg

SEQ ID NO: 121778 - DNA, 756 bp, Homo sapiens
  misc_feature: GYAE6OF02IDE39.41.2.A02.1.454.CMB.1.raw
  modified_base (369)..(369): a, c, t, g, unknown or other
  misc_feature (369)..(369): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctggtgcagcagccacgaggacgcccactctcgaggtcgcagctgatgcgagtcggtggggctgggaggtggaagggtacgccggtggggcctacgagtacgacgtctccgtactagacgtaacgtcgttcgtaaggacgtaacgtaggtaccgtaaacgtcttaacttaatactacgacggttcgggacgtaccggtaacgtccggtcccgtaaggaacggaccgggttntacgggtaagggttgggtacggtagggtacgtaggtaaacctaacccggtaacgtaagggtcgggttacgtaacggaaaaccgtcggtaacgttccctacggtaagaaccgtagggtaccggttaacgggaccgtagggaaccggtcgggtaccaacgtggttaggaacgggtacgttaccgggacgtaacccgggctaaaccgggcgtaacccggacgtaccgacgtacggttaaccgtacctaacgttcggacgtacgtacgtcgaacggacgtacccgtacggtttacctttcgttacgtcggaaccgtccggtaacccgtcccggaggggttaaccggggcccggttaaccgttccggtacgggtccgttaacggtcccgggg

SEQ ID NO: 121779 - DNA, 706 bp, Homo sapiens
  misc_feature: GYAE6OF02FZIED.41.2.A02.1.454.CMB.1.raw
  modified_base (53)..(53): a, c, t, g, unknown or other
  misc_feature (53)..(53): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
tcagtctatactatcacgaccggtgctcgatttagactcatctacagggggancatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgagagctgggcctnagtgaanctctctggcaagtcttcgtggaactacgtacggttaccaacgttacctttcgtaacttaacgtactaaccggttggggttacgaccgtaaccgaccggtcccccggttaggaccgtacggggtacttcggaggttaggagtggggaatggtactaccaaaccgtaaggtcgtaggtcgaactacgacggccttcgacggacaacgtacggtacgggttaccgagggtccgtaaggtaccccgagtaacgtggaacggttcggtaaccgacggtacccggacgaccgacggtaccgaccgtacccgaacgttacgtaaacggtaacccttacgaacgtttaccgaggtaaccttcgacggtaaaccggcccgtacggtttaccttttacgtacgttcgggtactaccggtaacccgtccccgggacggttaaccgggggccgggttaacccgtaccggtaccgggttaaccgtggtaaccccgggg

SEQ ID NO: 121780 - DNA, 775 bp, Homo sapiens
  misc_feature: GYAE6OF02GH3DZ.41.2.A02.1.454.CMB.1.raw
  modified_base (168)..(168): a, c, t, g, unknown or other
  misc_feature (168)..(168): n is a, c, g, or t
  modified_base (701)..(701): a, c, t, g, unknown or other
  misc_feature (701)..(701): n is a, c, g, or t
tcagtctatactatcacgaccggtgctcgatttagactcatctacagggggagcatcacccagcaaccacatctgtcctctagagagtcccctgagagctccgttcctcaccagtggactggacctggagactcctctttcgttgggtcggcagcagccacgaggacncccactcctcgaggtcgacagctggatcgcgtagttcggtgggcgtggtaggtagaaggaacggccggtcggggcctcgaggtaggaacgtccttccgtaccgtaggactaagtccgtttacgtaggtaactaacggttacggttaccgtaaccgttacttttacttaacttaacgttaacctacgggttcggggtacacccgaccggtacccggtacccccggtagggaaccgtacgggttacgttaggggacggttagggtaggtacgggtagtacggtaaccgtaacccggtaaccgtaaggtacgggttacgtaacgggaccaggtaccgtccgtactacgaccggacgtaaccggttcggaccggtacgggtaccgtacggtaaccgtacggtagtcggtacgggtggtaaccgacccggaaccggacgaaccggtcaccgggactaccgaccggtacgtaacgttacccttaggtacgtgtaaccgtagtacggagacgggtaccgttccggtttctacttcgggtntaacccgccggtaacccgtaccgggtacggtaccggggtccggtaccttacggtccggtacgttccggtacggg

SEQ ID NO: 121781 - DNA, 695 bp, Homo sapiens
  misc_feature: GYAE6OF02JKGHU.41.2.A02.1.454.CMB.1.raw
  modified_base (201)..(201): a, c, t, g, unknown or other
  misc_feature (201)..(201): n is a, c, g, or t
  modified_base (482)..(482): a, c, t, g, unknown or other
  misc_feature (482)..(482): n is a, c, g, or t
tcagtctatactatcacgaccggtgctcgatttagactcatctacagggggagcatcacccagcaaccacatctgtcctctagagagtcccctgagagctccgttcctcaccagtggactggacctggaggatcctcttcgttggtggcagcagccacgaggacgcccactctcgaggtcgcagctggatggctacgtcgnggggtctggacggtgacggaagtccggtacggggcctacgaggtacgacgtcctctcgtgacaagtccttcgtaggtactacgtcggttacaacgttacttcataacgtactaggtgggtcgaccgacgaccggcccgtaggtacgagggtactggaggtacggtagtggggtaatggaacctacgaaaccgtaggcgttaggacgtaacgacgactcctctagggaccaggaacgtcgtccgggtacggtaccgtacggggtaccacggtagtaacgggnggtaaccggttcggaaacccgcgggttaaccgacggaacggtaccgtcccgaacctagtaccgtaacgtaaccgttcacgggtttactaacggtcgcgtacgggaacctacggtacccgttccgtttatccggtggtaccggacggaccccggtcccgtacgggtacgggggtaaccggtcccgtaaggttaccgggtacgtaccggtacggg

SEQ ID NO: 121782 - DNA, 843 bp, Homo sapiens
  misc_feature: GYAE6OF02FUYQ1.41.2.A02.1.454.CMB.1.raw
  modified_base (241)..(241): a, c, t, g, unknown or other
  misc_feature (241)..(241): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccacaggacgccccactctcaggtgacagtctgatcgctagtcggtggggtactggacggtaggacggacggccgtggggtcctacgnggtacgaacgtctcctccgtgacgtacgtacgttgtaacgggtataacgtacggttaaccgtaaccgttactttacttaactacgttaccgtaacggttgggtacgaccggaacggcccggtacccgtaggggaccttaggggacgtttggaagggttgggtaggttacgggacgttaaccggacttaaaccccggtaaaacgttagggaccgggttaacgggtacggaacgaaccgtaccgggtcctttacgcgtaacccgtaacgggaaccggttaacggggtttaccggacggggtaccccgggtaacgggtacccgtaacgtagggtttaacggtacggggttaccgggtaccggtaaccgaccggttaccggaacgacccgggtacgtacccgggtaccaacggtacgttacggttaaccttacggtacgtaacggtagttacgtaggtaacggtacgtaacccggttccggtttaccttccgttaagggtcggttaccgggaaccggtaacccgggttacccgggtcggggttaacccggggggtaccgggttacccggtttaacccggtcggtttacggacgggttaaccccggg

SEQ ID NO: 121783 - DNA, 924 bp, Homo sapiens
  misc_feature: GYAE6OF02GIJS5.41.2.A02.1.454.CMB.1.raw
tcagtctatactatcacgaccggtgctcgatttagactcatctacagggggagcgatcacccagcaaccacatctgtcctctagagagtcccctgagagctccgttcctcaccatggactggacctggaggactccgtcttcgttggtggcagcagccacgaggagcccactctcgaggtgcgagcgtgagtgacgtaggttcggtgggtctaggagggtaggaagggaacggtcccggtcgggggtacccttacgtaaggtacggtaaacgtccgttaccgttcccgtacggtaaccgtaaacggttaccgttttacggtaacggtaacgttaaccggttaaccggtttaaccgtaaaaccccggttaccttttaaccgttaaactttaaaccgttaaaccgtaccgggtttacgggggttaccgacccggtaacccggacccgggttacccccggttagggaaaccgggttaaaccgggggtttaccgttaggggtaaacgggttacgggttaaacgggtagggggttaacggttacggtaaacccgttaacccgtaaaaccccgttaaagggtcgggttaacggtaccggtaccgtaacgtaaccggtcctcggtacacgtaccgtaggttacggtaccgacgggtacgtacggacctacgtagtacgtggtacgtacgaccgacggaccacggtaccgaccgtacccgacctacgtacgtaccggtaaccgttctaacgttaaccgtaggttaaccgttacgtaggtaaccggtaccgttacccggtttaccgtttaccggttaccgttaccggtcggtaacccgggtacccggtacccggtaccggggtaacccgggggtacccgggttaaccccgggtaacgggtttaccccggttaggtacccggttaaccccgggg

SEQ ID NO: 121784 - DNA, 734 bp, Homo sapiens
  misc_feature: GYAE6OF02FRC74.41.2.A02.1.454.CMB.1.raw
  modified_base (209)..(209): a, c, t, g, unknown or other
  misc_feature (209)..(209): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (466)..(466): a, c, t, g, unknown or other
  misc_feature (466)..(466): n is a, c, g, or t
tcagtctatactatcacgaccggtgctcgatttagactcatctacgagggggagcatcacccagcaaccacatctgtcctctagagagtcccctgagagtctccgttcctccaccatcggactggacctggaggatcctcttcgttggtggcagcagcccagaggtacgccctactcctcgaggtgcctagctgtactggctaggtcgngggtcgtggaggtaggaggacgtccggtacgggcctagaggtagacgtcgtcttccgtgaccgaagtaccgttcgtagtaacgtaacgtacggttaaccgaaccgttattcctaagttaacctaacgtcgggttggtacgaccgtaccgacccggtccggtaggaacggacggtcgtaggnggtacggtagtagggngtagtaccgtaacgttaaccgtaagggtacggtacgtacgaccgtacgacgttccgtacncggtaaccacggtaacggtccggtaccgcgggtacggaccgacccgtaagtggtacggtagtaggtacccgacgccggtacgaccggcgtaccgacgtcgtaaggccgtacgtaaccgtgtcgtgtaactcggtagtacggtaccgtacgtcccggtttagttcgttacgcggttaccggtacccggtaacccgtaccgggtacgggtacccggggtaacccggtttacgaacccggtttaccggttaggtaccccgggttcccgggg

SEQ ID NO: 121785 - DNA, 979 bp, Homo sapiens
  misc_feature: GYAE6OF02F8HQP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggagccccactcctcaggtgcagctgatgcagtcgtgggctgaggtagacggaacgccgtcggggcctacgagtaggaacgtcttccgtccgttcgacctaaagtacctttcgttaggtaacttaccgttaacggtttaccgaaaccggttaaccttttaccttaactttaacttaaccgttaaccggtttggggggttaccgaccggtaaccgtacccgggtcccccgtaagggaccggtaacggggtacgttttacggtacgggttggtaacggttggggtaacgttaggggtaaccttaaacccggtaaaaccccgttaaagggtacgggttagggtttacggaaccgaaccgtaacgggtacccctttaccgtaccgggaaccctaaccgggtaacggggttacccgggttttacccgggaaccgggggttaccggtaaccggggtaacccctaacccggtaagggtttaccgggtaaacggggtttcggggttaaccggaacccggtacccggggtaacccctaaaccgggaacccggtccggtaacccggggttaccaaccgggtaacggttaaacccggttaaaccgttaacccgttacgttaaccggttaaccgggttaaacgttacgggtacggtaaacggttaaccccggttaacccggtttaccgtttttaacccgttggttacggtaccggtaaccccgggtaaccgggttaccccccgggtaaggggttacccggggggttaccgggggggttaaaccctttaacccggggtttaccggttacccggttaaccgggttacccccgggg

SEQ ID NO: 121786 - DNA, 682 bp, Homo sapiens
  misc_feature: GYAE6OF02H81KX.41.2.A02.1.454.CMB.1.raw
  modified_base (187)..(187): a, c, t, g, unknown or other
  misc_feature (187)..(187): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
tcagtctatactatcacgaccggtgctcgatttagactcatctacgagggggagcatcacccagcaaccacatctgtcctctagagagtcccctgagagctccgttcctcaccatggactggacctggaggatccttcttcgttgggtggcagcagcccacgaggacgccccactctcgaggtgacngctgatgcgagtcggtgggactggaggtaggacgggacggccgtcggggtacctcgagtagacgtcctcgtcgtagactagtacttcgtaggatacgtagtacgacgtacttatatacacgtacggtggacncggacgccggtccgtaggacggtaggtacgtacggnggttaggaggtaggtagtggtaaccaccgtaaaccgtagtacggtcgtacgaaccgacgacgtctacgtacgtacgtaacgtacggtaacggtcggaggaccggttacggacacggtaggtggacggtcggacgaccgccggaacggaccgagtacccgtacgacgaacgtgtaaccgttaacgtctaacgtcgttacgagttacggaggtaacgtaccgtacgtttacgttaccgtggtccgtacgaccgggtacccgtacccggtacgggggtaaccggggtacccggttaccggtaacggttcccggtacgggtacggtccggg

SEQ ID NO: 121787 - DNA, 776 bp, Homo sapiens
  misc_feature: GYAE6OF02JRGML.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagatcctcttctggtggcagcagccacgaggacgccctactctcgagggtcgacgaggtctagatcgacgagtcgtgggacgtggaaggtggaacggaacggccgtcggggtacctcgaggtagacggtccttccgtaccgtcggaacaacgtccgtttacgcgtagtacgtaacggttaccaaacgttacttaccttaatactaacgtcggttaggggtcaccggaaccgtccggtacccggtacggaacggaacgggttacggttaggacggtagggtaagggtgggtaagtacggtaacgtacccgtaaaacccggtaggtagttacggggacaacccgaccgtaacggtcccgtcgtacgtaaacccgagtaacggtacgggttccggaacgggtaccgtaggtaaccctacgagttagggaccgggtagggtaacccgaccgggtaccggccgtaagggaccgtaccggtacccgacgtaccgtaagtacccgtaaaccgttacgacgtacggtagtacgtacgacggtaacggtccgttaaccgggttctttagttccgtaacgggtcgtaccggacggtacccgaggggttaacccgggacggggttcccggttaacgtccggttacggtccgggtacgggg

SEQ ID NO: 121788 - DNA, 656 bp, Homo sapiens
  misc_feature: GYAE6OF02FSUDM.41.2.A02.1.454.CMB.1.raw
  modified_base (135)..(135): a, c, t, g, unknown or other
  misc_feature (135)..(135): n is a, c, g, or t
  modified_base (190)..(190): a, c, t, g, unknown or other
  misc_feature (190)..(190): n is a, c, g, or t
tcagtctatactatcacgaccggtgctcgatttagactcatctacaggggagcatcacccagcaaccacatctgtcctctagagagtcccctgagagctccgttcctcaccatggactggacctggaggatcctnttcttggtggcagcagccacaggagcccactcctcaggtgcagctgatgcagtcnggggctgaggtggaggaagccgtggggcctcgagtgaagctctctgcaagactttcgtggactacgtaggttaccaacgtacttacgtattatacctacgtgggtgaccgaacgacggcccccgtaggacgacggggtacttggtagtgggagttcgggagttcggacttaccgaaacccgtaaggaggttggtacgacaacgacgtcccgttcgtcgccgaacgtaggtacggtaccgtacgggaccgtaggggtacccaccgtagtcgggtagtacgggtagtaccgaccggacccgtaacggacgacccgacggtacccaacgtagtaacgtaaccgttaccgtacgtacgtagagttaccgtaggacggtaccgacggttctttaccgtagtgtacggtcgaccggtacccgtacggtacggggaccggggtacccttacggtcgtaccgtacgtacccggg

SEQ ID NO: 121789 - DNA, 548 bp, Homo sapiens
  misc_feature: GYAE6OF01DBIDR.39.83.H06.1.454.CMB.1.raw
  modified_base (199)..(199): a, c, t, g, unknown or other
  misc_feature (199)..(199): n is a, c, g, or t
tcagtcgcactagtcacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatcgacccagtcctccatccctcctgtctgcatctgtagganacagatcatcatcacgttgtcgggcgagtcgagggctattaacctaattattagccgtggtactcagacaagaaaccagggaagtactaagcctactgtatctatgctgcacttcctattgactagtcgacgggtccagtcgtgttcaggtgcagtgagtcgtaggtatagtacttacactctacaccatacagctacgtctacgctacgtctagaatgttagtcgtaacttaacttactttactagtaactaaaagtctacgaccgtaccgttacccgtacccccgttacggttcccggacccggtacggaaccgtacggtacgtaggtaactagtaaccgtaaacgg

SEQ ID NO: 121790 - DNA, 736 bp, Homo sapiens
  misc_feature: GYAE6OF01AER9Z.39.83.H06.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
tcagtcgcactagtcacgaccggtgctcgatttagatcacgtgcgtcgcggggaggtctgagagaggagcccagccctgggattttcaggttgttttctatttggtgatcaggactgaacagagagaactcacatggagtttgggctgagcgtggtcgttttcgtaggtcggctagttttaaaggtgtccagtcgtnaggtgcagctgctggagtcgtggggagcgttggtacnggccgtgggggtccctggagctcgtcctgcnccgagtcctcgtggtacttcgtaacgtttaaatntcggcctatggagtcggtcggggtttccggaccgtggtcctacccggaagggggaaccgggtcgttaacggggaggttcggggtaccgtagtaaaggttacgtccgttaaggggtcggttaaggaaggttccgttaaccggtttaccaacgtactaaccggttaccgactaaacggtccgttacccgggtaggaaccggggtccgtacctttcccgaacccgttagtcccgtaaccggttaaacgaacccgttaacgttacgaaacggtaactaaccgttgtcgtaactccgtagaccttaagtacccgaagtaggtacgagtacggcggaagaaccgcggttactaatacgttgtaagtacgtacggaaatcccggtaggtccggggttaacggttcttaacggggctaaggtttaggtaacccttggttaacggg

SEQ ID NO: 121791 - DNA, 796 bp, Homo sapiens
  misc_feature: GYAE6OF01CS3TU.39.83.H06.1.454.CMB.1.raw
  modified_base (204)..(204): a, c, t, g, unknown or other
  misc_feature (204)..(204): n is a, c, g, or t
tcagtcgcactagtcacgaccggtgctcgatttagatcacgtgcgtcgcgggggcagaagtctctctcagtcaggacacagcatggacatgagggtccctgctcagcctcctgggactcctgctgctctggctcccagataccagatgtgacatccagatgacccagtctccatccctcctgtctgcatctgtaggagacaggntcatcatcacgtggccggagacgtcgaggtactaattacctaatttacttacgccgttaggtatcagacaagaaaccgaaggtaagtcttaacgctcctgtatctatcgctcgctacttcctactttcgactaacgtccgtacgggtcctacgtccgttcggttaccgtaggtcggacgtaggttacggtacgttacgggttacggtacgttaacgtttaacgttttaccctaacccgtttacccttaaccgtaaaccccgtacttacccgtaacggttacccggttaaccggttcccgtacgggtaccccgtaacggttaacccggttaagggttaaacgtttacggtttaaccgggttttacccgttaaaccgttttaaacccgtttttaacgttttaaccgttaaccgttaaaacgttaaaaacggtttaccgtaaccgggttaccccgtaaacccggttaccccggttaaccccccggtttaccccggttttccccggggttaacccggttaacccgggtaaccccgttaaaggggttaacccgttaagggttaaaccttaaaccggttaaacccgttaaaaccgggg

SEQ ID NO: 121792 - DNA, 771 bp, Homo sapiens
  misc_feature: GYAE6OF01EIL0O.39.83.H06.1.454.CMB.1.raw
  modified_base (472)..(472): a, c, t, g, unknown or other
  misc_feature (472)..(472): n is a, c, g, or t
tcagtcgcactagtcacgaccggtgctcgatttagatcacgtgcgtcgcggggaggtctgagagaggagcccagccctgggatttttcaggttgtttttcatttggtgatcaggactgaacagagagaactcaccatggtagtttgggctgagcgtggtctttttctgtggtcttaagttttaaaaggtgtcctagtgtcgaggtgcaggctgcgtggagtcgtgggggagtcgttaggtacaggtccggtcgggggttccctggacgacctccgtcgtgcgactcgtctcgtacggtatttacgaaacgtttttaaaatacgttcgaccgtaagtggaacggtccgttcgggggtccccggcgaacgggttccgtaccggaagggggaaggggtaccgtgggtaaggtcggtacgttacgtaaaggtacgttacggaggttggtacggaagtcccgtttagtaaccccaanacgtttaaccaccggcgtaaagacccgtttccggaaggaacggggtcccctactttacccgaaccgtacgttacccgtaacccggtaaaacgtaccgtaaacgtttaacggaaacgttaacaacgttacgttacgttactgtaacataaacgtagtaaacgtgtaaggacgtacggaccggaaggacctacggtaccgttaagtagtttacgttggtaacgacggtaaacgttcgccgggtaccgaccggggtttacgttacggacgttaaggtttcgttaaacgtttcgtttaacggg

SEQ ID NO: 121793 - DNA, 721 bp, Homo sapiens
  misc_feature: GYAE6OF01CO1TG.39.83.H06.1.454.CMB.1.raw
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (304)..(304): a, c, t, g, unknown or other
  misc_feature (304)..(304): n is a, c, g, or t
  modified_base (550)..(550): a, c, t, g, unknown or other
  misc_feature (550)..(550): n is a, c, g, or t
  modified_base (703)..(703): a, c, t, g, unknown or other
  misc_feature (703)..(703): n is a, c, g, or t
tcagtcgcactagtcacgaccggtgctcgatttagatcacgtgcgtcgcgggggcagaagtctctctcagtcaggacacagcatggacatgacggtccctgctcagctcctgggactcctgctgctctggcctccagactaccgagaatgtacactagtaccagatcgaacccagtcctaccgattccctcctgtctagctattcngtaaganacgagtattcacttacaacgttcgaacggtcggccggagtaacgtacggaacgtctaaacttaactaaagtttacgtaacgtcgtagtaanacgaaccgaagaaaaccgaaaccgaaaccggaacctaaccctaaacctcgtaacgtactactacgtcggacttccggacctttaaccgtatacggaacctaagggtccgttaacgggtacccaagtttaaggtaaccgttgtaaggtccgtagtagggttacgaaacttagggacgtaactaacgttacgttaacctaccgttacgactaactacacgtcggtaacgtctacggaactacgtagtntattagtactaactacttaacttacgagttaacaaggtaacctaaggtacgtaacgtaaggtaccgttaacgggttaaacggttaccgtttaacggttaccgggaaaccggttaaacgggaaccaaacgggtaccgttaaggaacggaaaccngggtaaaacccggtacgg

SEQ ID NO: 121794 - DNA, 745 bp, Homo sapiens
  misc_feature: GYAE6OF01CKTR8.39.83.H06.1.454.CMB.1.raw
tcagtcgcactagtcacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatcgacccagtcctccactccctccctgtctgcatcgtagtaggagacaggactcatcactcacgttggaccggagagtcgacgggtctaattaacctaatttactttacgccgttaggttactacgaacgacgaaggaaaacccgaaggggtaaacggtacttaacggcttacctaggtacttactagtctcgttcgactactaccttacgtttacgactaacgttccggaacgggttccctaagttccgttaccgggtttacgtacggttagggtacctaagggttcggtaccgttacggttacgggtaacttaaggtttaccttttaccctacgttaccctttaccgaaaccgttaccgttaccgacggtaccttaacgggtctttaccgggacctagggttaccccgtaaggtaaaccggtttaccggtttacttaaaccgttttacgtttacgttaacgttaaccgttaaataaccgttagtcccgtaaccgtccggttaccccgtacccgtttacggtaccccggtccggaacggtaccgttaaggtacgttaacttacgtaacgtaacggtaacgtacggg

SEQ ID NO: 121795 - DNA, 804 bp, Homo sapiens
  misc_feature: GYAE6OF01E5KFA.39.83.H06.1.454.CMB.1.raw
  modified_base (397)..(397): a, c, t, g, unknown or other
  misc_feature (397)..(397): n is a, c, g, or t
tcagtcgcactagtcacgaccggtgctcgatttagatcacgtgcgtcgcgggggcagaagtctctctcagtcaggacacagcatggacatgagggtccctgctcagctcctgggactctgctgctctggctcccagataccagatgtgacatccagatcgacccagtcctccacttcccgtcctgtctagcattctaggtaaggacgaacaggacgtacactaccattccgtacgttcgggcccggggacggtaacgccgaacggggactaactttaacccgtaaattttacgttttaacggcccgttagggttactccgaacgtaaccgaaaggtaaaacccgtaagggttaaacgtttaccgttaaacgtccgttaccttcgacttactagttcncgtacgcctaacttccgtaactttgacctaaacgtccggtaaccggtaccctacgttccgttaccggtttacgaggtacggtcgtaagggttacgagtttaccgggacgggttaacttaccgtttaacgttttcccaaacgttccgtaccgaacctagtacgaacgtcgtaacgttccgttaggacccgtacgtacctaaggtaacgtaacggtttacgtttaccgttaacctttaacgtttttacgtttactaaacggtttaaaactaaaaacctttcggtaccgtaacccccggttaccgttacccccgtacccccggttttaacggttcccccgggtaccggtaacccgggtaacccgtagggttaacgtaacggttaaccgtaacgttaaaccggtaaacccg

SEQ ID NO: 121796 - DNA, 744 bp, Homo sapiens
  misc_feature: GYAE6OF01CWEYS.39.83.H06.1.454.CMB.1.raw
tcagtcgcactagtcacgaccggtgctcgatttagatcacgtgcgtcgcggggaggtctgagagaggagcccagccctgggatttcaggttgttttcatttggtgatcaggactgaacagagagaactcacatggagtttggctgagctggtctttttctgtggcttaattttaaaaggtgtccagtgtcaggtgcagctgcgtggaggtcggtgggggaggcgtttgggtacgacggtccggttcgggggggtcccctggaggtcctcctcctggcgcgagttccgtccgtggtacttacgtaaccgttttaaaatacttcgacctagtggaggtcggtcgggggtccggcgacggcgtaccggaggggaaggggcgtgggaggtcgggtcctagtaagtagtgtacgttggtagtaacgtctacgttaaccaacgtaactacgaacgacgtacggtacccgtacgggtaacgggaaccgggtccgtccgttaccaacctacgttaccaaccgaaagtaaactaaagttaaccgaaagaactaacgtagtacgtaatacgagtaaactaaagtagtaaacgttaaggttaggaaaggacggaccggaaggaacccgacgggtaccttaagtttaacgttagtttaggaacggtaaacgggaaacggtccggtacgggacccgggttacccggggttacgtttaccgggtagttaagtaccggttaacgttacggtttaaaggg

SEQ ID NO: 121797 - DNA, 497 bp, Homo sapiens
  misc_feature: GYAE6OF02G9LRZ.39.83.H06.1.454.CMB.1.raw
tcagtcgcactagtcacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcatcatcacttgccgggcgagtcagggcattaccaattatttagcctggtatcagcagaaaccaggaaaggtcttaagctcctgatctatgctgcatccactttgcaatcaggggtcccatctcggttcagtggcagtgatcgtgggacagattcactctcaccatcagcagtctgcagcctgaagattgtgctaactttactttactgttaacaaaaattagtgaccgtagtccgtaccccctacgtttccggcccgttgggaccctaggagtggtactagtacctaaacgg

SEQ ID NO: 121798 - DNA, 783 bp, Homo sapiens
  misc_feature: GYAE6OF02F5713.39.83.H06.1.454.CMB.1.raw
tcagtcgcactagtcacgaccggtgctcgatttagatcacgtgcgtcgcggggaggtctgagagaggagcccagccctgggattttcaggtgttttcatttggtgatcaggactgaacagagagaactcaccatggagtttgggctgagctggtctttttcttgtggcttattttaaaaggtgtccagtgtcaggtgcagctgctggagtcgtgggggagcgttggtacaggccgtgggggtccctgacgactcgtcccgtgccgctacgtctcgtggtactttacgtaacgttttaaatacttcgcctaagtaggacgtcgttcggggtcccggcgacgggtccgtaccggaagggggacggggtccgtaggggtacggttcggggtacctacggtaacgttaacgtaccgtaaggggttcggtaggaaacggttccgtttaacggttaacccaacgtacgttaaccgtaccgacgtaacgtacccgttaccggtacgggaaccgggtccctaccgttacccaccgtacgttacccgtaacccgaagtaacctaacgttacgaaacgaaccacgtagtcgttactcgtagaacctaagtacgtaaactaggtttagaagtaccggtaccggaacggtaacccgtacgggtaacccgttattaccgttttagtacggtaacggtaaaccggtaaaccggtcccggttaacgggacccggggttacccggggttcgtttaccgggtaggttacttaccgggttaaccgtttacggtttaacggg

SEQ ID NO: 121799 - DNA, 783 bp, Homo sapiens
  misc_feature: GYAE6OF02IZHD0.39.83.H06.1.454.CMB.1.raw
tcagtcgcactagtcacgaccggtgctcgatttagatcacgtgcgtcgcggggaggtctgagagaggagcccagccctgggattttcaggtgttttcatttggtgatcaggactgaacagagagaactcaccatggagtttgggctgagctggtcttttcttgtggctattttaaaaggtgtccagtgtcaggtgcagctgctggagtctgggggaggcttggtacagccgtggggggtccctgacgactctccgtgccgcagtctcgtggtattactaacgtttaaatatcgcctagtgagtcgtacggggtcccggacgacgggtccgtaccggaaggggaacggggcgtagggtaggttcgggtaccttacgaaaggttactcgtaggttaggtagaagtctacggttaaccaacgtaataccgtaacgactaacggaccttaccgggtaggaaccgggtcccgtaccttacccgaacctacgtacccgtacccggaaacgtaaccgtaaacgttaccggaaaacgaaaccgtaaccgtaacggttagttaactaccgttagtaaaccgaaaagttacggtaaaccgtttaggtttaacgggaacggtaacggacccgggtaagggtaacccgtaccggggtaacccgttaagtttaacttaagtttacggtacggaaaccggtaaaaccggtcccgtaaccgggtacccggggttaaccggggttccgttttacggggtacgttaacggttacggtttaaccgtttacggtttaacggg

SEQ ID NO: 121800 - DNA, 719 bp, Homo sapiens
  misc_feature: GYAE6OF02FWR2Z.39.83.H06.1.454.CMB.1.raw
tcagtcgcactagtcacgaccggtgctcgatttagatcacgtgcgtcgcgggggcagaagtctctctcagtcaggacacagcatggacatgagggtccctgctcagctcctgggactcctgctgctctggctcccagataccagatgtgacatccagatcgacccagtcctccactccctccctgtctgcatcgtgtagagacgagagtcatcatctacgttcggccgggacgagtcgacgggctaacgttacctaattttatttacgcccgttaggtactcacgtacaacgaaaaccgaagggtaaacggttacttaaacgccgttaccttggtaacttacttaattcggtcttacgactactaccgtactttagacgtaatccgtaaccggggtccctaacgttccgttaccggtttactacgggtcggtaccgtgggtacgtacgttcggtagggtaacgtaaggtacttttacgtaccttaccgtacctaaccgtaactacctagtacgtaccggttctacgaccgtacgtaccgtaggtaaacgtacttaggtttacctaacgttaactttttacgttacgttaacgttaaactaaaacttacgtacgtaccgtaacgttccccgtaaccccgttaccgtttacccggtacccggtacgggtaacccgtacgggttaacgtacggtaacgttaaccgtaacccgttaaaaccgg

SEQ ID NO: 121801 - DNA, 692 bp, Homo sapiens
  misc_feature: GYAE6OF02HE2YH.39.83.H06.1.454.CMB.1.raw
tcagtcgcactagtcacgaccggtgctcgatttagatcacgtgcgtcgcgggggcagaagtctctctcagtcaggacacagcatggacatgagggtccctgctcagctccgtgggactcctgctgctctggcctccagataccagatgtgacatccagatcgacccagtcctcactccctccctgtcctgccatcgtgtaaggagacagagtcatcatcctacgttcggccgggtagaagtcgagggcctaattaaccgtaaattttagttacgccgttaggtactcaacgtacaacgaaaacggtagggtaaaacggttactaacgtcctaccgtgtaacttcgtaatcggtactcggactaacgttcctacgtttacgaactaagtccggtaaccgggtcccagtttccgttacggtcgtaggtcggtaccgtaggtcgaacgttccgtagggtactagttaactttcgacgttctaccactatacgacgtacgtacgtcgtacgccgtagtacccgttaagaacggtgttacgttacgtaacgtttaaccgtttacgtttaactaaacgtaaacttaaaacgttcctacgaacccgttaccggtaacccgttaccccgttaccgtttcccggacccgtaacgggacgttacggaacgtttacgggtactaaccgttacgtaaacccggg

SEQ ID NO: 121802 - DNA, 530 bp, Homo sapiens
  misc_feature: GYAE6OF02JMJA0.39.83.H06.1.454.CMB.1.raw
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (455)..(455): a, c, t, g, unknown or other
  misc_feature (455)..(455): n is a, c, g, or t
tcagtcgcactagtcacgaccggtgctcgatttagatcacgtgcgtcgcgggggcagaagtctctctcagtcaggacacagcatggacatgagggtccctgctcagctcctgggactctgctgctctggctccagataccagatgtgacatccagatgacccagttccacatccctccgtgctgcatctgtagagactagagtcatcatcacgttgcggcgagtgaggcattaccaattattagcctgtatcaganagaaacgaggaaacggtactaagctcctagtatacgtatnctgcactacacttnactaancgtacgggacctatcgtgtacgtagtcgtcgagttacgatcgtagagngttatcactctcaacgtactacgatcgagttcgngacaacgcctagagtacgtgtagtacctaattcgttactataaactaaagttacgtnaccgtacgtcccggtaccctaacggttccgaccgttaccggaactgggaacttaggaactagtacccgtaaacgg

SEQ ID NO: 121803 - DNA, 631 bp, Homo sapiens
  misc_feature: GYAE6OF02GSL30.39.83.H06.1.454.CMB.1.raw
tcagtcgcactagtcacgaccggtgctcgatttagatcacgtgcgtcgcgggggcagaagtctctctcagtcaggacacagcatggacatgagggtccctgctcagctcctgggactcctgctgctctggcctcccagataccagatgtgacatccagatcgacccagtcctccatccctcctgtctgcattctaggtagagacagtagtcaatcatcacgttcggccggcgagtcgagggctaacgttaacctaatttatttacgccgttaggtactcgagtacaacggaaaccgaagggtaaacgtacttaagctccgtagacttctagtcgctcgactactcctacttagacaagtcggacggtccctacgttccgttcggttacgagtcggacgtaggtcggtagtcgtacgggtactacggttcttacgcttacctaccgacctagtcgtaacggtctaacgttcgtacgcgtactacgttagaagtcttacggttactaactttaactttacgtttactaacgttaaaacgtaaattcttacgacctacggtcccgttaccccgttaacgttcccggtaccgtcggaaccgtaggtacgtacggtaactaccgtaacgtaaccgg

SEQ ID NO: 121804 - DNA, 660 bp, Homo sapiens
  misc_feature: GYAE6OF02FZTLJ.39.83.H06.1.454.CMB.1.raw
  modified_base (233)..(233): a, c, t, g, unknown or other
  misc_feature (233)..(233): n is a, c, g, or t
  modified_base (496)..(496): a, c, t, g, unknown or other
  misc_feature (496)..(496): n is a, c, g, or t
tcagtcgcactagtcacgaccggtgctcgatttagatcacgtgcgtcgcgggggcagaagtctctctcagtcaggacacagcatggacatgaggtccctgctcagctcctgggactcctgctgctctggctcccagataccagatgtgacatccagatcgaacccagtcctccatccctccctgtactgctagtctggtaggagacagagtcatcactcacgttggcccgggngagtcgaggctaacttaccaatttacgttcgccgtggtactcgagacaacggaaaccgaggggtaacggttacttaaggtcctccggtagtacttacctagttacgtctagacctacttccctagttttacgactaacgtccggtaccgggttacccctgtttccgtacggttcgaggttcggacgtacgttcggacgttcggaggtaaccgtagttctttacctcctccgtacctacctatacccgtattacctacgtttcnccgtaccgtacgtccgtaggtaacgtacgtcgtttaactaacgtttacgtttacttcggtaaacttaaaccgtaaatcgttaccgacgtaccggttccccgtaccccgttaccggttaccgtccgtacggtacgacgtacgtagaccgttacgtacctaaacgg

SEQ ID NO: 121805 - DNA, 528 bp, Homo sapiens
  misc_feature: GYAE6OF01DM4DM.8.38.D05.1.454.CMB.1.raw
  modified_base (203)..(203): a, c, t, g, unknown or other
  misc_feature (203)..(203): n is a, c, g, or t
  modified_base (503)..(503): a, c, t, g, unknown or other
  misc_feature (503)..(503): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatctttgatgcatccatcagggccactggcatcccagccaggtcagtggcagtgggtctgggacagacttcactctcaccatcagcagcctagagcctgaagtattttgactagtttattactgtacaactatacgtaccgagtcggccgtccggggcctacgtttccggcccgtcgggacctaaagttgaagactacaaacgactgtcggntgcacatctgtcttcatctcccgtc

SEQ ID NO: 121806 - DNA, 515 bp, Homo sapiens
  misc_feature: GYAE6OF01DAHWN.8.38.D05.1.454.CMB.1.raw
  modified_base (202)..(202): a, c, t, g, unknown or other
  misc_feature (202)..(202): n is a, c, g, or t
  modified_base (383)..(383): a, c, t, g, unknown or other
  misc_feature (383)..(383): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctccagataccaccggagagattgtgttgacacagtctccagccaccctgtctttgtctccaggggaaanagccaccctctcctgcagggccagtcagagtgttaccaccagttagcctggtaccaacacaaacctggccaggctcccaggcccctcatctttgatgcatccatcagggccactggcatcccagccaggttcagtggcagtgggtctgggacagacttcactctcacatcagcagctagancctgaagattttgctaagtttattactgtacaacatcgtacgagtcggccgtccggggcctacgtttcgggccctgggaccaaagttgagtatcaaacgactgtgctgcaccatctgtcttcatcttccgcc

SEQ ID NO: 121807 - DNA, 563 bp, Homo sapiens
  misc_feature: GYAE6OF01CNZYT.8.38.D05.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccaccagttagcctggtaccaacacaaacctggccaggctcccaggcccctnatctttgatgcatccatcagggccatggcatcccagccaggttcagtgcagtggtctgggacagacttcactctcacatcagcagcctagacgcctagaagtatttgacttagtttattactgtacaactattcgtaccgtagtcggtccgtacccggggcctacgtttccgggcccgttacgggaacctaaagttcgaagtaactaccgaaacgtacgtgtcggtctcgaccacctagtccttagttacttccaacttcccgttcccgtaccg

SEQ ID NO: 121808 - DNA, 534 bp, Homo sapiens
  misc_feature: GYAE6OF01DG9QL.8.38.D05.1.454.CMB.1.raw
  modified_base (507)..(507): a, c, t, g, unknown or other
  misc_feature (507)..(507): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatcttgatgcatccatcagggccactggcatcccagccaggttcagtgcagtgggctgggacagacttcactctcaccatcagcagcctagacgcctgaagtattttgactagtttattactgttacaacatcgtaccgaggtcggccgtccgggggtccacgtttccgggcccgtagggaaccctaaagttcgaagactacaaacgaactggtgntgcaccatctgtcttcactcttcccgc

SEQ ID NO: 121809 - DNA, 588 bp, Homo sapiens
  misc_feature: GYAE6OF01CZ1CP.8.38.D05.1.454.CMB.1.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgctccgaggggaaangccacctctcctgcagggccagtcagagtgttaccaccagttancctaggtaccaacacaaacctggccaggctcccaggccctcatcttgatgcatccatcagggccactcggcactcccagccaggttcacgtggcaggtgggtctgggacagacttcactctcacatcagcagcctagacgcctagaagtattttgactaagttttattacttagtacctaactacttaccgtaaccgtacggtcgggtcccgtcccgggggtacctaccgttttccgggcccgttagggtaacctaaagttcgaagtaactacgaaaacgtacgtcggtgacgttcgacctaccgtaattccgtacgttcttagacttccgttcccgtacc

SEQ ID NO: 121810 - DNA, 523 bp, Homo sapiens
  misc_feature: GYAE6OF01BWDDM.8.38.D05.1.454.CMB.1.raw
  modified_base (203)..(203): a, c, t, g, unknown or other
  misc_feature (203)..(203): n is a, c, g, or t
  modified_base (514)..(514): a, c, t, g, unknown or other
  misc_feature (514)..(514): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccaggcccctcatcttgatgcatccatcagggccacgtggcatcccagccaggttcagtggcagtgggatgggacagacttcactctcacatcatcgagcctggacgctggaggtatgtgctagtttatactgtctaacatcgtaccgagtcggccgtccggggcctcgttccggccgtgggaccaaggtgatactacgaaacgtacgtgtgcgtgccacattcgtgtacttcnttcctcccg

SEQ ID NO: 121811 - DNA, 596 bp, Homo sapiens
  misc_feature: GYAE6OF01ETI5H.8.38.D05.1.454.CMB.1.raw
  modified_base (204)..(204): a, c, t, g, unknown or other
  misc_feature (204)..(204): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccacccagttagcctggtaccaacacaaacctggccaggctcccaggcccctcatctttgatgcatccatcgagggccactggcatcccagccaggttcagtggctaggtgggtcgtgggacagacttcactctaccacctatcagcagccgtagacgcctagtaagtattttgacttaagttttattacttcgttacaactacgtacgtacgtacggtcggtcccgtccgggggtaccctaccggtttccgggtcccgtacgggtaacctaaagttcgaacgtacgtaccgtaaacgaacgtcggtggtactcggactaccgtattacgtcgttacttactacttccctcccgtacc

SEQ ID NO: 121812 - DNA, 725 bp, Homo sapiens
  misc_feature: GYAE6OF01BQY1Z.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcgtggggggggctggtccagccgtgggaggtccctgagactctcctgtgcaggctctggtacttcaccttcagtaactacggcgtgcacgtgggtccgccaggctccgaggccaagggtcttggagtggctggctagtttgttcagttcgtaggaaggtaagtgttacaaattactaatacagacctccgtaggaaacggggtccctagttaccaacctacgtccgtaccaaggaacgtaactaaacttaccgaaacgtaaaccaacgtaacgtacgtaactacgtacgtaactaaacgttaggaaccgaacgtacccgtaaaggtaggttaacggaacgggtaaccgtaacgggtacgtttacggttttaacgtttaaacggttacgggttaaaccggtaaaaaggggtaggggggtaaacttaacgggtaacgggttacgggtaaccgtaaccggtacccgttaacccgtaaacggtttaaccgtttaaccgtttacggttaaccggtttacccggg

SEQ ID NO: 121813 - DNA, 556 bp, Homo sapiens
  misc_feature: GYAE6OF01DYTYG.8.38.D05.1.454.CMB.1.raw
  modified_base (203)..(203): a, c, t, g, unknown or other
  misc_feature (203)..(203): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccacccagttagcctggtaccaacacaaacctggccaggctcccagactcctcatctttggcgtcctttaacagggccagtggaatcccagccaggttcagcggcagtgggtctgggacttcgttcactctcaccatcaaatacctgcaatctagacgtactttgctaagtttatttctgtcagtcagtctagaagtactggtccgtttctacgttttcgggacggaacgggaccgtaagggtcggacctacgaaacgtacgtcgtggctagccaccagtctgtcttcacttccttcccgctactctgacgcaaccgg

SEQ ID NO: 121814 - DNA, 729 bp, Homo sapiens
  misc_feature: GYAE6OF01BHRKX.8.38.D05.1.454.CMB.1.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagngccaccctctcctgcgagggccagtcagagtcgttaccaccagttagcctaggtaccaacacaaacctggccaggcctccacggcccctnacttcttgatgcactccatcgacgggccagtcggcactcccagccgtaggttcaggtcggacgtaggtcggggtctacggggactaggtaccttcgactcctaccacctatcaacgcacgtacctaaggacgtaccgtagtaaagttacttttacggactttaaagttttaacttacgttacggttaacctaaaccgtacgttacccggtaacccggtagggttcccgggtccccggttacccgggggtacccttaacccgggttttccccgggaccccggttaacggggtaaaacccttaaaacggttcggaaacggtaacttaaccggtaaaaccggtaaccgttgggttaccggtacgtacgggtaccctaaccgttacgttccgtttacggttaccctttaaccgtacccttccccgtttccccgaaccg

SEQ ID NO: 121815 - DNA, 598 bp, Homo sapiens
  misc_feature: GYAE6OF01EAAI5.8.38.D05.1.454.CMB.1.raw
  modified_base (481)..(481): a, c, t, g, unknown or other
  misc_feature (481)..(481): n is a, c, g, or t
  modified_base (521)..(521): a, c, t, g, unknown or other
  misc_feature (521)..(521): n is a, c, g, or t
  modified_base (559)..(559): a, c, t, g, unknown or other
  misc_feature (559)..(559): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatgggagtttgggctgagcttgggttttcctcgttgctcttttaagaggtgtccagtgtcaagtgcaactggtggagtcggtggggggggctggtccagccgtgggagtccctgagactctccgtgtgcaggctcgtggacttcaccttcaagtaaccgtacggcgtgcacgtcgggtccccgccgtagggcctccgagggaccgaaggggtcttgggacggtgggctgggtctaggtttcgttacagttcgtaggaaaggtagttgtactaatactagactacgactcggtagacgggacctattccaacactctaccagactactaataccaaagaacacgatagtatctanactaagacgacagaccgtaagacgtagaggacgtacggtnttagttatacgtagtaacggaaggagggtatacgaggngacgagtactacgtaacgttacttacgttgtcgtacggg

SEQ ID NO: 121816 - DNA, 619 bp, Homo sapiens
  misc_feature: GYAE6OF01CC8TN.8.38.D05.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtcgttaccaccagttagcctggtaccaacacaaacctggccaggcctcccaggcccctnattctttgatgcatccatcacgggccacgtggcactcccagcctaggttcaggtggctaggtgggtctggggacagtacttcactctcaccatcagcacgcctagacgccgtagtaagtattttgacttaagtttacttactcgtactaactacgttccgtaccggaggtcggtcccggtcccgggggtacctaccggtttcccgggtacccgttacggggtaacctaaagttcggaacgtacgtaacgaaacgtacgtcggtcggtactacggccaaccgtacgttaccgttcgttaccttacctactttcccgttccccgtacccg

SEQ ID NO: 121817 - DNA, 533 bp, Homo sapiens
  misc_feature: GYAE6OF01EJ8YB.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggctccgaggcaaggggcttgggagtggctggctagttgttcatctgaaggagtgttacaatactatacagactcgtgaaggccattcacatctcagagacaatacaagaacacgatgtatctgacaaatggacagacctaagagttagaggacacggtctagtttactagtagtacgaaaggaggggatagaggtcggacgagacgtacaagtactacgtttgacgttacgg

SEQ ID NO: 121818 - DNA, 579 bp, Homo sapiens
  misc_feature: GYAE6OF01BF5Y5.8.38.D05.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
tcagctcgcgtgtccacgaccggtgctcgatttagtatctgatagttgggtttgggggaggaactgctcagttaggacccagagggaaccatggaagcccagctcagcttctcttcctcctgctactctggctccagataccaccggagagattgtgttgacacagtctccagccacctgtctttgctccgaggggaaancgccaccctntcctgcagggccagtcagagtgtaccacctagttacnccgtggtaaccaacacaaacctggaccaaggcctccacggccctcattcttgactgcatccatcaggtccactggccagtcccaagccgaggttcaggtggcaggtgggtcgtggggacagtacttcactctcaccatcagctacgcctagacgcctagaacgttatttacgctagtttactacgtagtacaactagtaccgtacggagtcggccgtccgggacctaccggttcgtacccgtacggtaacctaaagtcgaacgtacaacgaaacgtaacgtgtacggctcggactacctaacgtctacggttcttacgcttccctcccgtac

SEQ ID NO: 121819 - DNA, 263 bp, Homo sapiens
  misc_feature: GYAE6OF01EXXHD.8.38.D05.1.454.CMB.1.raw
  modified_base (261)..(263): a, c, t, g, unknown or other
  misc_feature (261)..(263): n is a, c, g, or t
tcagctcgcgtgtccacgaccggtgctcgatttagtatctgatagttgggtctgggacagacttcactctcaccatcagcagcctagagcctgaagattttgcagtttattactgtcaacatcgtaccgagtggccgtccgggggccactttcggccctgggaccaaaattgagatcaaacgaactgtggctgcaccatctgtcttcatccttcccgccatctgagacacgcgagctgagcgggctggcaaggcgcatagnnn

SEQ ID NO: 121820 - DNA, 647 bp, Homo sapiens
  misc_feature: GYAE6OF01D3IU2.8.38.D05.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (577)..(577): a, c, t, g, unknown or other
  misc_feature (577)..(577): n is a, c, g, or t
  modified_base (631)..(631): a, c, t, g, unknown or other
  misc_feature (631)..(631): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgcccaccctctcctgcgagggccagtcaagagttcgttaacccacccgtagttacgcctaggtaacccaaacaccaaacctggaccaggcctcccgacggcccctnacttcttgatgcatccatcgacgggccagtggccactcccagccgtaggttccaaggtcggacaggttcgggtactaggggacaggtaccttacgacttcctaccaccgtactcacgtcacgtaccgtagacgtcctaggaaatttcgttttagacctttagtttaacttacgtagtaacaactacgtaccggtaccgtaggtcggtacccgggtccgggtacccttacgtttccgggacccgttaacgggaacctaaagtcgaanacgtaacgaaacgtacgtaggtcgtactcgacacctagttcctacgttccttanacttccgtccctaccg

SEQ ID NO: 121821 - DNA, 726 bp, Homo sapiens
  misc_feature: GYAE6OF01DPZO6.8.38.D05.1.454.CMB.1.raw
  modified_base (214)..(214): a, c, t, g, unknown or other
  misc_feature (214)..(214): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggcctcccagataccgaccggagagattgtgttgacacagtcctccacgccctaccctgttctttgtcctaccgaaggggaaancgccctaccctctcctgcgaggccagtcagtagtcgttacccaccgtagttcgcgtacggaaccaacactaaccgtcgccacggcctcccgacgcccctatacttcgtttgatcgactactccagtccgacggcctacgtcggacctacctacccgacggtaccgtaggttcgaaggtcggtacgtagggttcggtacgtaggggaactacgtacttccgtactcgtaccaacgtatacgacgacacgtaccgtacggaccgtacgtaagtaagtttacttttcggactttaagtttacttacgtacgtaacctaacgtacgtccggtaaccggtacgggtccgggacccggttcccggggtaccttaccggtttcccgggaccggttaaacggtaaccgtaaagtcggtaaacgtaacgtaccgtaaacgtaggtcggtacggtcaccgtcccgtaacgttcgttccgttaccggttactacccgttacccttccccggtcccgtaacccg

SEQ ID NO: 121822 - DNA, 606 bp, Homo sapiens
  misc_feature: GYAE6OF01A4BO2.8.38.D05.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
tcagctcgcgtgtccacgaccggtgctcgatttagtatctgatagttgggtttgggggaggaactgctcagttaggacccagagggaaccatggaagcccagctcagcttctttcctcctgctactctggctcccagataccaccggagagattgtgttgacacagtctccagccacctgtctttgctccaggggaaangccacctctcctgcagggccagtcagagtcgttaccaccagttacgcctaggtaccaanacaaactggccaggctacccaggccctcacttcttgactgctactccatccgagggccacgtggcacgtcccagccagggttcaaggtggcaggtcggtctggggactagactttcacgtctacgaccaagttccaaggccaacgccgtaagacgtaccgtagtaacgttagttttcgacttaaggtttaacttacttgtactaactacgtacgtacgacggtacggtcccgtacggggccttacgttccggacccgtacgggtaacctaaagttcgacgtatacgaaacgtacgtagtacggctagactactacgtacgtcgttccttatacttccttcccgcgtac

SEQ ID NO: 121823 - DNA, 584 bp, Homo sapiens
  misc_feature: GYAE6OF01DM2ZJ.8.38.D05.1.454.CMB.1.raw
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccacctgtctttgctccaggggaanagccacctctcctgcagggccagtcagagtcgttaccacccagttagcctggtaaccaacacaacctggccaggcctcccaggccctnatcttgatgcatccatcaggccactggcatcccagccaggttcagtgcagtgggtctgggacagacttcactctcacatcagcagctagagcctgtaagtattttagctagtttacttacgtgtaccaacgtacttcgtaccgtagtcgggaccgtcccgggggacctaccggttccggtacccgtacgggaacctaaagttcgaacgtaactacgtaaacgtaacgttggtcggtactacggcctaaccgtagttccttacggttacctttacctactttccgttccccgtaccc

SEQ ID NO: 121824 - DNA, 537 bp, Homo sapiens
  misc_feature: GYAE6OF01BUMWZ.8.38.D05.1.454.CMB.1.raw
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (513)..(513): a, c, t, g, unknown or other
  misc_feature (513)..(513): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccagggcctccgaggcaaggggcttgggagtggctggctagttgttcatcngaaggagtgtacaatactanacagactccggtagaagggcctattccaccatctccagacgacaactaccaagaacacgatagtatctagacaatcgacagacctaagagtagaggacacggactagttattacgtagtaacgaaggagggggatagaggtggngagctacatactcttgtcgttcgg

SEQ ID NO: 121825 - DNA, 784 bp, Homo sapiens
  misc_feature: GYAE6OF01CPPI2.8.38.D05.1.454.CMB.1.raw
  modified_base (204)..(204): a, c, t, g, unknown or other
  misc_feature (204)..(204): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaanagccaccctctcctgcagggccagtcagagtgttaccacctagttacgcctggtaccaacacaaacctggccaggcctcccacggcccctcacttctttgatcgcactccatcgacgggccacgtcggccactccccgagccgtaggttccgagggttcggaccgtaggttcgggggtaccgttagggggaaccgtaacgtaccgtttccaaccgtttcctacccgtaacccgtaacttccgaacggccgtaacggtacccgtaacggaccggtacccgttaggtaaaacggtttattttttacggaccgtttaaggtttttaactttaacgtacgttacctaaacgttacgttaccggttaccggtaacggttcccgggtacccggttccccgggggtacccgttacccggttttacccggggccccgttaacggggtaaacccttaaagtttcggaaaccgtacgttaaaccggtaaaaaccgtacggttacggtcgggtaccgtacggtaccctaacccgtacgtttacccgttacgtttcccttacctttaccgttcccgttccccgggttaaccc

SEQ ID NO: 121826 - DNA, 779 bp, Homo sapiens
  misc_feature: GYAE6OF01AX9Z2.8.38.D05.1.454.CMB.1.raw
  modified_base (217)..(217): a, c, t, g, unknown or other
  misc_feature (217)..(217): n is a, c, g, or t
tcagctcgcgtgtccacgaccggtgctcgatttagtatctgatagttgggtttgggggaggaactgctcagttaggacccagagggaaccatggaacgccccagctcagcttctcttcctcctgctactctggcctcccagactaccaccggagagtattgtgttgacacagtcctccacgccctaccctgttctttgtcctaccggaaggggaaancgccctaccctctccgtgcgacgggccagtcagtacgttcgtaacccaccgtagttacgcctaggtaaccaacacaaccgtcggaccgacgcctaccgacgtcccctctattcttgatcgactactccactccggacggcccagtcggacctaccacccgacggccgtaggttccaggtcggacgtagggtcgggtactcggggactacggtaccttccactcctaccgacctagtaccacgaccgtaacggtcctagggacccgtaccgttaaggtaaacgttttacttttacggtacgtttaaacgtttttacttaaccgttacgttaacctaaaccgtttccgttaacccgggtaacccggtcgggtacccgggtcccgggttacccggggtacctttaccccggttcccgggtaaccccggttaaggtaaacccttaagttcggaaacgtaaccgtaacgtaaaacggtacccgttggaccgtacccgtacgtacccgtaaccttaggtttcccgtttacgtttaccctttaccgttcccgttccccgtagttacccg

SEQ ID NO: 121827 - DNA, 699 bp, Homo sapiens
  misc_feature: GYAE6OF01BWLXL.8.38.D05.1.454.CMB.1.raw
  modified_base (230)..(230): a, c, t, g, unknown or other
  misc_feature (230)..(230): n is a, c, g, or t
  modified_base (298)..(298): a, c, t, g, unknown or other
  misc_feature (298)..(298): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccacctgtctttgtctccgaggggaaagcgccacctctcctgcaggccagtcagngtcgttaccaccctagttacgcctaggtaccaacacaaacctggaccaggcctacccgacggcccctnactctttgatcgcactccatcgacggccacgtcgcactcccagcctaaggtccaggtcggacgtaggtcgggtcaggggacacggtaccttaccgtaccttcgtaccaccgtactaccacggacacgtacccgtaaggaccgtaccgttaaggtaaacgttcttttacggactttaacggtttttaacttcgtttacgtacgaaaacgtcgttaccggtaacggtacgtccgggtacccggttcccggggacccttacggtttcccgggacccgttaggggaaaccctaaagttacgacgtaactaaccgtaaacggtaacgttggtacggtacctaggtccctaccgtacgttccgttacgttacccgtttataacccgtttcccgttaccccggtaacc

SEQ ID NO: 121828 - DNA, 776 bp, Homo sapiens
  misc_feature: GYAE6OF01EIC1H.8.38.D05.1.454.CMB.1.raw
tcagctcgcgtgtccacgaccggtgctcgatttagtatctgatagttgggtttgggggaggaactgctcagttaggacccagagggaaccatggaagccccagctcagcttctcttcctcctgctactctggcctcccagactacccaccggagagtattgtgttgacacagtctccagcccaccctgttctttgtctccgaaggggaaacgacgccctacccgtctccgtgcgacggggcccagtcaggtacgttcgttaacccaccctaggttacgcccgttaggtaacccaaacaaccaaaccgtcggaccaacggccctaccccgacggccccctactacttctttgactcgactacgtccacgtcgacgggcccacgtcggacctactcccacggaccgtaggttacgacggttacggcgtagggtaggtagtacgggactacgtaccttacgacctactaccacctactaccgactaccgacgtaccgtggacgtccgtaggtaacgtgttgtacgtacgtttaagtttacgttactcggtaacctaacgttacggttaccgtaccggtacggttacccgggtccccgggttacccgggggtacccttaaccgggttttcccgggacccgggttaacgggtaacccggtaacggggtacggtaacggaacgttaaacccggaaacggttaacgtcgggttacggaccgtacggacccgtaaaccttcgttaccgttccgttaccttcccgttacgttcccccgttacccg

SEQ ID NO: 121829 - DNA, 810 bp, Homo sapiens
  misc_feature: GYAE6OF01DS52N.8.38.D05.1.454.CMB.1.raw
  modified_base (177)..(177): a, c, t, g, unknown or other
  misc_feature (177)..(177): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatgggagtttgggctgagtcgttgggttttcctcgttgcttcgtttaagnggtgtcctagtgtcaagtgcaacgtggtggagtcggtggggggggctcggtccgaggtccgtgggggacggtccccgtggacgtacttcctccgtggtcgccgacgggtcttcgtggtaccttacctacctttacgaacggttaaccgtaccgggtcgtcggaccgtaccggttcggggtacccccgccggaacgggtccctacccggaaggggtaccgtaaggggtcgtttggggaggttccggtacgtggggtacgttacggttttcgttcgacgttcggtacggggaggtcgtaggtttacgttacgtaaggttggtaacgtcggaacgtacggtacccgttcgggaaggtaaaccgggtccttaactacccgtacgtactacccgtacgacgtaacgtaacctaacgtaccgaaacgtaacctaacgttaaagttcggttaagtttacggaacgtacgtaacgtaacgtaccgtaccgtaacgtccgtacggaacggtaccgtacgggtactaacgttacctaaggttaccggaagggtaaacggggaccggggaacgacgggtaccggtaccggttaaccgacggttacccgttacggtacgtaccgggttcgggccgggtacccggg

SEQ ID NO: 121830 - DNA, 604 bp, Homo sapiens
  misc_feature: GYAE6OF01AKZZR.8.38.D05.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (377)..(377): a, c, t, g, unknown or other
  misc_feature (377)..(377): n is a, c, g, or t
tcagctcgcgtgtccacgaccggtgctcgatttagtatctgatagttgggtttgggggaggaacgtgctcagttaggacccagagggaaccatggaagcccagctcagcttctcttcctcctgctactctggctcccagataccaccggagagattgtgttgacacagtctccagccaccctgtctttgtctccaggggaaanagccacctctcctgcagggccagtcagagtgttaccaccagttagccttggtaccaacacaaacctggccaggcctccaggcccctnatcttgatgcatccatcagggccatgcactcccagccaggttccaggtgccagtcgggtctggggactagacttcgactctcaccgntccagctacgcctagacgcctagaacgtagtttcgacgtagttttaacttacttgtacaacgtacttaccgtaccgtagtcgggaccgtcccggggtacctaccgtttcgggtcccgttacgggaacctaaacgttgaacggaataccgtaaaacgactacggtcggtacttacggccgtaccgaattccgttcgttaccgttaactcctttcccgtccccggtacc

SEQ ID NO: 121831 - DNA, 924 bp, Homo sapiens
  misc_feature: GYAE6OF01DAZHL.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgcttcgtttaagaggtgtccagtgtcaagtgcaactggtggagtcggtggggggggctggtccaggccgtggggacggttccctggacgtacttcctccgtggtcgcgacgggtcttcgttaggtactttcccaacccgtttcgaacgttaaaccgtacgggcgttcgaccgtaccggttcggggtccccgaccgtaacgggccttacccgaggggaccgtaaaagggggttcccgtttgggggaacggttcgggtaccgttgggtacgttaacggttttttcgttttaccgtaagttccggttaaggtaaaacggggttaaggtttacggtttaactaaacgttttaaccgttaaactaacggaacgtacccggttaccggttagggaaaccggggttcccgtaaactttccaaacccgttaccttaccgtacccgtaaacggtaacgtaaaccgttaaaacgttaaacccgaaaacgaaaccgtaaccggttaagttaccggttaataaccggtactaaaccgtaaacggttacggtaaacgtaacggtaacccgtaaaagggttacggttaacggggtaacggaaccgggttaccggtttaccgtttacggttttaaacttaacgggttaacggttaaaaccggggaaaaggggtacggggggttaaacttaagggaacgggttcggaaccgtacggtaaccccgttaccggtaaacggtttaacccggtttaacgttacggttaccggtttaacccgggg

SEQ ID NO: 121832 - DNA, 932 bp, Homo sapiens
  misc_feature: GYAE6OF01D70D8.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgaacttgggttttcctcgttgcttcgttttaagaggtgtccagtgtcaagtgcaacgtggtggagtcgtgggggagtcgtagtccgaggccgtggggacgtcacgagacgactcctcctgtcgcacgtccttcggtcggttaccaccgtttcgaagttacgaccgttacggctagtcgactaccggttacggggtccccaacccgtaaacgtcccggaaggggtaccggtaaaggggttaggtttacggggaacggggttcgggggttacgggtaccgtttaagggtttttcgttttaaccgaacgttttcggtacgggggtaacgggttcgttaacgggtttttcgggtttaaaccgaaaggttttcggggttaaagttccggttaccggttaccggggtaaccccgggtacccggggtttaaacggggaaacccgggggtcccctttaaccgttttaacccggaaccccgttaccgttacccgttaaccccgaacgggtaaaccgtaaacccgtaaaccgtacccggaaaacggtaaaccgtaacgtaaacgtttacggtttaacgttaccggtaaccgttaacggtaaaccgtaaccggtaaccgtttaaaccggtcccgtaagggtaaccgggtaaccgttacggggttaacttaaccgttacgttaacggttacgggtaaacgggaacggggtaacgggggaaccgtagggaaccgggtacgttaccggtaaagtttacccgttacggtttaccgacgggtacccggtagggcccggttaaccggg

SEQ ID NO: 121833 - DNA, 709 bp, Homo sapiens
  misc_feature: GYAE6OF01DSPH5.8.38.D05.1.454.CMB.1.raw
  modified_base (204)..(204): a, c, t, g, unknown or other
  misc_feature (204)..(204): n is a, c, g, or t
  modified_base (429)..(429): a, c, t, g, unknown or other
  misc_feature (429)..(429): n is a, c, g, or t
tcagctcgcgtgtccacgaccggtgctcgatttagtatctgatagttgggtttgggggaggaactgctcagttaggacccagagggaaccatggaagcccagctcagcttctcttcctcctgctactctggcctccagataccgaccggagagattgtgttgacacagtctccagccacctgtctttgtactcgaaggggaaangcccaccgtctcgtagcgagggccagtcaagtacgtcgttaacccaccgtagttacgccttaggaaccaaacgaccgaaaccgtggaccgacggcctcccgacggtccctatacgttctttgactcggactacgtccatcgacggccacgtgcctacgtcccagccgtaagttcaggttcggcgtaggcggttcgaggacacggtcttacacgttctacacctanccgagtaccgacgtaccgtaacggacgtaccgtagtaacgttacttttacggtacgtttaagttttaacttacggttacttaacgtaactacgttaccggtacggtacggtccggtacccggtccggggtacccttaccgggtttaccggtacccggttaacggtaaccgttaaaggtacgaacggtacgtaaacgttaaaaccggacgttacgttcgggtactacggacctacggttacttacgttacgtactttacaccgtttaccgtcccgtaaccg

SEQ ID NO: 121834 - DNA, 846 bp, Homo sapiens
  misc_feature: GYAE6OF01CPWWT.8.38.D05.1.454.CMB.1.raw
  modified_base (181)..(181): a, c, t, g, unknown or other
  misc_feature (181)..(181): n is a, c, g, or t
  modified_base (418)..(418): a, c, t, g, unknown or other
  misc_feature (418)..(418): n is a, c, g, or t
tcagctcgcgtgtccacgaccggtgctcgatttagtatctgatagttgggtttggtgggagaggagcccagcactagaagtcggcggtgtttccattcggtgatcagcactgaacacagaggactcaccagtggagtttgggctgagtcgttgggttttcctcgttgcttcgttttaaagnggtgtccagtgtacaagtgcctaagtgggtacggaggtccgggtggggggggcgttcggtccgacggccgttggggacggttccccgtggaacgtaccttccgtccgttggtccgaccgtagggtccttcgtaggtacttcctaaccgttacgaacgtaacgtaccggcgttacgaccgtaccggtcgggtccgcccgtacggacctacccgaggaccgtaacgggtcgttaagggnggtcggtcgtggtacgtagttcggttactagtcgtaaggtaaaggtagtacgttataactacgtacgtaacgaacgtaccgtacgggtaggaaccggtacctacgttaccaaccgtacgttaccaaccggaacgtaaacgtaacccgtaaactaaccgaaaacggtaaactaccggttataacgttacgtctaaacggtaccgtaaaagacggtaaccgtaaccggttaacgtaaaggtaacgggttaaccggaacgggttaaaccccgtttaaggtaccgttttaacgttttaaaggttaaaccgggaagggttaaaaccgggtaaaggggggtaaccgggtaactaaacgggtagggtacccggaaggttaacgtaccccgttaaacgttaaaggttacccgttaacggttttaacggtcccgggg

SEQ ID NO: 121835 - DNA, 545 bp, Homo sapiens
  misc_feature: GYAE6OF01A9AMN.8.38.D05.1.454.CMB.1.raw
  modified_base (205)..(205): a, c, t, g, unknown or other
  misc_feature (205)..(205): n is a, c, g, or t
  modified_base (408)..(408): a, c, t, g, unknown or other
  misc_feature (408)..(408): n is a, c, g, or t
  modified_base (493)..(493): a, c, t, g, unknown or other
  misc_feature (493)..(493): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagngccaccctctcctgcagggccagtcagagtgttaccacccagttagcctggtaccaacacaaacctggccaggcctcccaggcccctcatcttgatgcatccatcgagggccactggccatcccagccaggttcaggtggcaggtgggtcgtgggacaggtacttcactctcacctatcagcacgcctagacgcctgaagttntttgactagtttattactagtacaacgtatcgtacgagtcggccgtccggggcctacgttccggcccgtagggaacctaagtganagtacaaacgtatggtcgctgcacattctcgttcttcacttccgtcccgtac

SEQ ID NO: 121836 - DNA, 917 bp, Homo sapiens
  misc_feature: GYAE6OF01AYHKI.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcttgggttttcctcgttgcttcttttaagaggtcgtccagtgtcaagtgcaactggtggagttcggtggggggggcgttgggtccctaggcccgttggggacgtcccgtggacgtactccgtccgtgtgcgaggtcctcgtggtattccacctttacgaagttaaccgtcgggtaccgtggcctacggttcgggtcccgaccgtacgggcctccgaacgggcgaacggggtcttcgggacgttgggccgttagggcgttaaggttttcgttttacgaacgttactagggtaaaagggtaaggtttacgtttaaccgaaatttaaccggtaacgtttaaaccgacgttaacccgtacccgggtaacgggtaaacggggtacccgtaaactttacccgtaaccgtaacttcccgtacccgaaacgtacgtaaacccgtaaacgtttaaacccgaaacgtaaaccgtaaccggaactttacggtaacttaccgtacgaaccaaacgtttacggaacctaacggttacccgttaaaggtacggttaacgggtaaccgggtaacccgtaacgggttaccttacgggtttttaacgtaaaccgggtttaacggttaaacgtaaaacggggggttaacgggggtaaacgtttaaaccgggtacggggtttaaccgggacccgttaaacggtaacccccgggtttaaaccggttaaaacccggtttaaaacggtttaccccggtttttttaaaccgggccggtttttaaaaccccgggggg

SEQ ID NO: 121837 - DNA, 691 bp, Homo sapiens
  misc_feature: GYAE6OF01A8V4U.8.38.D05.1.454.CMB.1.raw
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgagggaagagccaccctctcctgcagggccagtcagagtcgttaccacccagttacgcctggtaccaacacaaacctggccaggcctcccaggcccctcacttctttagatgcactccatccgacgggccacgtggaccactcccacgccgtaggttcaggtcggacgtaggttcggggtcgtacggggacaacggtaccttcgtacctcctaccaacctactccgacgtaccaacgtcccttaaggaccgtccgtaaggtaaacgtttatttttcggaaccgttaagtttttactaccgtttagtaccaaacgttcgttacccggtacggtaggtcccggtccgggttacccggggacccttaccggtttcccgggaccccgtaagggtaaacctaaaggtttcggaactacgtaaccgaaacggttacgtcgggtacgtacgtacgacctaccctaagttccgttcgttacttaccactttccccgtcccgtaac

SEQ ID NO: 121838 - DNA, 649 bp, Homo sapiens
  misc_feature: GYAE6OF01D54BO.8.38.D05.1.454.CMB.1.raw
  modified_base (206)..(206): a, c, t, g, unknown or other
  misc_feature (206)..(206): n is a, c, g, or t
  modified_base (317)..(317): a, c, t, g, unknown or other
  misc_feature (317)..(317): n is a, c, g, or t
  modified_base (420)..(420): a, c, t, g, unknown or other
  misc_feature (420)..(420): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagatacccaccggagagattgtgttgacacagtctccagccaccctgtctttgctccgaagggggaaancgcccacccctctcctgcagggccagtcagagtcgttacccaccctagttacgcctggtaacccaacacaaacctggacccaggcctcccacggcccctcatctatcggtncgtatccaacgacgggccacgtggcactcccgagccgtaggtccagtcgacgaggttggtatggggaacacgcttcactctacaccatcatcacgtctggacnccgtaggagtattgttgacttagtttattacttagtacaacgtagttccggtaaccgtaggtccggtcccggtaccggggtacccttaccggtttcccgggtcccgttacggggaacccgtagggtacgggaacgtaccgtaaccgaaaaccggtaacggtggtcgggacctcgacccgaaccctagttaccgttcgtttacccttcaccgtttccctccccgtaaccg

SEQ ID NO: 121839 - DNA, 713 bp, Homo sapiens
  misc_feature: GYAE6OF01DDUHB.8.38.D05.1.454.CMB.1.raw
  modified_base (199)..(199): a, c, t, g, unknown or other
  misc_feature (199)..(199): n is a, c, g, or t
  modified_base (352)..(352): a, c, t, g, unknown or other
  misc_feature (352)..(352): n is a, c, g, or t
  modified_base (419)..(419): a, c, t, g, unknown or other
  misc_feature (419)..(419): n is a, c, g, or t
tcagctcgcgtgtccacgaccggtgctcgatttagtatctgatagttgggtttgggggaggaactgctcagttaggacccagagggaccatggaagccccagctcagcttctcttcctcctgctactctggctcccagataccacggagagattgtgttgacacagtctccagccaccctgtctttgctcgaggggaancgccacctctcctgcagggccagtcagagttcgttaccacctagttacgcctaggtacccaacaccaaaccgtcggaccacgggcctccccgaacggtcccctactaacttcgtttagacttcgctactccatccgagggccaacgtcggacnctcccgagccgaggttccagtcggactaggttcgggtcgtaggggactaggtacctttcacgttccnccgtaacacttaccgacggtaccacgggtacccttaacgggaccgtaccgttaaggaacgttagtttttcgaacgtttaacgttttacttacgtagttaacccgaactacgttacccggttaccgagggttccggtcccggttccgggggacccttaccggtttccgggacccggtaacgggtaaacctaaaggttcgaacgtaacgttaaccgaaaccgtacgtcgggtacggaccttggacccaaccttcgttacgttcgttacccttctaaccgttcccgtttcccgaacc

SEQ ID NO: 121840 - DNA, 755 bp, Homo sapiens
  misc_feature: GYAE6OF01C6EDX.8.38.D05.1.454.CMB.1.raw
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagcccaccctgttctttgtctccgaggggaaagacgcccaccctctcctgcgagggccagtcagtaggttacgttacccacccgtagttacgccgttacggtaacccaacaaccaaaccgtcggaccacggcctaccccgacggccccctactacttctttgatcgctactccatccgacggccacgtggctaccgtcccgagtccgtaggttacaggtcggcgtacggttcggggtcgtacggggaacctaggtaccttaccgaccttccctaccgtaacctactacgacgtaccgacgaccgttaacggaccgtaccgtagtaacgtttacgttttacgacgtttaagttttacttaccgtagttaactaacgtacgttaaccggtaccggtacgggtccgggtccccgggttacccggggtacccgtttacccggtttacccgggtacccgttaacggggtaaaccttaaacggttcggaaacggtaacctaaacgaaaccgtacgttcggtaccggtcgttacacctacccgttagtccgtttacgtaccttacgtacccttcccgtaccccgtaccg

SEQ ID NO: 121841 - DNA, 656 bp, Homo sapiens
  misc_feature: GYAE6OF01DJVGS.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaacgtggtggagtcggtgggggggcgtggtccagccgtgggaggtcacgagagactcgtcgtgtgcagcctcgtggttccaccttacagtaaccgtacggcagtgcgacgtcgggtcccgaccaagtcctaccgaggacgaaagggtgttgggaggtgggtagctaggtttgttacattcgtaggaggctagtcgttacgaagttggtatgacgagtaccgttcggaggaacgggccctataccaacctataccgtacgaagacgtaacgtaacttacgaacggaacaactaagtacgttagttaggacgtactacgaacgtacgtacctaacgtccgtaggacggacgacgggtacgtaacgtacgtacgtacggtaaggaacggggaacggggtaacgacgggtacgggtacgttaccgaagttaccgttaccgttaggtaccggtcggtcgggtacccgg

SEQ ID NO: 121842 - DNA, 754 bp, Homo sapiens
  misc_feature: GYAE6OF01AID7E.8.38.D05.1.454.CMB.1.raw
  modified_base (222)..(222): a, c, t, g, unknown or other
  misc_feature (222)..(222): n is a, c, g, or t
  modified_base (581)..(581): a, c, t, g, unknown or other
  misc_feature (581)..(581): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggcctcccagactaccgaccggagagtattgttgttagaccacagtcctccacgccctacccttgttctttgccgtaccggaaggggaaacncgccctaccctctccgtggccgacgggcctagtcaggtacgttcgtacccaccgtagttacgaccgttacggtaaaccaaccgaacctaaaccgtcggacccgtacggccccttaccccgtaccggtcccctactaacttttccgtttagaacgttccgacctaccttacccgaacggttccggaccgggtaccctacggttccggaaccctaccgtaccccggtaacggtccggttaacggtttcgacgggtcgtaccggtagggttccggggtcgtaaggggcctaacgtacccgtttccgaaccgtcctaaccacgtacgtacgacgtacacgtccgtagcccttagattacgttntttgtacttagtttactacgtacgtaactacgtctaccggtacgtggtccgggtccggtaccggtaccgttaccggtccggtaccgtaagtaaccctaagtacgacgtactacggtaaaccgcgttcgacggatcacgtactctccgtacttactacttccctcgttccctac

SEQ ID NO: 121843 - DNA, 866 bp, Homo sapiens
  misc_feature: GYAE6OF01C6BUJ.8.38.D05.1.454.CMB.1.raw
  modified_base (211)..(211): a, c, t, g, unknown or other
  misc_feature (211)..(211): n is a, c, g, or t
  modified_base (340)..(340): a, c, t, g, unknown or other
  misc_feature (340)..(340): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggcctccagactaccgaccggagagtattgtgttgacacagtctccacgcctacctgtctttgtacctccgaaggggaaanacgccaccctctcctgcgaggccagtcagtacgtacgttacccacctaggttacgaccgtacggtaaaccaaccaaccgaaaccgtcggacctaacggcctaccccgacggtccctactacttcgttanacgtcgtactactaccacgttcgaaccgggccaacgtcggacctaaccctcccgtaacgtaccggtacgggtttacgtaacggcggtacgtaacggggttcggggttccggtaggggaccgttaacggtaacgtttcccgtaacgttacctaccaacccttaaacgtcgaaacgtccgtaaccgtaccgtaacgtacggtacccttaaggtaaacgtttacgtttttacggtaacgttttaaacttttaacgtttaccgtagtttaaccgtaaaccgtttaccgttacccggttaaaccggtaccgggttcccgggtaccccggggttaacccggggttaaccccgttccgggtttacccgggtaaccccgggttacgggttaaaccggtaacgggtaaccgggtaaacgtaacggttaaaccggaaaaccgtacggttagggtcccggtaacctacggtaccccgtaacgtcttaccggtttaccttactttacccggtaacccttttacccgtccccgttaccg

SEQ ID NO: 121844 - DNA, 953 bp, Homo sapiens
  misc_feature: GYAE6OF01D1MVF.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagtcttgggtttttcctcgttgcttcttttaagaggtgtccagtgtcaagtgcaacgtgggtggagtcggtggggggggctggtccgagtccgtggggacggtccctgagtactctccgtgtgcgaggctcgtaggtattcctaaccttcgaacggttaacctaccggggtccgtaggcctaaccggttcggggtccccgaccgtacgggtccctaccggaaggggtacccgtaacgggggttcctttaggggacggttcgggccgttcgggtacgttacggtttttcgttttaccgaacgtttacggttaaggaaaggttaacggtttacgtttaaacctaaaacgtttacctaaagtaaccgtaaccggttaaacccgttccgggtaaacgggtaaaccgggtccccgttaacgtttaaccccgaacccgttaacgttcccgtaacccggtaaacggtacgtaaaacccgttaaacgtttaaaccccggaaaaacggtaaaccctaacggttaactttacgggttaacctaccgttaaccggaaccgttaaacgggtaccggtaaacggtaacccggttaaaccgttaagggttaaccggtttacgggaacgggtaaccgttaccgggtttaacttttaacggtttttaaaccgtttaaccggttaaacggggtaaaaccgggttaaacgggggtaaggggggtaaacccgttaaggtaacgggttaccgggacccgtaaccggttaacccggtaaacgttaaaccgtttacccgtttaaccgtttaccggttcggttaaccccggggg

SEQ ID NO: 121845 - DNA, 759 bp, Homo sapiens
  misc_feature: GYAE6OF01ET2FW.8.38.D05.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtcttgtctcgaggggaanacgccaccctctcctgcgacgggccagtcaggtatcgttacccacctagttacgcctacggtaaccaaacaccaaacctggaccaggcctccccgacggcccctnattcctagtcggtgacctactccgaaaccggtcggggacccctacggtcgggaccaaccgttccccaaggtacccgtacgggttacacggggttcggacgtaagggtttaggggtaacgttcggggaaactacggtaactttccaccgttcctacccgtaaccacttaccattaccgacgttccggtaggaaccgtcgtagggtacggtaatttcgggtgttaacggttaattttacgtaaccgttggttaacccaattacgttaccggtacggtacgggtccgggtacccggtcccgggggtcccttacccgggtttcccgggcccgggttaacggaacccggtaacggttacggaacttaacgaacgtaaaccggtacgtagggttcggtacgtacgtaccgaccttacgttcgttaccgttctaaccgttcccgttcccgtcccgtaccg

SEQ ID NO: 121846 - DNA, 853 bp, Homo sapiens
  misc_feature: GYAE6OF01CIQTA.8.38.D05.1.454.CMB.1.raw
tcagctcgcgtgtccacgaccggtgctcgatttagtatctgatagttgggtttggggagaggagcccagcactagaagtcggcggtgttccattcggtgatcagcactgaacacagaggactcaccagtggtagtttgggctgagtcttgggttttcctcgttgcttcgttttaagaggtgtccagtggtacaagtgacaacgtggtggaggtcggtgggggggctggtccagccgtgggacgtcccgtagagtaccttcgtccgtgtgcgtaacggcttcgtcgggtaactttccgaccgtttaccgaacggttaaaaccggtaccgggtcgtaacgtccggaccggttcgggggttccccacggaacgggtcctaccggaagggccgtaaacggggtctttaggggaggttcgggcgtcggtcggttagttttcggttacacgttaccggtaggtaaacggtacggtttagttaaaccaaatttacggtaactaacggaaaccggttaaccgttcccgggtaaggggaaaccgggtacccgttaacggtttaccccgaaaccgtctttaacccgaaccccgttaaggtaaaccgtaaaccgtaaacttacccgaaaaaggtaaaccgaccggtaattacgttaacgtaccgtagtaaccgtaagtacgggaaaccgtaacggtaccgttaaggtaaccggttaaggacgtaaccggtacgttacgttagtttaaaccgtaacgtagggttaaacgaaagggggtagggtaacgtaacggtacgggtacggaccaagggttacccgttaaacgtacggttaccttaacgtttcggtaacccggttcccgggg

SEQ ID NO: 121847 - DNA, 892 bp, Homo sapiens
  misc_feature: GYAE6OF01DEC1B.8.38.D05.1.454.CMB.1.raw
tcagctcgcgtgtccacgaccggtgctcgatttagtatctgatagttgggtttggggagaggagcccagcactagaagtcggcggtgttccattcggtgatcagcactgaacacagaggactcaccatggagtttgggctgagtcgttgggttttcctcgttgcttcgttttaagaggtgtccagtgtcaagtgacaacgtggtggagttcggtggggggggcgtcggtccgacgtccgtggggacggtcccgtgggacttcgtccgtgtcgcgaggctcgtggacttctaccttcacgtaacgtacggcgtgactacggtcgggtccgccgacggtcctaccggaaggaccgaacggggtcgtttacggggacggttcgggccgttgggtaccgttaggtttcgtttacgacgttcggtaggtaaaaggtacggtttcgttaactaaaacttaccgtaagtaacgacggtaccgtaccgggtagggtaaaccggtaccgtaacttccgaaccgtacgttacccgtaaccgaacggtaaaccgtaacctaaacccgacccgtaaaggaaaacctaacgtaagtttacggttaacgttttaaccgggaccctaacggaaacctacggtaaccccggtttaaacgtccggttaaaggaaccgggttaacccgtaagggggtttacttaaaccgttaaccgtttaacgggtaccgggttaaaagggaaaccggggggttaccgggggaaaaccccgtggggtaacccgggggttaaccgtttaacccgttaaaccgggtttcccgttttaacccggtttaaggggaacccggttttcccggggtaaacggggccccggtttaaacccggggttccccgttgggttaaacccccgg

SEQ ID NO: 121848 - DNA, 879 bp, Homo sapiens
  misc_feature: GYAE6OF01BL8NH.8.38.D05.1.454.CMB.1.raw
  modified_base (186)..(186): a, c, t, g, unknown or other
  misc_feature (186)..(186): n is a, c, g, or t
tcagctcgcgtgtccacgaccggtgctcgatttagtatctgataggtttgggtttggggagaggacgcccagcactagaagtcggcggtgtttccattcggtgatcagcactgaacacagaggactcaccatgggtagtttgggctgagtcgttgggttttcctcgttgtcctttagttttaaggnggttcgtcctaggtcgtacgtaaaggtcgtaccgtaaggttgggtacggggtagggttccggggggtcgggggggggggtccttccgggtacccgtaaccgggtcccgggttacggggggacccgtttccccgtaggtaccggtaccctttccgttcccggttaggtcggaccgtcgggtccttggtacggttacctttacccgtaccgtttacggtaacggttaaccggtacgggtcgtacgtacgtccggtccgggtccgaccgtacggtaccgtacggaacgggacgggtaacgggttcggtttagggacggttcgggtcgtacggtacgtttacggttttcgttaactacggttaggtaacggggtaagtacggtttactaacttaacgtacgtactaacgagtaccgtaggacggtacgacctacgtacactacgtaccgtacagtaacgtaacctaacgttacgaacgtaactagttactacgttacgtacgtaactaacgaacggtacgaacgtaacgttaacggtaaggtcggtaagggacgtaccggtagtttacgttacgtttaaccgaaggttacgggtaaacgggaaggggttacggtacgtacgggaggttacgaaccgttacggtaaccgttaaccggtaaccgtttacgttacggttcccgggtaacgttacccgggg

SEQ ID NO: 121849 - DNA, 837 bp, Homo sapiens
  misc_feature: GYAE6OF01D6P5F.8.38.D05.1.454.CMB.1.raw
  modified_base (206)..(206): a, c, t, g, unknown or other
  misc_feature (206)..(206): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctccagataccaccggagagattgtgttgacacgagtctccagcctaccctgttctttgtctccgaggggaaanacgccacccttctctgcagggccagtcagtagtcgttaccacctagttacgccgttaggtaaccaacctaacgaaaccgtcggaccacggtccctacccgaccggtccccctactaacgtttctttagaacgtcgtacaccgtacccgaacggtacgggaccctaacgtacggacctaacctacccgtaacggacccgttaacggttccgaagggtcggtacgttaggggttacggggtacggtacggggtaactaacggtaccgttttaaccaaccgtttcctaccaaccgtacttaccgtaactaccgtacggtcccgtagggtacccgtaccggtaaggtaacgtacggtttacggttacgttaaccgtttaaggtttttaaccgttacgttacgttaaaccgtaacgttaaccgttaccgggtaccccgggttaacggtccgggtaccccggggttcccggggtaacccgtttacccggggtttaccccgggaccccgggttacggggtaaccggttaacgggtacggaaacggttaaccgtaacgaaaacggtacggttcggtacggtcgtacgtaccaaccgtacttcgttacggttctaacggttcccttaccgtcccgtaacg

SEQ ID NO: 121850 - DNA, 697 bp, Homo sapiens
  misc_feature: GYAE6OF01E2IAC.8.38.D05.1.454.CMB.1.raw
  modified_base (204)..(204): a, c, t, g, unknown or other
  misc_feature (204)..(204): n is a, c, g, or t
tcagctcgcgtgtccacgaccggtgctcgatttagtatctgatagttgggtttgggggaggaactgctcagttaggacccagagggaaccattgaagccccagctcagcttctcttcctcctgctactctggctccaagataccaccggagagattgtgttgacacagtctccagccaccctgtctttgtctccaggggaaagngcccacccgtctcctgcgacgggccagtcagagtcgttacccacccgtagttacgccttggtaccaacaaccaaaccgtggccaggcctcccgacggcccctcattctttgatcgcactccatcgacggccacgtggcactcccgacgccgtacggttcacgttggcgaggttgggtcgtggggactacggtaccttcacctctaccgaaccgtatccgagccagaccctaagaccgccgtagaacgttagttttcgacgtttaagttttacttaacgttgttaacctaaacgtagttaccgtaaccggtcggtcgggtcccggtacccgggggtaccctaccggtttccgggtacccgttacgggtaaaccctaaaagttcggaacgtaacgtaaccgaaaaaccggtacgttagggtcggtaccgtcgtaaccctaacccgtacgttccgttacgttaccctttacctaccctttccccgtcccgtacccg

SEQ ID NO: 121851 - DNA, 648 bp, Homo sapiens
  misc_feature: GYAE6OF01BTICV.8.38.D05.1.454.CMB.1.raw
  modified_base (204)..(204): a, c, t, g, unknown or other
  misc_feature (204)..(204): n is a, c, g, or t
tcagctcgcgtgtccacgaccggtgctcgatttagtatctgatagttgggtttgggggaggaactgctcagttaggacccagagggaaccatggaagcccagctcagcttctcttcctcctgctactctggctccagataccaccggagagattgtgttcgacacagtctccagcctaccctgtctttgctccgaggggaaacncgcctacccgtctcctgccgacgggcctagtccagtagttcgttacccaccgtaagttacgcctaggtaaccaacaaccgaaaccgtcggaccaaggccctacccgacggtcccctcacttctttggactgactactccattcgacggtccacgtaggccatcccagccctaggttcaggtggcaggtcggtcgtacgggacacgtacttcgactcgacctacatcgagtcaacgtcgtagagctaggtacgttacgtttagacgttagtttactactacgtacaactacgtaccggtacgtaggtccggtacggtcccggggtaccttaccgttacccgtacccgttacgggaacctaaacgtcgaacgtactaacgtaacgtaacgtcgacggtcacgtcaccgtacttccgttcgtaccgttactacttcccgtcccgtac

SEQ ID NO: 121852 - DNA, 766 bp, Homo sapiens
  misc_feature: GYAE6OF01AWCL2.8.38.D05.1.454.CMB.1.raw
  modified_base (223)..(223): a, c, t, g, unknown or other
  misc_feature (223)..(223): n is a, c, g, or t
tcagctcgcgtgtccacgaccggtgctcgatttagtatctgatagttggggtttggggggaggaactgctcagttaggacccagagggaaccatggaacgccccagctcagtcttctcttcctcctgctactctggcctacccagactacccgaccgggagagtattggtgttgacactagtcctccacgccctacctgttctttgtctacggaaggggaacncgccctaccctctcctgacgacgggcctagtacagtacgttacgtacccaccgtagttcgacctacggtaaccaacaaccgaaccgtcggacccgacggtaccctcccgaccgtcccctactactttcgttacgacttcgaccctacgtaccgtacgtaccgggaccgggtaccctacggtcggaccctaccgtaccccggacggtaaccggtttacggtacggttacgggtaccgggtacgggttaccgggttcggggtaccgtacgggggaacctacggtttacccctacgttaccgtacccgttacccaaccgtacgtaccgtacgcccgtacggtaccgtaacggtccgtaacgttaggttaacgtttcgtttaacgtactttaagtttactacgtactactacgttacggtcccgtaggcggttccgggtaccggtcccggtacttccgggtccgtaccggtagtacttaagcaagactaccgaagtatcggcgtcacggtactactagttcctcgttactactccttcccgtctacg

SEQ ID NO: 121853 - DNA, 777 bp, Homo sapiens
  misc_feature: GYAE6OF01DQWJ3.8.38.D05.1.454.CMB.1.raw
  modified_base (313)..(313): a, c, t, g, unknown or other
  misc_feature (313)..(313): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcttgggttttcctcgttgcttcttttaagagtgtccagtgtcaagtgcaacgtggtggagtcggtgggggggctggtccagccgtgggacgtccctgagactctctgtgcaggtctcgtaggtacttccacctttcgaagtaaccgtacggctcgcacgtcgggtcccncgacggcctaccgaggaccgtaaggggtcgttagggacgtggtccgtaggtcgttagtttcgttacacgtcgttaggaaaggtacgttgttaacaaattactacgtaacgacgtacgtccggtaggaacggccgtaacttaccgactacgtcctacgaacggtaacgaaaccttaaacttaaccgaaaacggtaacccaacggttaacgttacggttaaacgttacctaggtaaaccgtaaaggtacgggaaccgttaaaccgtaacccgggttaaaggtaaccggtttaagggaaccggtaacccggttaaccggttacgtttttaacgtttaaacgttaaccggttaaggggtaaacgtaaacgggggtaacgggggtaaacttaacgggaagggttaccggactaacgtaccgtaaaccgtaaacgttaccttttaaacggttcgtacgttaaacccgggg

SEQ ID NO: 121854 - DNA, 841 bp, Homo sapiens
  misc_feature: GYAE6OF01ALAZC.8.38.D05.1.454.CMB.1.raw
tcagctcgcgtgtccacgaccggtgctcgatttagtatctgataggttgggtttggggagaggagcccagcactagaagtcggcggtgtttccattcggtgatcagcactgaacacagaggactcacagtggtagtttgggctgagtcgttcgggttttcctcgttgtcttacgtttttaaggaggtgtcctagtcgtacaagtgtacgtaacgtgggtgggtagggttcggggtcggggggggcttcggtacccgacggtccggtggggtacggttccccgtaggtacgtaccttccgttccgtggtcgccgtacggtccgttcgttacggtactttaccctaccgttacgtaacgttaaccggtacggtccgtcgaccggtacgtcgggtcccgaccgaggtccgtaccggaggtaccggtaagggtcgttgggtaggtcggtcgtggacgttagtttcgtttagacgttacggtaaggtaaacgggtagttcgttaactaaacttacgttaaacgtaccgtacggtacccgttacgggtaaacgggtaaccgggaccttacgttacccaaccgttaccgtacccgtaacgaacgtaactaaacccgtaaacctaaaccgtaaacgaaacgtaacgtaagttacgtaacgttacctagaacgtaagaccggtaagaacggttacgtaaaggtcgtaacggacgtacgttacgttatttacgttacgtaggtaaggtaaacggggtaaacgggtaggggtaactaacgggacggtacgacggttacgaaccgtttaacggttaaccttaacggtttcgttaaaccgtgggttaacccggg

SEQ ID NO: 121855 - DNA, 952 bp, Homo sapiens
  misc_feature: GYAE6OF01A7ZUF.8.38.D05.1.454.CMB.1.raw
  modified_base (119)..(119): a, c, t, g, unknown or other
  misc_feature (119)..(119): n is a, c, g, or t
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagctcgcgtgtccacgaccggtgctcgatttagtatctgatagttgggtttgggggaggaactgctcagttaggacccagagggaaccatggaagccccagctcagcttctcttccncctgctactctggctcccagataccaccgganagtattcgtgttgacacagtctccagccacctgtcttgtctacaggggaaancgcccaccctctccgtgcacgggccagtcaggtagtcgttaacccaccaagtttcgccgttcggtacccaaacaacaaaccgttggccacggccttccccgacggccccctatacttctttcgagtttcgcctactccgatcgaacggggtcccaacggttcgggacctaccgtaccccgtacgggcccgttaacgggttcccgtaaggttcggggtactaacggggttccggggttagttacggggggacccttaaaggtacccgttttccaaaccttttcccggtaacccaaaaccccgtattacccgtaaacggtccgtaaccggggccttaacgggaacccggtaccgtttaaagggttaaacgtttacgttttttacggtaccttaaaggttttttttaacccttaacgttcgtttaaacccaaaccgtttaacgttaccccgggttaaaccggttaacgggttaccggggccccccggtttccggggggtttaacccccttacccggggtttttacccgggtaacccccgggtttaaaagggggtaaccccccgttaaaaaggttttaccgggaaaacgttaaaaccggttaccctaaaaaaaccgggggttaaccctttacgggtccgggttaaacccccggtttggaacccccggtaaaccccttacggttttaaccgtttacccgttttcccgtttaaacccggtaacccctttttcccccggtaaccccggttaccccg

SEQ ID NO: 121856 - DNA, 813 bp, Homo sapiens
  misc_feature: GYAE6OF01ANJP3.8.38.D05.1.454.CMB.1.raw
  modified_base (157)..(157): a, c, t, g, unknown or other
  misc_feature (157)..(157): n is a, c, g, or t
  modified_base (656)..(656): a, c, t, g, unknown or other
  misc_feature (656)..(656): n is a, c, g, or t
tcagctcgcgtgtccacgaccggtgctcgatttagtatctgatagttgggtttgggggaggaactgctcagttaggacccagagggaaccatggaacgccccagctcagcttctcttcctcctgcctactcgtggcctccgagactacccacggganagtatttgtgttgaccactacgtcctccacgccctaccttggttcttttcgtccgtaccggaagggggaaacgccgtaccccaccccttcgtcccgtggaccggaccgggtccgtagtaccgaggtacgttaccgttaacccacccggttagtaccgtcccgtaacggtaaacccaacgaacctaaccgtcggtaccccgacggtcccctaacccgtaccggtccccttctactttacgtttacgacgtcgaccgtacctccaacgttccggaccgggtaacctccggtacgacccgtacctacccgaacggtaccgtacggttacgtacggttcgggacgtacgggttcgggtaccgggtacggacgtaaccgttccttactaccgtaccgacctaccgtctacgcggcgtacctcgtaccgcgttacggtaagtagtttaacgttctaacgttacgtttacgtacgttcttacgaacgtacgggttaccgtaccggngtacccgggtcccggttaccgggtaccgttcccggtaccgggtacccgtacggtaaacgtaaacgttcggaactaacgtacgtaacggtacggtccggtggtacctacggtccaagttacttccgttcttacgttaccctcgttcccctcggtaccc

SEQ ID NO: 121857 - DNA, 765 bp, Homo sapiens
  misc_feature: GYAE6OF01C2BR3.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagttgggctgagcttgggttttcctcgttgcttcttttaagagtgtcagtgtcaagtgcaacgtggtggagtcggtgggggggctggtccagccgtgggacgtccctgacgactcctccgtgtcgcgaggctcgtggacttccaccttcgaggttacgccgtacggctaagtcgacgtacggtcgggtccccgaaccaaaccgtccgaggacgaagggtacgtggggacggtgggtcggtacgttaggtttcgttacgtacgtcggtaggacgggtcgtagggtttcgttactaaggtttggtactcgtaccgtcggacggtccggtaggaacggtcccgtattacccgaactattcccgaactaacggaacctaccgaaaccgtaacccggaaggaactaaccgtaagtttacggtacgttttacgtaaccccgtagtaaaccgtacgttaacccgtaacgttaccgtaagggtaccggtaacggtacgggttaattaccgtaacttacgggtacggtaaacggggacggggaacggggtaaccgaagggtccgggtaaccgttaaccgggtaaccgttcgtttacccggttaacgggtccggttaaccgggccgggtacccgttaacccggg

SEQ ID NO: 121858 - DNA, 843 bp, Homo sapiens
  misc_feature: GYAE6OF01E3C9L.8.38.D05.1.454.CMB.1.raw
  modified_base (170)..(170): a, c, t, g, unknown or other
  misc_feature (170)..(170): n is a, c, g, or t
  modified_base (214)..(214): a, c, t, g, unknown or other
  misc_feature (214)..(214): n is a, c, g, or t
  modified_base (836)..(836): a, c, t, g, unknown or other
  misc_feature (836)..(836): n is a, c, g, or t
tcagctcgcgtgtccacgaccggtgctcgatttagtatctgatagttgggtttgggggagaactgctcagttaggacccagagggaaccatggaacgccccagctcagcttctcttcctcctgctactctggcctcccagactaccaccggagagtattgtgttgacacngtcctccacgcccaccttgttctttcgctccggaaggggaaacncgccctaccctctccgtgcgacggcctagtcagtacgttcgtaacccaccgtaggttccgccgttacggtaacccaactaacccgaaaccgtcgggacccgtacggtccctacccgtaccggtcccccttataccgtttccttttaggaacttccggtacctaacgttacccgtacgtacccgggaccgggtacccctacggtaccggtaccctacccgtaccccggtaacggtaccccggttaacgggtttccggaacgggttacgggtaccggtaaacggggtttccgggggtaccttaacggggggtaacctaaccgggtttaacctttacccggaccttacgtacccgactaacggtcaacgaccgtaacggtccacggtacggtacctagtaacgtttagtttaccgtagtttactttaactacgtacttaaccgtaacgtacgttacccggtacggacggttccggggtacccggtcccggggtaacccttaccgggttccccggaaccggttacgggaaaccttaaggtacgtaaccgtacgtaaccgtaaaacgtcgttacgggcttaccgtaacgtctaacgtcttacctccgtactcgtacctttccccggntacccgg

SEQ ID NO: 121859 - DNA, 675 bp, Homo sapiens
  misc_feature: GYAE6OF01DAKSQ.8.38.D05.1.454.CMB.1.raw
  modified_base (164)..(164): a, c, t, g, unknown or other
  misc_feature (164)..(164): n is a, c, g, or t
  modified_base (184)..(184): a, c, t, g, unknown or other
  misc_feature (184)..(184): n is a, c, g, or t
  modified_base (268)..(268): a, c, t, g, unknown or other
  misc_feature (268)..(268): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (547)..(547): a, c, t, g, unknown or other
  misc_feature (547)..(547): n is a, c, g, or t
  modified_base (605)..(605): a, c, t, g, unknown or other
  misc_feature (605)..(605): n is a, c, g, or t
tcagctcgcgtgtccacgaccggtgctcgatttagtatctgatagtttgggtttgggggaagaggagcccagcgacctagaagtcggcggttgttccagttcggtgatcgacgcgactgaacacgagaggactcaccatggtagttggctgagtcgtggtttcngttagcttctttaagaggtntcagtgtcaagtgactaagtggtggacgtcgggtgggggggctggtccagccgtgggacgtccctgagtcctctcgtgtgacgnggtctcgtagtacttctaccttacgaacgttaaccgtcggcgttagccgacggttcggcccgccgtaggccctacgaggtcgaaggtcgttaggngtcggcgtggtcgttagtttcgttacattgaggtaagtagttntaagaagttggtancgngaacgtcgtacgtaggacggtctacttcgactactacgtaccgaagtaacgtaacgacttacgaaacgacctaattagtttagtaacgtgaancgtaanaactacgtacgtaacgcgtaacggngtaaccgtcggttactacttacgtaacggtaaggacgggtaaacggggacggtaacgngggttacggtaactaccggttaagtccgtttacggttacggtacgtcggaccgggtacccgttaaacggg

SEQ ID NO: 121860 - DNA, 876 bp, Homo sapiens
  misc_feature: GYAE6OF01DPLY0.8.38.D05.1.454.CMB.1.raw
  modified_base (839)..(839): a, c, t, g, unknown or other
  misc_feature (839)..(839): n is a, c, g, or t
tcagctcgcgtgtccacgaccggtgctcgatttagtatctgatagttggggtttggggagaggagcccagcactagaagtcggcggtgtttccattcggtgatcagcactgaaacacagaggactccaccatgggtagttttcggggctgtaggtccttggggtttttcccttcggtttgtctttacgtttttaaaggacgggttcgtcctaaggttcgtacgtaaggttcgaccgtaacgttggggtgggtacgggttccggggtcggggggggggtccgtttcgggtcccgtaacggtcccgggttgggggtacccgggttacccccgttaggtaaccggtacctttcccgttccggttcggtagggtacccgtagggtccgttacgttcggttacctttaaccctacccgtttaacggtaacgttaaacccgggtaccggtcgtacggccgtaccgggtaccgggtccccggtaccggacggtccttaccggacgggtaccggtaacggggtccgtaggggtacggtggtcgtacggtcgttggtttacttcgtaatcggtaagtacggtaacgttgttaaacgaacgttctaactacgtacggtacctcggtaaggtaacggtcctagttacccaacgtccgtaccgtaccgaagtaacgtaacctaccgtaacgaaacggtaactacggtacttataccgtttcgaacgtaacgtaaacggtacgtaaccgtaacgtaacgggttaagttaaggtacgtacggtacctacgggttatttaggttaacgttagtaacgggaagtaacggggaggtaggagtcggtacgacgttanacggtaccttacggttacttacgtcgtacgttccggg

SEQ ID NO: 121861 - DNA, 783 bp, Homo sapiens
  misc_feature: GYAE6OF01DIYER.8.38.D05.1.454.CMB.1.raw
  modified_base (405)..(405): a, c, t, g, unknown or other
  misc_feature (405)..(405): n is a, c, g, or t
  modified_base (440)..(440): a, c, t, g, unknown or other
  misc_feature (440)..(440): n is a, c, g, or t
  modified_base (535)..(535): a, c, t, g, unknown or other
  misc_feature (535)..(535): n is a, c, g, or t
  modified_base (725)..(725): a, c, t, g, unknown or other
  misc_feature (725)..(725): n is a, c, g, or t
tcagctcgcgtgtccacgaccggtgctcgatttagtatctgataggttgggtttggggagaggagcccagcactagaagtcggcggtgtttccattcggtgatcagcactgaacacagaggactcactatggtagtttgggctgagtcgttcgggttttcctcgttgtctttacgtttttaaggaggttcgtccgtagtcgtacaaggtcgacgtaacgttgggtagggtaggttcggggtggggggggtacttgggtacccacgggtccggttacggggaacggttcccctaggtaacgtaccttccttcccgtaggtacgcgtacggttccttacgtacggttacttccgtaaccttacggtaacgttaacgaccggtcgttcgcgtaccggttcgggtaccnccgtaggcctaccggaggacggtaggtcgtggagnggtctggtacgtgtttacgttcgacgtacgaggtaagagttgtacaacgttactagtaacgtacgtacgtacggtacggacgtacctagttaccncgtaacttcgaccgaagcgtaacttaaacgtaccgaaagaaccgttacgtagttacgtacgtcgttaaacgaacgtaggttacgacgtaacggttaacgtacggttaacggaccggttacgtacggtaccgttagttttacgttaacgttacgggtaaagtaacgggtaagggtaaggtactacggggtntacgggactacggttaaccctagggttaaccttgttaccttgggtcccgtttacgggg

SEQ ID NO: 121862 - DNA, 703 bp, Homo sapiens
  misc_feature: GYAE6OF01DZ771.8.38.D05.1.454.CMB.1.raw
  modified_base (661)..(661): a, c, t, g, unknown or other
  misc_feature (661)..(661): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcgtgggtttttcctcgttgcttcttttaagaggtgtccagtgtcaagtgcaactggtggagtcgtggggggctggtccagccgtgggacggtccctgagacctctccgtgtgcaggtctcgtggtacttccaccttcaagtaacctccggtcgtcgcgacgtgggtccccgccgacggcctccgaagggaccgaacggggtcgttgggagtggcgtggctagtttgttcagttacgtaggaaggtaagttcgttaacaaagtttaacctagttaaccgaacgtcccgtaccggtagggaaacggggtccctaagtttacccgacctaacgttccctaaccgaaggtaacgtaaaccgtaaacgtttaacccgaaacgtaaacaccgtagtaagttacctacgtacgaaccgtaaaggttacggaacgacggttaaccgtaacggtaggttaggaccggtaacgtacggttacttggtttaatacgtagggtaaacgaaagggtacggggtatacggnggtgaccgtagactacgtaattacgttacttcgcgttacggg

SEQ ID NO: 121863 - DNA, 562 bp, Homo sapiens
  misc_feature: GYAE6OF02I90JW.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggcctccaggcaagggcttgggagtggctggctagttgttcatcgtagaaggagtgtacaatactatacagactccggtgaacggcctatcaccatctccagagacaattaccaagaacacgatagtatctacgacaaataggacacgacctaagagttagaggacgacgtctagtttattacgtagtaacggaagggagggggtaatacgaggtaggacgagactaccgtaagttaccgttacgtttacgtacgttacgg

SEQ ID NO: 121864 - DNA, 274 bp, Homo sapiens
  misc_feature: GYAE6OF02IRSTV.8.38.D05.1.454.CMB.1.raw
  modified_base (261)..(274): a, c, t, g, unknown or other
  misc_feature (261)..(274): n is a, c, g, or t
tcagctcgcgtgtccacgaccggtgctcgatttagtatctgatagttgggtctgggacagacttcactctcaccatcagcagcctagagcctgaagatttgcagtttattactgtcaacatcgtaccgagtggcctccggggccactttcggccctgggaccaaaattgagatcaaacgaactgtaggctgcaccatcctgtcttcatcttccccgcatctgagacacgcgagctgagcgggctggcaaggcgtcaagtgnnnnnnnnnnnnnn

SEQ ID NO: 121865 - DNA, 514 bp, Homo sapiens
  misc_feature: GYAE6OF02HT63U.8.38.D05.1.454.CMB.1.raw
  modified_base (420)..(420): a, c, t, g, unknown or other
  misc_feature (420)..(420): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggctccaggcaagggcttggagtggctggcagttgttcatctgaaggagtgttcaatactatacagactcgtgaagggccattcacatctcagagacaatacaagaacacgatgtatctnacaatgacagacctaagagtgaggacacgctgttattactagtacgaaggaggggaatacgaggtggcgagctacaagtactacttgacttcgg

SEQ ID NO: 121866 - DNA, 551 bp, Homo sapiens
  misc_feature: GYAE6OF02F8O6N.8.38.D05.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (435)..(435): a, c, t, g, unknown or other
  misc_feature (435)..(435): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccacctctcctgcagggccagtcagagtgttaccacccagttagcctggtaccaacacaaacctggccaggctccaggcccctnatctttgatgcatccatcagggccacgtggcactcccagccaggttcagtggcagtgggtctgggacagtcttcactctcaccatcagcagcctagacgctagaagtattttgctagtttattacttgttacaactattccgtacgngtcggccgtcccggggcctacgtttccggcccgtcgggaccgtaagggtcggagacgtacaacgacgtcggtggactcgaccaccgtatcgtcgttcttctacttcctcccgtacc

SEQ ID NO: 121867 - DNA, 557 bp, Homo sapiens
  misc_feature: GYAE6OF02I0OTW.8.38.D05.1.454.CMB.1.raw
  modified_base (203)..(203): a, c, t, g, unknown or other
  misc_feature (203)..(203): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaanagccaccctctcctgcagggccagtcagagtgttaccaccagttagcctggtaccaacacaaacctggaccaggcctcccaggcccctcatctttgatgcatccatcagggccactggcatcccagccaggttcagtggcaggtgggtctgggacagtacttcactctacaccatcagcacgcctagacgccgtagaagtattttgacttagtttattactgttacaactactcgtacgtgtcggccgtccggggcctaccgtttccggcccgtacgggaacctaaagttcgaagtactacgaacgacgtggtggcctagccacctatcgttcgtcttctacttccttcccgac

SEQ ID NO: 121868 - DNA, 657 bp, Homo sapiens
  misc_feature: GYAE6OF02H21KE.8.38.D05.1.454.CMB.1.raw
  modified_base (158)..(158): a, c, t, g, unknown or other
  misc_feature (158)..(158): n is a, c, g, or t
tcagctcgcgtgtccacgaccggtgctcgatttagtatctgatagttgggtttggggtaggaggagcccagcactagaagtcggcggtgtttccattcggtgatcagcactgaacacagaggactcaccatggagtttgggctgagctgggttttccngttgctcttttaagaggtgtccagtgtcaagtgcaactggtggagtcgtggggggggctgggtccagccgtgggagtcccgtgagactctcctgtgcaggcctcgtggattcaccttcgaagtaacgtacggcgtgctacgtggccgccgaggctccgaggcaacgggtcttgggagtggctggcagtttgtttcaatcgtaggaacgggtcaagttgtttacgaaagttggtaatgtctagaaccgtccgggtagaacggggcctaagttcaacccatcctcaagacgaacaacctaacgacgaaacaacctaaagtacgttaatttaggaacctagtaaaccacgttaacctaacgtccgtagaacggaacgtaacgggttacgtagtaaaccgtactaggtaaccgaaggggtaaccgggggaaacgacggacggggtaacttaccggaaaggttcttaccgttagtaaccggttcacggggtccgttaaaccggg

SEQ ID NO: 121869 - DNA, 564 bp, Homo sapiens
  misc_feature: GYAE6OF02HHD1A.8.38.D05.1.454.CMB.1.raw
  modified_base (203)..(203): a, c, t, g, unknown or other
  misc_feature (203)..(203): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaangccaccctctcctgcagggccagtcagagtgttaccacccagttagcctggtaccaacacaaacctggccaggctcccaggcccctcatctatggtgcatccaacagggccactggcactcccagcctaggttcaggtggcaggtggtatgggacagactttcactctacaccatcatcagcctggacgcctagaagtatgttgactagtttattactgtacaactatcgtacgagtcggccgtccggggcctaccgttccggccgtcgggaccgtagggtggagtactacgaacgtaacgtggtacggcgtcggctaccgtacgttcttcgttccttacctacttcccgttcccgtaccg

SEQ ID NO: 121870 - DNA, 611 bp, Homo sapiens
  misc_feature: GYAE6OF02GKJT9.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgcaggctccgaggcaagggctgggagtggctggctagttgttcatcgtgaaggaagtgtacaatactatacagactcgtagagggccatcacatctcagagacaactaccaagaacacgatagtacgtactagacaaagtaggaccagtaccgtaaggtaaggttaggaacggaacgtaaccgggtacttacgtttaacgttacgttaggttacggaaagggtaacggggggtaacggttaacgtaagggtacggtacgtacgtaccgtaccgtaaaccggttaacgtttaccgtttacgtaccgtttaccggg

SEQ ID NO: 121871 - DNA, 556 bp, Homo sapiens
  misc_feature: GYAE6OF02F9R8J.8.38.D05.1.454.CMB.1.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (534)..(534): a, c, t, g, unknown or other
  misc_feature (534)..(534): n is a, c, g, or t
tcagctcgcgtgtccacgaccggtgctcgatttagtatctgatagttggggtttgggggaggaactgctcagttagggcccagagggaaccatggaagccccagctcagcttctcttcctcctgctactctggctcccagataccaccggagagattgtgttgacacagtctccagccaccctgtctttgctccgaaggggaaancgccaccctctcctgcagggccagtcagagtgttacccaccagttacgcctggtaccaacacaaacctggaccaggcctcccacggcccctcattctttgatgcactccatcgacgggccacgtggcactcccagcctaggttcagtggcaggtgggtcngggacagcttcactctcaccntcagcagcctagacgcctagaacgttatttagcttagtttacttactgtacaactagtaccgtacgagtcggccgtccggggcctacgtttccgccgtacggaacctaaagttcgagactaacgaacgacgtagtcggctgcctacgngtctcgtctcacttcctcctac

SEQ ID NO: 121872 - DNA, 709 bp, Homo sapiens
  misc_feature: GYAE6OF02GLTCM.8.38.D05.1.454.CMB.1.raw
  modified_base (204)..(204): a, c, t, g, unknown or other
  misc_feature (204)..(204): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaancgccaccctctcctgcgagggccagtcagagtcgttacccacctagttacgcctaggtaaccaacaaccaaacctcggaccacggcctccccgacggccccctacacttctttgactcgcactccatcgacgggccacgtggctactccccagccgtaggttcaggtcggcgtaggtgggtcgtgggacagtacttcgactctccacctatcacgcacgtcctagacgctagtacgttatttcgacttagttttactacgtgtactaactcgttaccgtaccggtagtacccgggtcccggttcccgggggtacccttaccggtttacccgggtaccccggttaacggggtaaaacccttaaaacgtttcgggaaacgttaaccgttaacccggtaaaaccggtacgttacgggtaccgggtacgttacggaacccgtaaccgttaactttccggtttacgtttacccgttaccgtttaccctttaccccgttcccccgtaaccg

SEQ ID NO: 121873 - DNA, 565 bp, Homo sapiens
  misc_feature: GYAE6OF02FKZ0P.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctggggaggtccctgagactctcctgtgcaggctctggattcaccttcagtaactacggcgtgcactcggggtccgccgaggcctccgaggcaaggggcttgggagtggctgggctagtttgtttcatctaggaaggaagtgttacaatactatacagactccgtagaagggccgtattcgaccatctccagagacaattaccaagaacacgagtgtatctagacaaatgacagacctaagagtgaggacacggtcttagtttattacgtagtacgaaggagggggtaataaggaggtggacgagacgtaccgtaagttacctacgtttcgtattaccgg

SEQ ID NO: 121874 - DNA, 546 bp, Homo sapiens
  misc_feature: GYAE6OF02G98JS.8.38.D05.1.454.CMB.1.raw
  modified_base (292)..(292): a, c, t, g, unknown or other
  misc_feature (292)..(292): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggcctcccaggcccctnatctttgatgcatccatcgaggccactggcatcccagccaggttcaggtggcaggtgggtctgggacagacttcactctcacatcagcagcctagacgcctagaagtatttgctagtttattactgtacaactatcgtacgtagtcggccgtccggggtcctaccgtttccgcccgtacggaacctaaagttcgagtactacgaacgtactgtggtctgaccacattctcgttcttcctactccgttcccgtcc

SEQ ID NO: 121875 - DNA, 555 bp, Homo sapiens
  misc_feature: GYAE6OF02GML03.8.38.D05.1.454.CMB.1.raw
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccnccaggctccgaggcaaggggcttgggagtggctggcagtttgttcatctgaagagtgtcaatacatacngactccgtagagggccattcacatcncanagacaattaccaagaacacgatgtaatctagacaaagtgacagtaccgtaaggtacgttaggaacggacgacggtacttaggtttattaacgtagtaacggaagggtagggggataacgaggtcgacgagtctaccgaagttactactttcgacttccgg

SEQ ID NO: 121876 - DNA, 854 bp, Homo sapiens
  misc_feature: GYAE6OF02JF1TK.8.38.D05.1.454.CMB.1.raw
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
tcagctcgcgtgtccacgaccggtgctcgatttagtatctgatagttgggtttgggggtagggaacgtgctcagttaggacccagagggaaccatggaagccccagctcagcttctcttcctcctgctactctggctcccagataccaccggagagattgtgttgacacagtctccagccaccctgtctttgtctccgaggggtaaancgccaccctctcctgcagggccagtcagagtcgttaccaccctagtacgcctggtaaccaacaccaaaccgtggacccaaggcctaccccgacggtcccccctntacttcctttagactcgaccagtccacgtccgacgggtcccaacgtggaccacctccccgagtcccgtacggttcaggttcggaccgtaggttcgggtaccggtggggaacctaacgggtttaccttaccgtaccgttaccgttacccaaccccgtaagttacccgtaacggacccgtaccggtaacccgtttaacggaacccgttccggttaacgggtaaacgtttaacgtttttacggtaaccggtttaaagtttttaaccgtttaaaccttacggttaaccgttaaaaccgttacgtttacccggttaaccgggttacgggttacccggggttcccggttacccggggggttacccttaacccgggttttacccgggtacccccggttaacggggttaaacccgttaaaaggtttcggtaaaacgaccgttaaccgaaaccggtaacggttaccgggtacgggtaccttaacgggaccttaaaccgtacgttaccgtttacgttcccgttactaccgtttaccccgtcccgttaacccg

SEQ ID NO: 121877 - DNA, 705 bp, Homo sapiens
  misc_feature: GYAE6OF02HLLLD.8.38.D05.1.454.CMB.1.raw
  modified_base (185)..(185): a, c, t, g, unknown or other
  misc_feature (185)..(185): n is a, c, g, or t
  modified_base (331)..(331): a, c, t, g, unknown or other
  misc_feature (331)..(331): n is a, c, g, or t
tcagctcgcgtgtccacgaccggtgctcgatttagtatctgatagttgggtttggggagaggagcccagcactagaagtcggaggtgtttccattcggtgatcagcactgaacacagaggactcaccatggagtttgggctgagcgtggttttcctcgttgctcttttaagaggtgtccagtgtnaagtgcaactggtggagtcgtgggggagcgtagtccagccgtgggaggtcacgagagactctcctgtgcagcctcgtggttcaccttcgagtagctacggctatgcacgtcgggtacccgaccaaacctccgaaggcgaaagggtnttgggaggtgggtcggcgtaggtttgttcattcgaggacggtcaggttcgttacgtaagtggtatacggacgtacgaccgttcggacggtaacgggccgtacgttcccaacctacgtaccgtaccaggtacgtaactaacttaccggaaacggaaccaacgtaagttagttaagtttcggaacgtaccgtaagtaacgtacgtaaccgttaacggttaccgtaggaacgggtaaccgtaccgggtaacgttaacgttaaccgtacgttacggtaaccgggtaaagggggaccgggggaaccgagggtaccggggtaacgttacccggtaacggttacccgttccggtttacggtaccggttccggtaaccgggg

SEQ ID NO: 121878 - DNA, 605 bp, Homo sapiens
  misc_feature: GYAE6OF02G9MG9.8.38.D05.1.454.CMB.1.raw
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagctcgcgtgtccacgaccggtgctcgatttagtatctgatagttgggtttgggggagggaactgctcagttaggacccagagggaaccatggaagccccagctcagcttctcttcctcctgctactctggctcccagataccaccggagagattgtgttgacacagtctccagccaccctgtctttgtctccaggggaaagngccaccctctcctgcagggccagtcagagtgttaccaccagttagcctggtaccaacacaaacctggccaggctccacgcccctcatcttgatgcatcatcaggccactggcatccccagccgtaggttcaggtcggcaggtggtcgtgggacngtacttcactctcactntcancacgctagagtccgtagaagtatttgacttagttttatactagttacaactacgttacctacggtacgtcggtcccggtccgggggtaccctccggtttcccggcccggttacgggaaaccctaaagttcggaacgtacttaacgaacgtacgttcggtacggctacgaccacccgttaattcccgttaggtttacccttacgacctttcccgttacccggtacc

SEQ ID NO: 121879 - DNA, 600 bp, Homo sapiens
  misc_feature: GYAE6OF02JRAGR.8.38.D05.1.454.CMB.1.raw
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
tcagctcgcgtgtccacgaccggtgctcgatttagtatctgatagttgggtttggtgggagaggagcccagcactagaagtcggcggtgtttccattcggtgatcagcactgaacacagaggactcaccatggagtttgggctgagctgggttttcctcgttgctctttaagaggtgtccagtgtcaagtgcaactggtggagtcgtgggggggctggtccagcctgggaggtcccngagactctcctgtgcaggctcgtggattccaccttcaagttaactaccggctgcacgtggggtcccnccaggcctccaggcaagggcttgggacgttggcgtggactggtttgtttcattcgtagaagggtaagttcgttcgaaatttactatacgagtaacctccggtaggaaacgggccgtaatcgtacctactactccgagacgactaactacaacgaacgacgactacgtatactagactaagagacacgacgtagtacgtagagacacgtacgttagttagttactagtaacggtaacggaaggggtaactaaggagtaggacgacgtacgtacgtaacgtacgttacgttagtaacg

SEQ ID NO: 121880 - DNA, 668 bp, Homo sapiens
  misc_feature: GYAE6OF02FZYJ3.8.38.D05.1.454.CMB.1.raw
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaggggaaagagccaccctctcctgcagggccagtcagagtcgttaccaccctagttacgcctggtaccaacacaaacctggccaggcctccgacggcccctcacttctttgatgcatccatcgacgggccacgtggcactccacgcctaggttcagtcggctaggtgggtcgtgggacagtacttcactctacacactcgagcacgaccgtagacgcctaggtaagttattttacgacttaaggttttaacttacgtagttactaaacgttaacgttccggtaaccgtacgggtcgggtaccccgggttcccggggggtaccttaccggttttcccgggacccggttacggggaaacccttaaaacgttcggaacgtaactaaccgaaacgtaccgttaggtcgggtaccgttacggaacccgtacctaagttccgttacgttacctttactacctttacccgtcccgtaacc

SEQ ID NO: 121881 - DNA, 775 bp, Homo sapiens
  misc_feature: GYAE6OF02GA432.8.38.D05.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggcctcccagataccaccggagagattgtgttgacacagtctccagccaccctgtctttgtctccaggggaaangcccacctctcctgcagggccagtcagagtgttaccacctagttacgcctggtaaccaacacaaaccgtggaccaggcctacccgacggcccctnattcttgatgctatccatcgacgggccacgtcggacactcccgaagcctaggttcaggttcggacgtaggttcgggtacgtggggaacctaaggtacctttccgacgttctccgaacctacttccgaaccgacgtaccggtacccgtaacggtaccgtcccgttaagggtaacgtttacgttttacggacgtttaacggttttaacgttaaccgttcggttaaacctaaaccttacgtttacccggtaaccggtacgggtttcccgggtacccgggttacccggggggtaccttacccgggtttttaccggggaccccggttaacggggtaaaccttaaaacggttcgggaaacgtaaccgttaaaccgtaaacggttaaccgtacgggttacggtaccgttacggaaccctaaccgttacgtttaccgttacgtttacccgtttacgtacccgtttcccgttaccccgtaaccgg

SEQ ID NO: 121882 - DNA, 627 bp, Homo sapiens
  misc_feature: GYAE6OF02IG8A4.8.38.D05.1.454.CMB.1.raw
  modified_base (379)..(379): a, c, t, g, unknown or other
  misc_feature (379)..(379): n is a, c, g, or t
tcagctcgcgtgtccacgaccggtgctcgatttagtatctgatagttggggtttgggggagaggagcccagcgctagaagtcggcggtgtttccattcggtgatcagcactgaacacagaggactcaccatggagtttgggctgagctgggttttcctcgttgctcttttaagaggtgtccagtgtcaagtgcaactggtggagtcgtgggggggggctgggtccagcctgggaggtccctgagactctcctgtgcaggctctggattccaccttcaagtaactacggctgctacgtcgggtccgccaagggcctaccgagggactaaggggcttgggagtggctgggctaggtttcgtttcagtctaggaaggtagtnttacaattactaatacagtactccgaggaacgggccaatttccaacctatctaccagaacgaacaattaccgaaagaaccaacgtaagtacgttatcgtagactaaacgtggaaacaggtacctaaagaggttagaacggacgtacgggtattacgtttaattacgtaggtaacgtaaagggagggggtataacgaggtcggacaggtacctaccgtaaggttaccttacgtttcgacgtttaccggg

SEQ ID NO: 121883 - DNA, 678 bp, Homo sapiens
  misc_feature: GYAE6OF02HESHN.8.38.D05.1.454.CMB.1.raw
  modified_base (313)..(313): a, c, t, g, unknown or other
  misc_feature (313)..(313): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaagtgcaactggtggagtcgtgggggggggctggtccagccgtggggacggtccctggagacctctcctgtgcaggctcgtggacttcaccttcaagtaactacggcgtgcctacgtcgggtcccnccgaggcctaccgaggccgaaggggtccttgggacggtggcttgggctaggttttcgtttacattcgtaggaaaggtagttgttacaaattactatacagtacctccggaggaacgggtcctaatttccaacctactcctaccgagaacgaactaacttaccaaacgaaccaacgtatacgttactacgtacgaacaaagtacggacgaacgtaacctaaaggtagttacggaacggacgtaccgggtacttacgttttaattacgttacggtacggtaaagggtaacgggggtaagtaacggtaggtacggaccgtagtaccgtaccgtaacgttaaccgtttacgtttacgtaccgttacggg

SEQ ID NO: 121884 - DNA, 696 bp, Homo sapiens
  misc_feature: GYAE6OF02IYFAA.8.38.D05.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
  modified_base (578)..(578): a, c, t, g, unknown or other
  misc_feature (578)..(578): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccngcctgggaggtccctgngactctcctgtgcaggctntggattcaccttcagtaactacggcgtgctacgtgggtccncgaggctccgaggcgaagggcttgggagtcggcgttggcgtaggtttgtttacagtaccgtaggtaaggtaaggttcgttactaacgttactaactacgtaagtaccgtccgggttaggaaacgggtacccgtactttacccaccgtacttacctacccgaagtaacgaactaaacttaccgaaacgtaaaccgacgtaagttacgttaacttacgtacgaactaaagtacggaactaacggtaccgtaaggtacggttagaacgggtacgaccggttntttacgttttacttacgtacggttaacgggtaaaggggtaacgggggaacttacggaacggtacggacgacgtaccgtaccgtaaaccgttacgttacgtttacggtacgttacgggg

SEQ ID NO: 121885 - DNA, 600 bp, Homo sapiens
  misc_feature: GYAE6OF02HP2F2.8.38.D05.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctccagataccaccggagagattgtgttgacacagtctccagccaccctgtctttgtctccaggggaaanacgccaccctctcctgcagggccagtcagagtcgttaccaccagttacgcctggtaacccaacaacaaaacctggaccacggcctcccgacggccccctcattcctttgatcgcatccatcgagggccacgtcggcactcccagcctaggttcaggtcggcaggtcggggtctacgggacacgtacttcgacttcacaccatcancacgacagcactagaattntttcgattagtttatactntactatacttcgtacgngtcggccggtccggggtacctacgttccggaccgtacggtaacctaaagttgaacgtactaacgaaacgtacgtaggtcgtacctagaccctacctacgttccgttacgttactttacgactttacccgtcccgtacc

SEQ ID NO: 121886 - DNA, 680 bp, Homo sapiens
  misc_feature: GYAE6OF02GO85C.8.38.D05.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgttctttgtctccagggggaaancgcccaccctctcctgcagggccagtcagagtgttacccaccctagttacgcctcggtaaccaacacaaacctggccaggcctcccacggtccccctntactctttgatcgctactccagtcagggccacgtggcactccgacgccgtaggttcagtggactggtgggtctgggaacagtacttcaccttcctacccgacctaactcgaacgtccgacgtccgtaagaccgtaccgtaggtaaacttgtttacgacgtttaagttttaactaccgttagttaccaactacgttaccggtaacggtggttacccgggtcccgggttcccgggggtacccttacccggttttcccgggccgtaaccgggtaaacctaaaggttcgaacgtaacttaacgaaaccgtaacgttggcggttctacggccaaccgtattccgtacgtttcccttaacgtccgttacccgttccctaaccg

SEQ ID NO: 121887 - DNA, 858 bp, Homo sapiens
  misc_feature: GYAE6OF02GJMQA.8.38.D05.1.454.CMB.1.raw
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcgtggttttcctcgttgctcttttaagaggtgtccagtgtcaagtgcaatggtggagtcgtgggggagcgtagtccgagccgtgggaggtcacagagactctcctgtgcacgcctgtcggttccaccttcagtacgcgtacggcagtcgcacgtcgggtcccgaaccaaaccgtccgaagggaccgtaaaggggattacgggtagggtgggggttacggacgttaagggttttcgtttaccgtaagttccggtagggaaccggggtaccttaggtttacggttaacgtaaaggtttgggttaagtcgggtaccgtcggtaccgggtaccggtacgggaaccggggtcccgttaagttaccccgaaccgtacgttcccgtaacccggaaaggaaccgtaaacccgtaaccgtaaccccgaaaggaaccctaaacgttaaaggttccgtttaacgtttaccggaacccttaaggaaacccgtaaccgttaacccggttaaaccgttacccggttaagggaaccgggttaaccggtaaccggggttaacttaaacgttaaccgttaccgggttaacgggtaacgggggaaaccgggggtaaacgggggaaacccgtaacgggggtaacccggggtaacgtttaaccccggaaggtttaccccggtttaccgggtttaaccggtaccgggtttaccgggtccgggggtaaacccccgg

SEQ ID NO: 121888 - DNA, 705 bp, Homo sapiens
  misc_feature: GYAE6OF02H2Q6Y.8.38.D05.1.454.CMB.1.raw
  modified_base (205)..(205): a, c, t, g, unknown or other
  misc_feature (205)..(205): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctccagataccaccggagagattgtgttgacacagtctccagccaccctgtctttgtctccgaaggggaaagngcccaccctctcctgcagggccagtcagagtgttaccacccagttagcctggaccaacaacaaacctggccaggcctcccacggcccctcattctttgatgcatcatcgaggccactcggcactcccagcctaggttcaggttggcaggtgggtcgtgggacagtacttcgactctacaccatcacgcacgtaccgtaagacgtacccgtaagtaacgtaacgtttttagaccttaggttttaaccttttaacgttagttaaccaaacgttaacgtttaccggttaaccggtacgggtaccggggtacccggttaccccggggggtacccgtttaacccgttttcccgggaccccggtttacggggtaaaaccctaaaacggtttacggaacgtacgttaaacccgtaaaaccggtaaccgtagggttacgggtccgtacggtaccaacccgtagttacttccgtttaccttaccgtaccgtttaccttccccgtaaccc

SEQ ID NO: 121889 - DNA, 655 bp, Homo sapiens
  misc_feature: GYAE6OF02G7VEZ.8.38.D05.1.454.CMB.1.raw
  modified_base (249)..(249): a, c, t, g, unknown or other
  misc_feature (249)..(249): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
tcagctcgcgtgtccacgaccggtgctcgatttagtatctgatagttgggttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaagcgccaccctctcctgcagggccagtcagatgtgcgcttcganctgtaccaacacaacctggccaggctcccaggcccctnattctatcggtnctacttccgaactgggcccacgtggcactccgacggccaggttccaggttcggactacggtgggtactggggaccaggtaccttcacttcgtacacctatccatcacgccgtggacgtcctagaacgtattgttacggtacttagtttaatttacgttagttccgtaactacgttacggtaccgtagtacggtacccggtttaccgggggtaccttaccggttttccgggacccgtttaccgggtaccggtaacggggttcggtacggttaacgtaccggtaaaacgggtaaccgttacggtacgggttacgtcggtacgtaccctacgttccgtacggttccgttaccgtaaccg

SEQ ID NO: 121890 - DNA, 666 bp, Homo sapiens
  misc_feature: GYAE6OF02GH3PV.8.38.D05.1.454.CMB.1.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatgggagtttgggctgagctgggttttcctcgttgctcttttaagaggtgtccagtgtcaagtgcaactggtggagtcgtgggggggggctggtccagcctggggacgtccctgagactctcctgtcgcaggctctggacttcaccttcagtaactcggcgtncacgtgggtcccnccgaggcctccgaggcaagggtcttggggagttcggctgggcctaggtttgttcattccggtaggaaacggtagttcgttacaaagttacgttaatacgaaggtaccttcggtaaggaacgggtcctacttaccgaccacgttcctaccgtaaggacgtaactaacttaccaaacggaaccaacgtatacgttacttacgtagacaaacgtcgaactacgtacgtaacgtacggttagacggtaccgacggttacttagtttaacgtacgttaggtaaccggaagggtacggggtaattaaccgtaggtacggacgtacgtaccgtacgtaacggttaacgtttacgttacgtaccgtacggg

SEQ ID NO: 121891 - DNA, 682 bp, Homo sapiens
  misc_feature: GYAE6OF02F9GTP.8.38.D05.1.454.CMB.1.raw
  modified_base (326)..(326): a, c, t, g, unknown or other
  misc_feature (326)..(326): n is a, c, g, or t
  modified_base (468)..(468): a, c, t, g, unknown or other
  misc_feature (468)..(468): n is a, c, g, or t
tcagctcgcgtgtccacgaccggtgctcgatttagtatctgatagttgggtttggggtaggtaggaggcccgagcactagaagtcggcggtgtttccattcggtgatcagcactgaacacagaggactcaccatggagttgggctgagctgggttttcctcgttgcttcttttaagaggtgtccagtgtcaagtgcaactggtggagtcgtggggggggcgtgggtccgaggccgtggggaggtccctggaggacctctcctggtgcaggtctcgtggattccgaccttcgaagtaaccgtcggtcgtgaccgacgtcgggtcccncgacggccttccgaggcgtaaacgggattgggagttggggagtccgaggttttgtttccgattcgtaggacggggtcctaggttcgttacgaagtggtacgtgcgtacgaccgtcgtaggaagggtcccagttcgaaccgtntccgtcgaacggagtaaccaaccgtaccgaaggaaccgaactaagtagtttaacgttagaacccgttcgaaacgtacgtaccttaaccgcgtacgaagtaccgtcggttaagtctaacgtacgtagtaacggagggtaccggggtaacgagacgggttcgtaacccgaagttacctccgtttaggacctaggtccggggacctacggtacccgg

SEQ ID NO: 121892 - DNA, 579 bp, Homo sapiens
  misc_feature: GYAE6OF02FWCZZ.8.38.D05.1.454.CMB.1.raw
  modified_base (271)..(271): a, c, t, g, unknown or other
  misc_feature (271)..(271): n is a, c, g, or t
  modified_base (495)..(495): a, c, t, g, unknown or other
  misc_feature (495)..(495): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttnagtaactacggcgtgctactgggtcccgccaggctccgaggcgaacgggcttgggagtggctgggctagtttgtttcagttcgtaggaaggtaagttgttacaatactatacagtacgtcgtaggaacgggcctattcacctatctcagagactaacttaccaacgaacacgattagtactctagacaaagtggaacagacctaagtagtagaggacgacggtnttagtttatacgtagtaggaagggaggggtactaacgtaggtaggtacgagtctaccgaagttacgtactttcggacttacggg

SEQ ID NO: 121893 - DNA, 670 bp, Homo sapiens
  misc_feature: GYAE6OF02GUW1X.8.38.D05.1.454.CMB.1.raw
  modified_base (174)..(174): a, c, t, g, unknown or other
  misc_feature (174)..(174): n is a, c, g, or t
  modified_base (200)..(200): a, c, t, g, unknown or other
  misc_feature (200)..(200): n is a, c, g, or t
  modified_base (441)..(441): a, c, t, g, unknown or other
  misc_feature (441)..(441): n is a, c, g, or t
tcagctcgcgtgtccacgaccggtgctcgatttagtatctgatagttgggtttggggagaggagcccagcactagaagtcggcggtgtttccattcagtgatcagcactgaacacagaggactcaccatggagtttgggctgagcttgggttccttcgtgtctctttagtaggngtcacgtgtcagtagcactaggtggnggtcggtggggggcgggtcgtccgacgcgtcgggcggtccgtcgagactcctcctgtgcgagcgtctggtagtctacctctagtaacgtacgcgagtcacgtcgggtcccgccgaggcgtcccagggacgtagggcgtaggtcggtggcgtggcgtagtttcgtttcgctacgtgtaacgggtaagttacgttacaattaacgtaactacgaagtacccgtcgtacgggaaggtctacgtntacctaccgtactctaccgacgtaacgactaactacgtaacgaacgtaactagtcttaagtcctagacgtaaacgtacggaacgacggtacccgtaaagtaacggtgtaaacggaacgtccggtaagttacttacgtttacgtaggttaaccgggaaagggtaagggtacggtacgtaaggtacggacgtacggtaccgtaaccgtaaggtacccgttagtttaaccgg

SEQ ID NO: 121894 - DNA, 657 bp, Homo sapiens
  misc_feature: GYAE6OF02FTES0.8.38.D05.1.454.CMB.1.raw
  modified_base (310)..(310): a, c, t, g, unknown or other
  misc_feature (310)..(310): n is a, c, g, or t
  modified_base (601)..(601): a, c, t, g, unknown or other
  misc_feature (601)..(601): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatgggagtttgggctgagctgggttttcctcgttgctcttttaagaggtgtccagtgtcaagtgcaactggtggagtcgtggggggggctgggtccaggcctggggaggtccctggacgactctcctgtgcaggctctggattccaccttgagttaacctacggcgtgcacgtcggggtcccnccgaggcctccgaggcgaagggcttgggagtggctggctaggtttgttcagttcgtagaaggtagttcgttcaaattaccgtaataccgaagtaccttcccggtaggaaccgggggtccctatttacccgacctacgtcctaccgagacgaactaaacttaccgaaacgtaacaacggatacggttaactccgtaagaccaaaggtcggaacacgtaccgtaagtagtacggaacggaccgtacggtacttagttttaacgtacgttagtaccgggaagggtaggggtaanacgtaggtcggtacacgtcgtaccgtaacggttattacgttacggacttaccgggg

SEQ ID NO: 121895 - DNA, 774 bp, Homo sapiens
  misc_feature: GYAE6OF02GL4EQ.8.38.D05.1.454.CMB.1.raw
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagcccaccctgtctttgtctccgaaggggaagacgcccaccctctcctgcgaggccagtcagagtcgtaccaccagttacgcctcggtaaccaaccaaccaaaccgtggacccacggcctccccgaccggcccctcacttctttgatgcactccatccgacggccacgtcggacaccgtcccacggcctacggttcgtacggtcggaccgtaggggttcggggtacgttacggggaccgtaacggttaccgtttcctacccgttaccttccgtaaacccgtaacttaccggaacgtacccgtaaccgtacccgttaacggacgtaccgttaaggtaacgttttagttttcgtacgtttaacgtttttacgttacgtttacgtaaccttaagtaaccgtttccggaaccgtagggtcccgggttcccggtccccgggggttaccttccgggtttacccgggtacccggtacgggtaaaccttaaacgttacggaacgtacgtaaccgtaacggtaccgttgggtaccggtacgttacccggccttaaccgttacgttacgttacgtttcccgtttactaccgtttcccgttaccccgtaccg

SEQ ID NO: 121896 - DNA, 871 bp, Homo sapiens
  misc_feature: GYAE6OF02GS72W.8.38.D05.1.454.CMB.1.raw
  modified_base (321)..(321): a, c, t, g, unknown or other
  misc_feature (321)..(321): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccgaaggggaaacgacgcccaccctctcctgcgaggccagtcagagttcgtaacccaccgtagttacgccgtaggtaacccaacacctaaaacctggaccacggccctaccccgacggtccccctacgnttccgttcggccgtacccgttttaaacgacgggtcccgtaaggttcggaaacccgtccccgtaaggaccccgttaacgggttaccgtacgggaccgggtaccgttaagggttccgggggttaccggttaccgggggttaaccttttacccggtttaccgtaaacccgtttccggtaccccgtaaacccgttacttaaacccggtaaaacctttaaacccggtctaacccgtaaaacgtttccggttaaaccgggaacccgttttacgtttttacggtaacccgttttaacggttttttaacttttccggttacggtttaccgtaacgttaccgttaacggttaccgttaacggttaaacggttaccggttccgggttacccgtttccgttaaccgggtttcgggaaccgggtaccgggtaaccggtaacgggttccggtaaacccgttaacgaaaccgtaacgtcgtcggtacgtacgaccttacgtacgttcgtacgttcctacgtccgttccgttcccgtaccgtactcgtagacgtacgaccgtacg

SEQ ID NO: 121897 - DNA, 707 bp, Homo sapiens
  misc_feature: GYAE6OF02HERE7.8.38.D05.1.454.CMB.1.raw
  modified_base (168)..(168): a, c, t, g, unknown or other
  misc_feature (168)..(168): n is a, c, g, or t
  modified_base (205)..(205): a, c, t, g, unknown or other
  misc_feature (205)..(205): n is a, c, g, or t
tcagctcgcgtgtccacgaccggtgctcgatttagtatctgatagttgggtttgggggaggaactgctcagttaggacccagagggaaccatggaagcccagctcagcttctcttcctcctgctctctggcctcccagatacccgacggagagtattgtgttgacacngtcctccagcctacctgtctttgctcgaaggggaacncgcccacctctccgtgcgacggccagtccagtagtcgttaacccacctagttacgccgtaggtaccaaactacaaactcggcctaggcctcccgaacgccccgtactacgttcttagaatgactactccagtccgacgggtccctacggtcggacctacgtaccccgagtaccgtaggttccaaggtcggtacggtacgggtttcggggtaaccgtggggaacctacggtacctttaccgcttacctacgaacctagtaccacgggtcaccgtacgtacgacgtacgtacgtaagttctttacgcgtttaagtttacttacgtacgttacgtaacttacgtacgtaacgtggtccggcccggttaccgggtacccttacggtcccgtaccgtaacgggaaaccttaaggtcgtaagtactaaccgaacggttactggggtactacgtacgaccctacgtacgtacttcgttacccttacgtaccttcccggttaccctaccg

SEQ ID NO: 121898 - DNA, 898 bp, Homo sapiens
  misc_feature: GYAE6OF02HBV0H.8.38.D05.1.454.CMB.1.raw
  modified_base (239)..(239): a, c, t, g, unknown or other
  misc_feature (239)..(239): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagagtgtccagtgtcaagtgcaacgtggtggagtcggtgggggggctggtccagtccgtgggacggtccngagacctctccgtgtgcaggtctcgtggtacttccaccttacaacgttaccgtacggtcgtacgctacgtcgggtccccgtccggacggtcccgtccgacggaccgtaggggtccgtttagggaggttcggcggttacgggcgtttacgggttttacgtttacccgtagttaccggtaaggttaaaaggtaacggtttcgtttaactaaaccggtttaactaacgttaacggtaacggtaacccgttaccggggttacggaaacggggtccgttaaacttttacccggaaacccttacgtaccccggtaacccgaaacggtaaccgtaaaacccgttaaaccgttaacccgaaaacgggtaaacgtaacccgtagtttaaccggttaacgtttaccgtacgtaaaccgtaaaaggtacgtaaaccggttaacgtaaccgttaaacggttacggttaacggaacggtaacccggtaagggttaccgttttaaacggttttaacgtaaccggttaacgggtaacgggtaaaagggggtacgggggttaaaacgttaaccggtaaggggttccggaaccggttaaccggtaaccggtttaacccgttaaaccgggtttacccgttttaaccggttttacggttacccggtttaacccggggg

SEQ ID NO: 121899 - DNA, 764 bp, Homo sapiens
  misc_feature: GYAE6OF02FHBK5.8.38.D05.1.454.CMB.1.raw
  modified_base (210)..(210): a, c, t, g, unknown or other
  misc_feature (210)..(210): n is a, c, g, or t
  modified_base (268)..(268): a, c, t, g, unknown or other
  misc_feature (268)..(268): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagngccaccctctcctgcagggccagtcagaatgttggcgcctacgtatcctggtaccaanagaacctggccaggctccccgaggccccctcgatctatgggtgcattccaaacaggggtcccaacgtcgggaccacgttacccccgagcccctacgggtttcaacggtcgggccaggggttcggggttaatgggggaacctagggaacctttccgaaacgttcccttaccgaacccctaagtttcccaattaccgtaacgtcccgttaggggtaacgtcccgttacggtaagggtaacgttcggttacgtaccgttaaggtttttaactttaccgttagttaccgaaactacgtacccgttaaccggttaacgggttcgggtaccccggtacccggggggtaccctaccggttttccgggaccccgttacggggaacccttaaacgggttcgggtaactaacggttaccgtaaaaccggtaaccgttacgggttacgggtaccttaccggacctaacccgtacgttaccttaccggttacctttacccgttaaccg

SEQ ID NO: 121900 - DNA, 718 bp, Homo sapiens
  misc_feature: GYAE6OF02JDAEF.8.38.D05.1.454.CMB.1.raw
  modified_base (298)..(298): a, c, t, g, unknown or other
  misc_feature (298)..(298): n is a, c, g, or t
tcagctcgcgtgtccacgaccggtgctcgatttagtatctgatagttgggtttggggagaggagcccagcactagaagtcggcggtgtttccattcggtgatcagcactgaacacagaggactcaccatggagtttgggctgagcgttgggttttcctcgttgcttactttttaagaggtgtccagtgtacgaagtgctaacgtggtggagttcggtgggggggggtacttgggtccaggtcccgtggggacggtccctgagtctcgtccgtgtgcacggctcgtgacttcgaccttnacgttaactacggcgtgcctacggttacgggtcccaccgaggtcctaccggaggcgaagggtcttcgggagtcggacgtgggacttaggtttcgttaccgagttccggtaaggtaaggttaacgttgtttaaaccgaatttacgtaagtaccgacgtacgtccgtaggaaaccggtcccgtatttacccgacctacttacctacgacgtaacgaaccgtacgttaaccgaacgaaccacgtagttagtacgtacttagaacgtaagtccgactaacgtaccgtaaggtacggttagaccggtacgttaccggtatttacgttttacgagttaacggtacggtaagggtacgggacttaaggtaggtacggagttacgtacgtaaccgtaacttacgtttacgttacgtaccgttaccggg

SEQ ID NO: 121901 - DNA, 723 bp, Homo sapiens
  misc_feature: GYAE6OF02GISMN.8.38.D05.1.454.CMB.1.raw
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
tcagctcgcgtgtccacgaccggtgctcgatttagtatctgatagttgggtttggtgggagaggagcccagcactagaagtcggcggtgtttccattcggtgatcagcactgaacacagaggactcaccatggagtttgggctgagctgggttttcctcgttgcttcttttaagaggtgtccagtgtcaagtgcaacgtggtggaggtcggtggggggggtcgtgggtccgagccgtgggacggtccctggagacctcctcctgtcgacnggcctcgtggtacttcgaccttcaacgtaacgtacggcgtgcacgtcgggtccgccnggacctccgaggtaccgagggcgtttagggaggtggccgtaggcgttaggtttgttacagttcgtaggtaaacggagttggttaacgaactttactagtaccgtacgtacgtaccggtaggaacgggtaccgtacgttaccgaccctactacccgtacgagaacgtaacgtaacgttacccaaaggtaacacggtattacggtattacccaaggaactaaggtaggaaccctagggtaacctaaggtacggttacggaacgtaacgtccggttagtttaacgtttaacgtacggtttacgggaacggtaagggggtaaggggtaccttaacgggaggttacggaacgacggtacccgtaagttaaccgttaccgtttacggttacgttaacccggg

SEQ ID NO: 121902 - DNA, 813 bp, Homo sapiens
  misc_feature: GYAE6OF02JW58D.8.38.D05.1.454.CMB.1.raw
  modified_base (296)..(296): a, c, t, g, unknown or other
  misc_feature (296)..(296): n is a, c, g, or t
tcagctcgcgtgtccacgaccggtgctcgatttagtatctgatagttgggtttggggagaggagcccagcactagaagtcggcggtgttccattcggtgatcgaggcacgtggaacacgagaggactcaccatggagtttgggctgagctggtttcctacgttgctactttaagagtgtcagtgtacaagtcgacaacgtggtggagtcgtggggggctcggccagccgtgggacgtcccagacgactcgtccgtgtcgccgtaggccttacgtcggaacttaccgaaccctttanaacgtaaaccgtacggtaccgtacgaccgaaggtcgggtaccgtaacccagggtaccctaccggaaggtccggaaaaggggtccggttaggggaacggtcggggtaccgtacgggaccgtaaagggttttcgtttaccgtaaggtccggtttaaaggaaaccggggtaaaattcggtttaaacccaaaaagggtttaacctttagtaaaaccggtaacggtaaccgtttacccgggagggtaaaaccggggtcctaaacgtttacgaaacctacgttacctaccgtaaacggacgtaaactaaacgttaaccaaacggtaaacaaccgtaagtaagtaacctacgtacggtaaacaaagttaccggaagaccggtaacttaaaggtacgttacgaggtaacgacggttactaggtttaaaccttattacggtaacggaaagggtacggggaaattaaccggagttaacggacctagaacgttaccgaaagttccgtaagttcgtaacgtttaaccgg

SEQ ID NO: 121903 - DNA, 818 bp, Homo sapiens
  misc_feature: GYAE6OF02FUXBJ.8.38.D05.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgctccaggggaangccacctctcctgcagggccagtcagacgtgttacccacctagttagcctaggtaccaacacaaacctggaccaggcctccgacggtcccctntacttcctttgacttggcctatcccaacttcgaacggggccctaacgtgggaccaacgtccccaacggtcccgtaaggtttccgaaggtcgggactaaggggttcggggttccgtaggggttacccttttccggtttacgtaacccgttcgttaaccctaccctaaccgtttaccgaaaaccgttttaacccgtcggtaaccttaacgtttccgtacgggtaaccgttacccgtttttacggtacctttagtttttaaccgtttaccgttggttaaccgtacgtaccgttaggttaccgttacggtaaaccggttcgttaccggggttcccgtttaaccggtaccgggtttttccgggaaccgggggtaaccggggtaaccggttaaaccgggttaaccgggtaaacccgttaacggaaaacccggttacgttacgggtacggtaccgtaggaccctaccgtaacgttccgtttcgttactttaccgtaaccggtttcccttacccggtacccgttacgtccgg

SEQ ID NO: 121904 - DNA, 762 bp, Homo sapiens
  misc_feature: GYAE6OF02GFG4E.8.38.D05.1.454.CMB.1.raw
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (452)..(452): a, c, t, g, unknown or other
  misc_feature (452)..(452): n is a, c, g, or t
  modified_base (754)..(754): a, c, t, g, unknown or other
  misc_feature (754)..(754): n is a, c, g, or t
tcagctcgcgtgtccacgaccggtgctcgatttagtatctgatagttgggtttgggggaggaactgctcagttaggacccagagggaaccatggaagccccagctcagcttctcttcctcctgctactctaggctcccagagatcattggagaagtggtgatgacacagtctccggtcacccttgtcttcgtttttccgngggganacgacgccctaccctctccttggcggccggccagtcagacgtcgttaaggacgtaacttagcgttggtatcgtagacaggacggctcggccaggccctaccgagtacctccgtactacgtttccgttggcccgttaaccgtttaacgacgggtccgtacggttacggtacctacccgacgtccggtacggttccaggtccggactacgggttcggggtacgtcgggttaccgttccggtttaaccnccgttaccgtacctaacccgttaataaccggttaaagtacccggtactacggtaacctaacgttccgttaacggttaacccgttaaccgtttcgtacgtttaacggtttttactttccggttacgtacgttacgtacgtacgttacgtacgtaacgtccgttcgtccgtttacgtacggtttacgggaccggtaacgggtaccggtaacggtcgtaacccgtaacggaaccgttacgtcggtacggtacgccgtaccgacctaaggttcctacgttacttaccgtaccgtcccgtttacccncgttaacg

SEQ ID NO: 121905 - DNA, 919 bp, Homo sapiens
  misc_feature: GYAE6OF02FQSXR.8.38.D05.1.454.CMB.1.raw
tcagctcgcgtgtccacgaccggtgctcgatttagtatctgatagttggggtttgggggaggaactgctcagttaggacccagagggaaccatcggaagccccagctcagcttctcttcctcctgctactctggctcccagactaccgaccgggagagattgtcgttagacacgagtcctacagccctaccgtcgttctttagtctaccgaaggggtaaacgacgaccctaccgtacgtcctacgacgtacgggacctagtacgaacggtacggtacgttaacccaaccgtagttacggtacccgttaacgggtaacccaaaaccgtaaaccgtaaacccgtacgggaccgtaaacggtcccgtaaccccgtaccggtaccccctacgtaacttacgtttaacggaagttacggaccttaactaacccggtacgttacggaaccggggtaccctaccggtacggaccctacctaacccggacgtcccgttaagggttacgacggtcggtcggtacggtccggggtacgtacggggacctaacggttaccgtcgttaacctcgtaccgaaacgtcctcgaaccgtaacgccgtacgaacggaccgtacgtagtaacgtttacgtttcggaaactttaagtttacgttaacgttaacgttaccgttaaacgtccgtttaaaccgggtaccgggtacgggttacccgggtacccgggtaacccggggtaacccgtttacccgggttaacccgttacccgggttaaacggtaaacccgtttaacgttacgggtaacgtaaaccgttaaaccggaaccgttaacggtttacggaccgtaacccgggttaacgacccgtaaacccgttggttaccccgtttcgtttaacccgtaacctttacggttaccccttacccggtaaacc

SEQ ID NO: 121906 - DNA, 407 bp, Homo sapiens
  misc_feature: GYAE6OF01A6Z55.1.46.E02.1.454.CMB.1.raw
  modified_base (397)..(397): a, c, t, g, unknown or other
  misc_feature (397)..(397): n is a, c, g, or t
  modified_base (403)..(407): a, c, t, g, unknown or other
  misc_feature (403)..(407): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggaagttcacctctgtcgttcggccaagggaccaaggtagaaatgaaacgaactgtggctgcaccatctgtcttcatcttcccgcatctgactcgtctctactgagcgggctggcaaggcncatagnnnnn

SEQ ID NO: 121907 - DNA, 405 bp, Homo sapiens
  misc_feature: GYAE6OF01A3ZEH.1.46.E02.1.454.CMB.1.raw
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
  modified_base (378)..(378): a, c, t, g, unknown or other
  misc_feature (378)..(378): n is a, c, g, or t
  modified_base (398)..(405): a, c, t, g, unknown or other
  misc_feature (398)..(405): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtggatttgggacagagttttcnctcaccatcagcgccctacagagtgaagatgttgctagtttatttctgccagcaatataattacnggcctgcgtcgacgttcggcaacgggacaaggtgaaatcaaacgactgtgctgcacatctgtctcatctccgcatctgactcgtctctactgancgggctggcaaggcgcatgnnnnnnnn

SEQ ID NO: 121908 - DNA, 439 bp, Homo sapiens
  misc_feature: GYAE6OF01D3TLE.1.46.E02.1.454.CMB.1.raw
  modified_base (414)..(415): a, c, t, g, unknown or other
  misc_feature (414)..(415): n is a, c, g, or t
  modified_base (418)..(439): a, c, t, g, unknown or other
  misc_feature (418)..(439): n is a, c, g, or t
tcagacgagtgcgtcacgaccggtgctcgatttagactcatctacagggaaagggccaccctctcctgcagggccagtcagagtgttagccaacaactacttagcctggtaccagcagaaacctggccaggctcccaggctcctcatctatggtgcatccagcagggccactggcatcccagacaggttcagtgggcagtgggtctgggacagacttcactctcaccatcaccagactggagcctgaacgatttttgcagtgtaattactgtcagcagtatggtagctcacctcccatgtacacttttggccagggaccaaggtgaaatcaaacgaactgtggctgcaccatctgtcttcatcttcccgcatctcgactcgtctctactgagcgggctggtcaaggcgcatagnntannnnnnnnnnnnnnnnnnnnnn

SEQ ID NO: 121909 - DNA, 412 bp, Homo sapiens
  misc_feature: GYAE6OF01BJD4V.1.46.E02.1.454.CMB.1.raw
  modified_base (408)..(412): a, c, t, g, unknown or other
  misc_feature (408)..(412): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcacatctgtcttcatcttcccgcatctgactcgtctctactgagcgggctggcaaggcgcatagnnnnn

SEQ ID NO: 121910 - DNA, 409 bp, Homo sapiens
  misc_feature: GYAE6OF01A5C02.1.46.E02.1.454.CMB.1.raw
  modified_base (405)..(409): a, c, t, g, unknown or other
  misc_feature (405)..(409): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggaagttcacctctgtcgtttcggccaagggaccaaggtagaaatgaaacgactgtggctgcaccatctgtcttcatcttcccgccatctgactcgtctctactgagcgggctggcaagggcgcatagnnnnn

SEQ ID NO: 121911 - DNA, 418 bp, Homo sapiens
  misc_feature: GYAE6OF01EPFEJ.1.46.E02.1.454.CMB.1.raw
  modified_base (411)..(418): a, c, t, g, unknown or other
  misc_feature (411)..(418): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcaccatctgtcttcatcttcccgcctatctgactcgtctctactgagcgggctggcaaggcgcatagnnnnnnnn

SEQ ID NO: 121912 - DNA, 415 bp, Homo sapiens
  misc_feature: GYAE6OF01BVPXQ.1.46.E02.1.454.CMB.1.raw
  modified_base (406)..(415): a, c, t, g, unknown or other
  misc_feature (406)..(415): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccagggaccaaggtggaaatcaaacgaactgtggctgcacatctgtcttcatcttccgcatctgactcgtctctactgagcgggctggcaaggcgcatagnnnnnnnnnn

SEQ ID NO: 121913 - DNA, 409 bp, Homo sapiens
  misc_feature: GYAE6OF01E2G3Y.1.46.E02.1.454.CMB.1.raw
  modified_base (404)..(409): a, c, t, g, unknown or other
  misc_feature (404)..(409): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctccatgtacacttttggccagggaccaaggtgaaatcaaacgactgtggctgcacatctgtcttcatcttcccgctatctgctcgtctctactgagcggctggcaaggcgcatacgnnnnnn

SEQ ID NO: 121914 - DNA, 393 bp, Homo sapiens
  misc_feature: GYAE6OF01DIC8R.1.46.E02.1.454.CMB.1.raw
  modified_base (289)..(289): a, c, t, g, unknown or other
  misc_feature (289)..(289): n is a, c, g, or t
  modified_base (385)..(385): a, c, t, g, unknown or other
  misc_feature (385)..(385): n is a, c, g, or t
  modified_base (389)..(393): a, c, t, g, unknown or other
  misc_feature (389)..(393): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcatcattagcagactggagcctgaagatttcgcagtgtattactgtcagcagtatggaagttcacctntgtcgttcgcaaggacaaggtagaaatgaaacgactgtgctgcacatctgtctcatctccgcatctgactcgtctctactgagcggctggcagcgnatgnnnnn

SEQ ID NO: 121915 - DNA, 411 bp, Homo sapiens
  misc_feature: GYAE6OF01A3AD1.1.46.E02.1.454.CMB.1.raw
  modified_base (315)..(315): a, c, t, g, unknown or other
  misc_feature (315)..(315): n is a, c, g, or t
  modified_base (396)..(396): a, c, t, g, unknown or other
  misc_feature (396)..(396): n is a, c, g, or t
  modified_base (402)..(403): a, c, t, g, unknown or other
  misc_feature (402)..(403): n is a, c, g, or t
  modified_base (405)..(411): a, c, t, g, unknown or other
  misc_feature (405)..(411): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaattcacctctgtcgttcggccaagggaccaaggtanaaatgaaacgaactgtaggctgcaccatctgtcttcatcttcccgcatctgactcgtctctactgagcgggctggcaggcncatagnngnnnnnnn

SEQ ID NO: 121916 - DNA, 415 bp, Homo sapiens
  misc_feature: GYAE6OF01EN9Y0.1.46.E02.1.454.CMB.1.raw
  modified_base (408)..(415): a, c, t, g, unknown or other
  misc_feature (408)..(415): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtgctgcacatctgtcttcatccttccgccatctgactcgtctctactgagcgggctggcaaggcgcatagnnnnnnnn

SEQ ID NO: 121917 - DNA, 416 bp, Homo sapiens
  misc_feature: GYAE6OF01CJY1O.1.46.E02.1.454.CMB.1.raw
  modified_base (409)..(416): a, c, t, g, unknown or other
  misc_feature (409)..(416): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtaggctgcaccatctgtcttcatctcccgccatctgactcgtctctactgagcggctggcaaggcgcatagnnnnnnnn

SEQ ID NO: 121918 - DNA, 417 bp, Homo sapiens
  misc_feature: GYAE6OF01A7S16.1.46.E02.1.454.CMB.1.raw
  modified_base (410)..(416): a, c, t, g, unknown or other
  misc_feature (410)..(416): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcaccatctgtcttcatcttcccgccatctgactcgtctctactgagcgggctggcaaggcgcatagnnnnnnnt

SEQ ID NO: 121919 - DNA, 409 bp, Homo sapiens
  misc_feature: GYAE6OF01DCI49.1.46.E02.1.454.CMB.1.raw
  modified_base (289)..(289): a, c, t, g, unknown or other
  misc_feature (289)..(289): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (404)..(409): a, c, t, g, unknown or other
  misc_feature (404)..(409): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagatttcgcagtgtattactgtcagcagtatggaagttcacctntgtcgttcggccaagggaccaaggtagaatagaaacgactgtggctgcacatctgtcttcacttctcccgcatctgacttcgtctctactgagcgggntcggcagggcncatagnnnnnn

SEQ ID NO: 121920 - DNA, 417 bp, Homo sapiens
  misc_feature: GYAE6OF01DF5NB.1.46.E02.1.454.CMB.1.raw
  modified_base (402)..(402): a, c, t, g, unknown or other
  misc_feature (402)..(402): n is a, c, g, or t
  modified_base (409)..(417): a, c, t, g, unknown or other
  misc_feature (409)..(417): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctccatgtactacttttggccagggaccaaggtgaaatcgaaacgtactgtggctgcacatctgtcttcatcttccgctatctgactcgtctcgtactgagcgggctggcgtaggcncgatagnnnnnnnnn

SEQ ID NO: 121921 - DNA, 415 bp, Homo sapiens
  misc_feature: GYAE6OF01COW95.1.46.E02.1.454.CMB.1.raw
  modified_base (298)..(298): a, c, t, g, unknown or other
  misc_feature (298)..(298): n is a, c, g, or t
  modified_base (403)..(403): a, c, t, g, unknown or other
  misc_feature (403)..(403): n is a, c, g, or t
  modified_base (409)..(415): a, c, t, g, unknown or other
  misc_feature (409)..(415): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacncttttggccaggggaccaagggtggaaatcaaacgaactgtggctgcacatctgtcttcatcttccgccatctgactcgtctctactgagcgggctggcaaggcncatagnnnnnnn

SEQ ID NO: 121922 - DNA, 491 bp, Homo sapiens
  misc_feature: GYAE6OF01DDB5J.1.46.E02.1.454.CMB.1.raw
  modified_base (240)..(240): a, c, t, g, unknown or other
  misc_feature (240)..(240): n is a, c, g, or t
  modified_base (468)..(468): a, c, t, g, unknown or other
  misc_feature (468)..(468): n is a, c, g, or t
  modified_base (471)..(491): a, c, t, g, unknown or other
  misc_feature (471)..(491): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgagattttgcagtgtattactgtcagcagtatggtagctcacctcccatgtactacttttggccaggggaccaagggtggaatactaacgaacgtagtggcgtcgtcgaccactacttcgttcgttctacttcttccccgtcccgtactcttcgtacgtccgttccttccttacttacgtacgggaccgggtccggtcggtaccggacggacggccgatacggtncgnnnnnnnnnnnnnnnnnnnnn

SEQ ID NO: 121923 - DNA, 575 bp, Homo sapiens
  misc_feature: GYAE6OF01BGCXM.1.46.E02.1.454.CMB.1.raw
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (551)..(575): a, c, t, g, unknown or other
  misc_feature (551)..(575): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatcgtactacgttttggccgaaggggtaccaagggtaggaaaacgtcgaaaacggaactggtagggactaggaccaaccgtactcgttcggttcctttaccgtactttcccgtttaccccggcctaacgtttcccttacggttacctttaccggttccctttacccgttaaccgttcgggtaacgggtcccgggggtaccgttcgggggtaacccgaaacggggtcccgtacgaaacgtttaacggctacgngnngcgtnnnnnnnnnnnnnnnnnnnnnnnnn

SEQ ID NO: 121924 - DNA, 414 bp, Homo sapiens
  misc_feature: GYAE6OF01CNK8A.1.46.E02.1.454.CMB.1.raw
  modified_base (401)..(401): a, c, t, g, unknown or other
  misc_feature (401)..(401): n is a, c, g, or t
  modified_base (407)..(414): a, c, t, g, unknown or other
  misc_feature (407)..(414): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcacatctgtcttcatcttcccgcatctgactcgtctctactgagcgggctggcaggcncatagnnnnnnnn

SEQ ID NO: 121925 - DNA, 491 bp, Homo sapiens
  misc_feature: GYAE6OF01CWJM0.1.46.E02.1.454.CMB.1.raw
  modified_base (457)..(458): a, c, t, g, unknown or other
  misc_feature (457)..(458): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (466)..(491): a, c, t, g, unknown or other
  misc_feature (466)..(491): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctagaagattttgcagtgttattactgtcagcagtatggtagctccacctcccatcgtacacttttcgccgaaggggaccaagggtacggaaactaccgaaacgaacgtagtggctgcaccatctgttcttcattccttcccgacctatcctgtaccttcgttctcttacgtgacggccgggtctagggtccgaaagggtccacgtaagttacggnngnancgtnnnnnnnnnnnnnnnnnnnnnnnnnn

SEQ ID NO: 121926 - DNA, 535 bp, Homo sapiens
  misc_feature: GYAE6OF01CMFHD.1.46.E02.1.454.CMB.1.raw
  modified_base (357)..(357): a, c, t, g, unknown or other
  misc_feature (357)..(357): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (510)..(535): a, c, t, g, unknown or other
  misc_feature (510)..(535): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacactttttggccaggggaccaaagggtggaaagtacaaacgaaacgtagtggtcgtcgtanaccaactcgtacgttcttccgttacttcctttacccgttccccgacttaccgttcgtaaccgttccgtttccgttccttaccgttcggtaacggccggggtccggttcgggtaccggtaacgggaccggtaccgtaacgtagtanacgcngannnnnnnnnnnnnnnnnnnnnnnnnn

SEQ ID NO: 121927 - DNA, 680 bp, Homo sapiens
  misc_feature: GYAE6OF01CSDJK.1.46.E02.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (628)..(628): a, c, t, g, unknown or other
  misc_feature (628)..(628): n is a, c, g, or t
  modified_base (656)..(656): a, c, t, g, unknown or other
  misc_feature (656)..(656): n is a, c, g, or t
  modified_base (662)..(662): a, c, t, g, unknown or other
  misc_feature (662)..(662): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (677)..(678): a, c, t, g, unknown or other
  misc_feature (677)..(678): n is a, c, g, or t
  modified_base (680)..(680): a, c, t, g, unknown or other
  misc_feature (680)..(680): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtncatccagcagggccactggcatcccagacaggttcagtggcaggtgggtcngggacagacttcactcncaccatccaacgagactggagcctagaagtattttgacaggtntattactgtcagtcagtatggtanctcacctcccatcgtactacgttttcgaccgaggggacctaaagggttaggaaaacttaccaaaaaacggtaaaccgttgggttacggggacctttacgggaaccaaccccgtaaattacccgtttcggtttacccgtttttaccgtaaaccgttttcccttttaacccccgggaccccttaacgtttacccttacgggtaacccctttccgggtttaccctttacccgtttaaccgttacgggaaccgggtccgggggtaccgttacggggtaaccgtaaaacggggtcccgggtaaccaaagtttaacgggagtacgtacgtacgtacgtacgtagancgacgagacgagtagtagagacgacganagacanagacgtcananacgnngn

SEQ ID NO: 121928 - DNA, 441 bp, Homo sapiens
  misc_feature: GYAE6OF01A10MS.1.46.E02.1.454.CMB.1.raw
  modified_base (240)..(240): a, c, t, g, unknown or other
  misc_feature (240)..(240): n is a, c, g, or t
  modified_base (398)..(398): a, c, t, g, unknown or other
  misc_feature (398)..(398): n is a, c, g, or t
  modified_base (423)..(424): a, c, t, g, unknown or other
  misc_feature (423)..(424): n is a, c, g, or t
  modified_base (427)..(441): a, c, t, g, unknown or other
  misc_feature (427)..(441): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggtagctcacctcccatgtacacttttggccagggaccgaaggtaggaacgtacaaacgaacgtgtggctgcacatctcgtcttctactcttcccgcctactctcgtactcgtctctactgngcgggcgtcggcgacgcgcagtagnncgnnnnnnnnnnnnnnn

SEQ ID NO: 121929 - DNA, 441 bp, Homo sapiens
  misc_feature: GYAE6OF01CJ8O2.1.46.E02.1.454.CMB.1.raw
  modified_base (422)..(441): a, c, t, g, unknown or other
  misc_feature (422)..(441): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggcctaaggggaccaaggtaggaaatcgaaacgaactgtggctgcacatctgtcttcactcttcccgcatctgactcgtctctacgtgaacgcggctggtacaagggtccgcacgtagannnnnnnnnnnnnnnnnnnn

SEQ ID NO: 121930 - DNA, 538 bp, Homo sapiens
  misc_feature: GYAE6OF01E3X1D.1.46.E02.1.454.CMB.1.raw
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (514)..(538): a, c, t, g, unknown or other
  misc_feature (514)..(538): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcaggtggcaggtgggtctgggacagacttcactctcaccatccaccagactggacncctagaagtattttgctagttagttattactgtcagcagttagtgggtacnccgtacaccctccctattcgtacctacgttttcggaccgtacggggtaaccaagggtagaaaactccgaaaacgtacgtggtcgcgtcgaccgtactacgttcttcgttccttactacttcccttccccgctacttccgtacgtaccttccgttaccttcttaccggtggaccggtccgggtacgtccgggacgacgggtccaccgtagttgacntncnnnnnnnnnnnnnnnnnnnnnnnnn

SEQ ID NO: 121931 - DNA, 528 bp, Homo sapiens
  misc_feature: GYAE6OF01D2ASF.1.46.E02.1.454.CMB.1.raw
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (503)..(528): a, c, t, g, unknown or other
  misc_feature (503)..(528): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcaggtgggtcgtgggacagtacttcactctccaccatccaccgagactggacncctagaagtnttttgctagttgttattactgtcagcagtatggtagctcacctccattcgtactactttcggacgagggtaacaagggtagaactaacgaaacgtacgtgtcgtcgtacgactaccacttcgttcgttaccttcgtaacctttcccgttaccccgtacctacttccgtacgtaccgttcgttccttccgtacgtcggacgggtccgggtacgtacgggacgtaccggcgtactaacgtgcntnacnnnnnnnnnnnnnnnnnnnnnnnnnn

SEQ ID NO: 121932 - DNA, 428 bp, Homo sapiens
  misc_feature: GYAE6OF01A21B6.1.46.E02.1.454.CMB.1.raw
  modified_base (240)..(240): a, c, t, g, unknown or other
  misc_feature (240)..(240): n is a, c, g, or t
  modified_base (414)..(428): a, c, t, g, unknown or other
  misc_feature (414)..(428): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggtagctcacctcccatcgtacacttttggccagggaccaaggtgaaatcaaacgactgtgctgcacatctgtcttcatccttcccgcctatctacgtacctcgttctctactcgagcgggctggcaggcgacatagnnnnnnnnnnnnnnn

SEQ ID NO: 121933 - DNA, 418 bp, Homo sapiens
  misc_feature: GYAE6OF01A89PT.1.46.E02.1.454.CMB.1.raw
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (412)..(418): a, c, t, g, unknown or other
  misc_feature (412)..(418): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatccaccagactggancctgaagattttgcagtgtattactgtcagcagtatggtanctcacctccatgtactacgtttgccgagggaccaaggtgaaatgaaacgactgtgctgcacntctgtcttcactcctccgctctctcgctcgtctctactgacgcggntcggcgaacggcganatagncnnnnnnn

SEQ ID NO: 121934 - DNA, 418 bp, Homo sapiens
  misc_feature: GYAE6OF01B1DR3.1.46.E02.1.454.CMB.1.raw
  modified_base (411)..(418): a, c, t, g, unknown or other
  misc_feature (411)..(418): n is a, c, g, or t
tcagacgagtgcgtcacgaccggtgctcgatttagactcatctacagggaaagggacaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggacgcctgaagattttgcagtgtattactgtcagcagtatggtagctcacctccatgtactacttttggccgaggggaccaaggtaggaaatcaaacgaactgtggctagcacatctgtcttcactccttccgcatctgctcgtctctactgagccggctcggcaggcgcatgnnnnnnnn

SEQ ID NO: 121935 - DNA, 599 bp, Homo sapiens
  misc_feature: GYAE6OF01CSAX3.1.46.E02.1.454.CMB.1.raw
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
  modified_base (570)..(570): a, c, t, g, unknown or other
  misc_feature (570)..(570): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
  modified_base (588)..(589): a, c, t, g, unknown or other
  misc_feature (588)..(589): n is a, c, g, or t
  modified_base (591)..(599): a, c, t, g, unknown or other
  misc_feature (591)..(599): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccagtggcatcccagacagggttcagtggcaggtgggtctgggacagtacttcactctacacatccaccagacctggacgtcctagaagtattttgactagtcgttattactgtcagtcagttagtggtacgtctccaccctccattcgtacctacgttttcggaccgtaacgggacctaagggtacggaaacttacgaaacgtacgtggtacggactcgactaaccgacgttcgttaccgttcttaacctacgtttaccctttacccgaccgttacttcctaccggttaccgtttacccgttcccgttaaccttacggttacgtaacggggtcccgggtaccgttacgggaccgggtaaaccgggccgtaccgttaagtaccggngtcactctngtagctgcntagtctcgcgngncnntnntnnnnnnnnn

SEQ ID NO: 121936 - DNA, 656 bp, Homo sapiens
  misc_feature: GYAE6OF01B4LBM.1.46.E02.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
tcagacgagtgcgtcacgaccggtgctcgatttagactcatctacagggaaagggccacccgtctcctgcagggccagtcagagtgttagcaacaactacttagcctggtaccagcagaacctggccaggctccaggctcctcatctatggtgctatccagcagggccactggacatcccagacagttcagtggcagtggtctgggacngacttcactntcacatcaccagactganctganatttagcagtgtattactgtacagcagtatagtagctcgcctaccagtacgtacgtacgttttcggacgtacgggaacctaaggtacggaaagtacgtaaacgtaacgtacgtggacgttcgaccgtaacgtaacgttccgttacggtttaccttacttaacccgttacccgttccccgtacccttaacctttccggtacccgttaccggttaccgtttacccgttacccgtaaacgtttcgggtaacgggtacgggtcccgtaggtacccgtaacgggtccgtacccgggtaattaacgtacgggtcgtaagtacgtagtacgtcgtacgtacgtacgtacgtacgtacgtacgtacgtacgacgtacgtactacgtacgtacgtcgacgtacgtacgtacgtcgtcgtgtag

SEQ ID NO: 121937 - DNA, 437 bp, Homo sapiens
  misc_feature: GYAE6OF01AQ0ND.1.46.E02.1.454.CMB.1.raw
  modified_base (240)..(240): a, c, t, g, unknown or other
  misc_feature (240)..(240): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (406)..(407): a, c, t, g, unknown or other
  misc_feature (406)..(407): n is a, c, g, or t
  modified_base (409)..(410): a, c, t, g, unknown or other
  misc_feature (409)..(410): n is a, c, g, or t
  modified_base (414)..(437): a, c, t, g, unknown or other
  misc_feature (414)..(437): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagatttcgcagtgtattactgtcagcagtatggtaattcacctctgtcgttcggccaaggaccaaggtagaaatgaaacgatgtagctgacacatctgtctcatcctcccgcatctgactcgtctctacgtgagtcggctcggcaaggcganacgtagnanntnncgtnnnnnnnnnnnnnnnnnnnnnnnn

SEQ ID NO: 121938 - DNA, 423 bp, Homo sapiens
  misc_feature: GYAE6OF01ATLAI.1.46.E02.1.454.CMB.1.raw
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (404)..(405): a, c, t, g, unknown or other
  misc_feature (404)..(405): n is a, c, g, or t
  modified_base (407)..(423): a, c, t, g, unknown or other
  misc_feature (407)..(423): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaggtagaaactnaaacgactgnggctgcacatctgtcttcatcttcccgcatctnactcgtctctacngagcggctggcaaggcncatnncnnnnnnnnnnnnnnnnn

SEQ ID NO: 121939 - DNA, 534 bp, Homo sapiens
  misc_feature: GYAE6OF01EULE0.1.46.E02.1.454.CMB.1.raw
  modified_base (507)..(507): a, c, t, g, unknown or other
  misc_feature (507)..(507): n is a, c, g, or t
  modified_base (514)..(534): a, c, t, g, unknown or other
  misc_feature (514)..(534): n is a, c, g, or t
tcagacgagtgcgtcacgaccggtgctcgatttagactcatctacagggaaagggccaccctctcctgcagggccagtcagagtgtagcaacaactacttagcctggtaccagcagaaacctggccaggctcccaggctcctcatctatggtgcatccagcgagggccactggcatcccagacaggttcagtggcaggtgggtctgggacaggtacttcactctacaccatccaccagactggcgctgaagtattttgctagtgtattactgtctagctagttagtcgggtaagccttccaccctccctagtcgtacttacgttttgggccgtaagggggtacctaaagggtaggaaactacgaaaacgaccgttaggtcgggtcgtcgacgtaacctattcgttacgttccttactaccttcccgttccccgacctagttctacgtacccttccgtccttctaccggtggacgggtcgggtcgtcggacgaacgggccgtacgtanaggtcannnnnnnnnnnnnnnnnnnnn

SEQ ID NO: 121940 - DNA, 463 bp, Homo sapiens
  misc_feature: GYAE6OF01DF9AE.1.46.E02.1.454.CMB.1.raw
  modified_base (239)..(239): a, c, t, g, unknown or other
  misc_feature (239)..(239): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (437)..(463): a, c, t, g, unknown or other
  misc_feature (437)..(463): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcagggccactggcatcccagacaggttcagtggcagtgggtctgggacagacttcactctcaccatcaccagactggancctgaagattttgacagtagtattactgtacagctagtatggtagctcacctccatgtactacgtttgccgagggaacctaaaggtcgaaatacaaacgaactgtggctagacacacttctgtcttacactcctcccgacactctagtacctcgtctcgttactagacggtcggctgggacaggccactanagcangnnnnnnnnnnnnnnnnnnnnnnnnnnn

SEQ ID NO: 121941 - DNA, 457 bp, Homo sapiens
  misc_feature: GYAE6OF01D1JHK.1.46.E02.1.454.CMB.1.raw
  modified_base (156)..(156): a, c, t, g, unknown or other
  misc_feature (156)..(156): n is a, c, g, or t
  modified_base (423)..(423): a, c, t, g, unknown or other
  misc_feature (423)..(423): n is a, c, g, or t
  modified_base (431)..(457): a, c, t, g, unknown or other
  misc_feature (431)..(457): n is a, c, g, or t
tcagacgagtgcgtcacgaccggtgctcgattttagactcatctacagggaaaggggccaccctctcctgcagggccagtcagagtgttagcaacaactacttagcctggtaccagcagaaacctggccaggctcccaggctcctcatctatggtncatccagcagggccactggcatcccagacaggttcagtggcagtgggtctggggacagacttcactctcaccatcaccagactggagcctgaacggattttgcagtgtattaactgtcagcagttatggtagcgtcacctcccatcgtacacttttggccaggggacccaaagggtggaaaatcaaacgaactgtggctgcaccatctgtacttcaatcctttcccgccatctgtactcgtctctactgagcggactggacaaggcncatacgannnnnnnnnnnnnnnnnnnnnnnnnnn

SEQ ID NO: 121942 - DNA, 422 bp, Homo sapiens
  misc_feature: GYAE6OF01BBIAO.1.46.E02.1.454.CMB.1.raw
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (406)..(422): a, c, t, g, unknown or other
  misc_feature (406)..(422): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatgctgggtcccacagggccactggcatcccagacaggttcagtggcagtgggtctggggacagacttcactctcatcattagcagactggagcctggaagatttcgcagtgtattactgtcagcagtatggaagtttcaacctctgtcgttcggcctaagggaccaaggtagaaatgaaacgaactgtgctgcncatctgtcttcatcttcccgcatcngactcgtctntactgtagcggctggcaaggcgcatagnnnnnnnnnnnnnnnnn

SEQ ID NO: 121943 - DNA, 767 bp, Homo sapiens
  misc_feature: GYAE6OF01AB5PV.1.46.E02.1.454.CMB.1.raw
  modified_base (152)..(152): a, c, t, g, unknown or other
  misc_feature (152)..(152): n is a, c, g, or t
tcagacgagtgcgtcacgaccggtgctcgatttagactcatctacagggaaagggccaccctctcctgcagggccagtcagagtgttagcaacaactacttagcctggtaccagcagaacctggccaggctccaggctcctcatctatggtncatccagcagggccatggcactcccagacaggttcagtggcaggtgggtctgggacagtacttcactctcaaccataccacctagaccgtggacgtccgtagaagtatttttaggacctaagttagttaactttacgtagttacaggacctaggttaacttgggtaacgctaccgacccttacccagttcgtaaccgtacgttttacgggacccgtaaggggtaaccctaagggtacggtaaaacttaccgaaaaacggtacgtacggtacgggacttacggacctaaccgtagttaccgttacggttaaccttttacgaaccgttttacccgttacccccgtaaccgtaccgtttccgtaagggttacccctttaccggttacccgttaccgtttaaacccggtgggtaaccgggtacggtaccgtacgggtaccgaacgggtacccgtaccgtaacgttaacggcttaacgcgttaccgaaggttccccacgtttacgtaaggtccctacgtacccgggaaagtacgtcccggggtagttaaacccgtaattcccggttaaggtccctaaagggtcgtaccctaacgtaacgggtagtacgtacgtacgtacg

SEQ ID NO: 121944 - DNA, 697 bp, Homo sapiens
  misc_feature: GYAE6OF01CRKZ1.1.46.E02.1.454.CMB.1.raw
  modified_base (208)..(208): a, c, t, g, unknown or other
  misc_feature (208)..(208): n is a, c, g, or t
  modified_base (604)..(604): a, c, t, g, unknown or other
  misc_feature (604)..(604): n is a, c, g, or t
  modified_base (670)..(697): a, c, t, g, unknown or other
  misc_feature (670)..(697): n is a, c, g, or t
tcagacgagtgcgtcacgaccggtgctcgatttagactcatctacagggaaagggccaccctctcctgcagggccagtcagagtgttagcaacaactacttagccctggtaccagcagaaacctggccaggcctccaggcctcctcatctagtggtgcactccagcgacgggcccacgtcggcactcccagacgtaggttcagtggcngggtcgggtcgtggggacagtaccttcactcctacacctagaccgaaccgacgtacgtgggaaccgtccgtaaggtaaagtttacgtttttcggacgttaaggtttaggtttaacttaccgtttcggtacgaaggtaccgtaaaggtttacggttaccggggtaactcccgttccccgaaacccctttcccgtaagtttaccggttaacccttaccggggttttaccggacccgggaaaccggggtaaccggtaacggggtaaaccggtaaagttaacccggtaaaacgtacgggtagtaaccggggttcctaacggaccctaacgtacggttaccttccggttccttacctaccgtttccccgtacccgactactttccgtacttaccccggttntacccttaacgttcggacgggtacgtcggggtacgtaccggacggtaacggtccgtaatcgtaagnnnnnnnnnnnnnnnnnnnnnnnnnnnn

SEQ ID NO: 121945 - DNA, 523 bp, Homo sapiens
  misc_feature: GYAE6OF01CWHK0.1.46.E02.1.454.CMB.1.raw
  modified_base (150)..(150): a, c, t, g, unknown or other
  misc_feature (150)..(150): n is a, c, g, or t
  modified_base (154)..(154): a, c, t, g, unknown or other
  misc_feature (154)..(154): n is a, c, g, or t
  modified_base (249)..(249): a, c, t, g, unknown or other
  misc_feature (249)..(249): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (511)..(523): a, c, t, g, unknown or other
  misc_feature (511)..(523): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggcctccaggctcctcatttanggtncatccagcacgggccacgtggcatcccagacaggttcaggtggctaggtgggtctgggacagacttcactctacaccatcgaccagactgggacncgttagaagtagtttgacgtagtgttaacttacgtgccgaagtctaaggttagtcggtacgtccttccacccttaccagttactacttacgtttcgggacccgtaaggggaccctaaagggtagtaaaataggaaaaccgtagttcggagcgtagaccaaccgtnttcgtcgttacttacgtactcctttacccgacgtntcgtaccgtactcgttactcgttaacgnggacggccggtagacgcgaagggccngtaacngnnnnnnnnnnnnn

SEQ ID NO: 121946 - DNA, 750 bp, Homo sapiens
  misc_feature: GYAE6OF01BR5YV.1.46.E02.1.454.CMB.1.raw
tcagacgagtgcgtcacgaccggtgctcgatttagactcatctacagggaaagggccaccctctcctgcacgggccagtcagagtgttagcaacaactacttagcctggtaccagcagaaacctggccaggctcccaggctcctcatctatggtgctatccagcagggcctactggcatcccagacaggttcaggtggcaggtgggtcgtgggactaggaccgttcgactctccacctatcaccagactggacgcctagaagtattttcgactagtgtattactgtcagtcgtagtagtggtacgctccgaccgtccgtagttcgttacctacgttttcgggaccgtaaggggtaccgtaaagggtacggtaaaacgtaccggtaaaacggtaaccggttaggtacggacgttacggacccgtaacctacgttaccgttacggtttacctttaccgtaaccgtttcccgtttacccccggtaccctttaacgttccgttaccggttaacccgtttcccggtttacccgttttacccgttaaccgggttaacgggtaaccggggttacccgggggttaccgggtttaccggggtaaacccgggtaaaccggggtacccggtaaccgttaacgggttaacggacgtcggtaagtacggacggtaacgacgtagacgtacgtacgtacgtactactacgtacgtacgtacgtacgacgtacgagtacgcgtcggacgtagcgtcgtcggtcgg

SEQ ID NO: 121947 - DNA, 655 bp, Homo sapiens
  misc_feature: GYAE6OF01B447V.1.46.E02.1.454.CMB.1.raw
  modified_base (228)..(228): a, c, t, g, unknown or other
  misc_feature (228)..(228): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(644): a, c, t, g, unknown or other
  misc_feature (643)..(644): n is a, c, g, or t
  modified_base (646)..(647): a, c, t, g, unknown or other
  misc_feature (646)..(647): n is a, c, g, or t
  modified_base (649)..(654): a, c, t, g, unknown or other
  misc_feature (649)..(654): n is a, c, g, or t
tcagacgagtgcgtcacgaccggtgctcgatttagactcatctacagggaaagggccaccctctcctgcagggccagtcagagtgttagcaacaactacttagcctggtaccagcagaacctggccaggctcccaggctcctcatctatggtgcatccagcagggccactggcatcccagacaggttcagtggcaggtgggtctgggacagtacttcactctcaccgntccaccagactggacgtcctagaagtattttggctagttgttattacgtcgtacagtctaggtattggtacgcctccgtacccctcccgtattacgttaccttaccgttttcgggacccggaacggggtaacccgtaaagggttaaccgggtaaaactaccggtaaaaccggtaaccgttaggtcgggaccttacggaccctaaccgtaacgtttcccttacggtttacctttacccgtaaccgtttcccccgtttaccccggacccttacgttccgtaccgtacgtttcccggttaccttacccgttacgtacgggtacggtccggggtaccgttacgggaccgtaacgggtcccgtaaccgtaacggttagacgtcgacntacgcncgcgcncgtgngngcgtcagngngncnngnntnnnnnnc

SEQ ID NO: 121948 - DNA, 556 bp, Homo sapiens
  misc_feature: GYAE6OF01BN7IO.1.46.E02.1.454.CMB.1.raw
  modified_base (206)..(206): a, c, t, g, unknown or other
  misc_feature (206)..(206): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (378)..(378): a, c, t, g, unknown or other
  misc_feature (378)..(378): n is a, c, g, or t
  modified_base (527)..(528): a, c, t, g, unknown or other
  misc_feature (527)..(528): n is a, c, g, or t
  modified_base (530)..(538): a, c, t, g, unknown or other
  misc_feature (530)..(538): n is a, c, g, or t
  modified_base (540)..(556): a, c, t, g, unknown or other
  misc_feature (540)..(556): n is a, c, g, or t
tcagacgagtgcgtcacgaccggtgctcgatttagactcatctacagggaaagggccaccctctcctgcagggccagtcagagtgttagcaacaactacttagcctggtaccagcagaacctggccaggctcccaggctcctcatctatggtgcatccagcagggccacgtggcactcccagacaggttcagtggcaggtgggtcngggacagcttcactctcaccatccaccagactggacgtcctaggaagtattttgactaggttnttaatttactgtcagtcagtatggtanccgtcaccctcctatcgttactacgtttcggacgtacggggaccgtaaggtagtaaactacgaaacgtacgtggtcggtacngtaccaacctatccgttcgttccttctaccgtttcccttacccgtaccttacgtaccttcgtacccgttcccggttccttaccgttaccggtaggaccgggtccgggtaccgttcggggtaacgaccggggacctaccgtatacggtanncnnnnnnnnncnnnnnnnnnnnnnnnnn

SEQ ID NO: 121949 - DNA, 573 bp, Homo sapiens
  misc_feature: GYAE6OF01CT21L.1.46.E02.1.454.CMB.1.raw
  modified_base (550)..(554): a, c, t, g, unknown or other
  misc_feature (550)..(554): n is a, c, g, or t
  modified_base (556)..(573): a, c, t, g, unknown or other
  misc_feature (556)..(573): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcagggccatggcatcccagactaggttcaggtggcaggttggggtctgggacagtacttcactctcaaccataccaccagactggacgcctagaagtattttcgactaggtagttacttatggtactagacgtagtaagttggtacgtctaccgtaccctccgtaacttcggttaacttacgttttcggaccggtaacgggaaccgtaagggtagtaaaaacgtaccgaaaacggtacttacgggtagtccgtacgaacccgtactaacgttcttcgtttaccctttcgtactttcccgtacccgcttacgtccttacgttaccttcgttactacccgtttacgtggtaacgggccggttcgtacggaacgacggtcgtacctagacgtnnnnngnnnnnnnnnnnnnnnnnn

SEQ ID NO: 121950 - DNA, 666 bp, Homo sapiens
  misc_feature: GYAE6OF01EG74D.1.46.E02.1.454.CMB.1.raw
  modified_base (67)..(67): a, c, t, g, unknown or other
  misc_feature (67)..(67): n is a, c, g, or t
  modified_base (161)..(161): a, c, t, g, unknown or other
  misc_feature (161)..(161): n is a, c, g, or t
  modified_base (477)..(477): a, c, t, g, unknown or other
  misc_feature (477)..(477): n is a, c, g, or t
  modified_base (580)..(580): a, c, t, g, unknown or other
  misc_feature (580)..(580): n is a, c, g, or t
  modified_base (607)..(607): a, c, t, g, unknown or other
  misc_feature (607)..(607): n is a, c, g, or t
  modified_base (624)..(624): a, c, t, g, unknown or other
  misc_feature (624)..(624): n is a, c, g, or t
  modified_base (629)..(629): a, c, t, g, unknown or other
  misc_feature (629)..(629): n is a, c, g, or t
  modified_base (632)..(633): a, c, t, g, unknown or other
  misc_feature (632)..(633): n is a, c, g, or t
  modified_base (641)..(641): a, c, t, g, unknown or other
  misc_feature (641)..(641): n is a, c, g, or t
  modified_base (646)..(647): a, c, t, g, unknown or other
  misc_feature (646)..(647): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (658)..(659): a, c, t, g, unknown or other
  misc_feature (658)..(659): n is a, c, g, or t
  modified_base (663)..(663): a, c, t, g, unknown or other
  misc_feature (663)..(663): n is a, c, g, or t
tcagacgagtgcgtcacgaccggtgctcgatttagactcatctacagggaaagggccaccctctccngcagggccagtcagagtgttagcaacaactacttagcctggtaccagcaacgaaacctggccaggcctcccgaggcctcctcactctagtggtncactccagcgacgggccacgtggctactcccgaaggtaccgtaggttcgaaggttcggcgtagggttcggggtacgtacgggaacctacggtacctttcaccttctaacccacctactccaacctaggacgtcggaacgttccgtaaggtaagtttactttcgacgttacgttagttaacttacgtcggtacaagtcgtaagttaacggtaggtaaccgtcctacgtcgttcggttaccggtaccggaacgtaacgggaactaaaggtaacgtaaacgtacggaaaccgtagtcggactacgtacggactaacgtntttaccgttcgttactaccgtaccgttcccttacccgtacttacgtaccggttactacccgttccgttactcgttacgtcggggacgccgtcggcgtaaccgnggtaccgtactagtccggatcgtacgntcgatcgcgtaatcgangtacncgnngacacganacgcnngcncngcgcannctgngcg

SEQ ID NO: 121951 - DNA, 639 bp, Homo sapiens
  misc_feature: GYAE6OF01A77FF.1.46.E02.1.454.CMB.1.raw
  modified_base (144)..(144): a, c, t, g, unknown or other
  misc_feature (144)..(144): n is a, c, g, or t
  modified_base (154)..(154): a, c, t, g, unknown or other
  misc_feature (154)..(154): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
  modified_base (596)..(596): a, c, t, g, unknown or other
  misc_feature (596)..(596): n is a, c, g, or t
  modified_base (606)..(606): a, c, t, g, unknown or other
  misc_feature (606)..(606): n is a, c, g, or t
  modified_base (612)..(612): a, c, t, g, unknown or other
  misc_feature (612)..(612): n is a, c, g, or t
  modified_base (625)..(625): a, c, t, g, unknown or other
  misc_feature (625)..(625): n is a, c, g, or t
  modified_base (629)..(629): a, c, t, g, unknown or other
  misc_feature (629)..(629): n is a, c, g, or t
  modified_base (635)..(635): a, c, t, g, unknown or other
  misc_feature (635)..(635): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctnatctatggtncatccagcgacgggccacgtggacactcccagactaggttcaggtgcaggtgggtctgggactagcttcactctacaccatccaaccgtgtactggacgtctaggaaagttcgttttacggctaggttacgttaacgttacgttcgtacgtaacgtcgtaaggttacgttcgggtacgtccctaccgtacccctaccgtacttcggtaaccttacgttttacgggaccggtaacgggaacgtaacgggtagtaaactaccggaaaacgtacgtaggtcggtactacgaccgtactacgtcgtcgttacttacctacgttcccgtccgtactacgttacccgtagtaccgttccgttacgttacctacgtcggtacgtccgggtacgtcggtaccgaggtacgagtagtancgtancgntacngntcgngattccatacgtcncgacgtacgngtctancgtactcgagtcngtanccgtgngtcc

SEQ ID NO: 121952 - DNA, 721 bp, Homo sapiens
  misc_feature: GYAE6OF01AVPAY.1.46.E02.1.454.CMB.1.raw
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (696)..(708): a, c, t, g, unknown or other
  misc_feature (696)..(708): n is a, c, g, or t
  modified_base (710)..(710): a, c, t, g, unknown or other
  misc_feature (710)..(710): n is a, c, g, or t
  modified_base (712)..(721): a, c, t, g, unknown or other
  misc_feature (712)..(721): n is a, c, g, or t
tcagacgagtgcgtcacgaccggtgctcgatttagactcatctacagggaaaggggccaccctctcctgcagggccagtcagagtgttagcaacaactacttagcctggtaccagcagaaacctggccaggctcccaggctcctcatctatggtgcatccagcaggggccactggacactcccagactaggttcagtggcagtgggtctgggacagtacttcactctcacactccaccagacctggacgtccgtaggaacgtattttacggcgtagttaggttaactttacgtcggttacaacggtcgtaaggttagttagggttacggtaccttacctaaccccgtacccgtaaggttaccggttaaccgtttaccggttttttcggggaccccgggtaaaggggggtaacccgtaaacgggggttaaacgggtaaaaaccggttaacccggaaaaaacccggttaaccggtttaacggggtccgggtaccggttacccgacccggttaaaccctaacgtttcccgtttacggtttcccctttaaccccgttacccttccccggttttaccccccgacctttacggtaccgttccggtaaccgtttcccggtttcccgtacttaaccggtacggggtacggccgggggttacttaccggggacgaacccgggacgtaccgtaagttacgntgngnnnnnnnnnnnnngngnnnnnnnnnn

SEQ ID NO: 121953 - DNA, 696 bp, Homo sapiens
  misc_feature: GYAE6OF01ERHTH.1.46.E02.1.454.CMB.1.raw
  modified_base (162)..(162): a, c, t, g, unknown or other
  misc_feature (162)..(162): n is a, c, g, or t
  modified_base (615)..(615): a, c, t, g, unknown or other
  misc_feature (615)..(615): n is a, c, g, or t
  modified_base (651)..(651): a, c, t, g, unknown or other
  misc_feature (651)..(651): n is a, c, g, or t
  modified_base (658)..(658): a, c, t, g, unknown or other
  misc_feature (658)..(658): n is a, c, g, or t
  modified_base (665)..(666): a, c, t, g, unknown or other
  misc_feature (665)..(666): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (672)..(675): a, c, t, g, unknown or other
  misc_feature (672)..(675): n is a, c, g, or t
  modified_base (677)..(681): a, c, t, g, unknown or other
  misc_feature (677)..(681): n is a, c, g, or t
  modified_base (683)..(696): a, c, t, g, unknown or other
  misc_feature (683)..(696): n is a, c, g, or t
tcagacgagtgcgtcacgaccggtgctcgatttagactcatctacagggaaagggccaccctctcctgcagggccagtcagagtgttagcaaacaactacttagccctggtaccagcaacgaacctggccaggcctcccgaggcctcctcattctagtggtncactccgagccgacgggccctacgtcggacctaccgtaccccaaggaaccgtacggttccgaggtcggcgtagggttcgggtcgagggactacgtacttccacttcctaccaaccactccaaccgtagtccgtagggacctacgtagtaagttcttagtacgttaagttacgttaacttacgtcgtacaaggtacttaaggttgtacgggtacctccgtacccgtaccctacggtacttcgtaaccgttaccggttacgggaccgggtacgggtaacgtaagggtaacaaacgtaccgaaaccgtgtacgggtcgtacgaccgtacctacgttaccgtcgtttaccttcccgttactccggttcccccgtccgttaacctacgtttccccgtaacggttacccctttcccggtttaccttaccggtacgggaccggtacccgggggttacccncgggggttaacccaaccgggttacgaccggtttaancgttggntacgcgnngntncnnnngnnnnngnnnnnnnnnnnnnn

SEQ ID NO: 121954 - DNA, 634 bp, Homo sapiens
  misc_feature: GYAE6OF01B37ZD.1.46.E02.1.454.CMB.1.raw
  modified_base (216)..(216): a, c, t, g, unknown or other
  misc_feature (216)..(216): n is a, c, g, or t
  modified_base (606)..(608): a, c, t, g, unknown or other
  misc_feature (606)..(608): n is a, c, g, or t
  modified_base (610)..(610): a, c, t, g, unknown or other
  misc_feature (610)..(610): n is a, c, g, or t
  modified_base (612)..(616): a, c, t, g, unknown or other
  misc_feature (612)..(616): n is a, c, g, or t
  modified_base (618)..(634): a, c, t, g, unknown or other
  misc_feature (618)..(634): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgccatccagcagggccactggcatcccagacaggttcagtggcagtgggtctgggacagacttnactctcaccatcaccagactggagcctgaagattttggctagtgtaattacgtgtacagacagtatggtagcgtcaacctcccattgtacctaacttttcggaccgtaacggggaacccgtaaaggggttcgggaaaaacgtttaaccgaaaaaccggtaaacggttacgggtttacgggacctttacgggaacccgtaacccctaagttaccccgtttaagggtttcccgtttaccgtaaactttaccccgttttaccccgggacccccgttaatacccgtttacgaaccgtttccccggttaccttacccgttaacgtttacggtacggaccggggttacctaggggaccgtaaaacgggtccgaccgtaagttacgacgttggcacnnnangnnnnngnnnnnnnnnnnnnnnnn

SEQ ID NO: 121955 - DNA, 668 bp, Homo sapiens
  misc_feature: GYAE6OF01D0J3C.1.46.E02.1.454.CMB.1.raw
  modified_base (609)..(609): a, c, t, g, unknown or other
  misc_feature (609)..(609): n is a, c, g, or t
  modified_base (613)..(613): a, c, t, g, unknown or other
  misc_feature (613)..(613): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
  modified_base (634)..(635): a, c, t, g, unknown or other
  misc_feature (634)..(635): n is a, c, g, or t
  modified_base (653)..(654): a, c, t, g, unknown or other
  misc_feature (653)..(654): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (662)..(664): a, c, t, g, unknown or other
  misc_feature (662)..(664): n is a, c, g, or t
  modified_base (666)..(666): a, c, t, g, unknown or other
  misc_feature (666)..(666): n is a, c, g, or t
tcagacgagtgcgtcacgaccggtgctcgatttagactcatctacagggaaagggccaccctctcctgcagggccagtcagagtgttagcaacaactacttagcctggtaccagcaagaaacctggccaggcctcccgaggctcctcatctagtggtgcactccgagcagggccacgtggcactccagactaggttcaggtggcgtaggtcgggtcgtagggactacgtacttcacttctaccaaccatccaccgagacgtcggacgaccgtagaagttatttcggactagttagttacttacgtagtacgaagtagttcggttaagttcgggtacggtaccgtaacccgttaccgtaccggtttcgggacccggtaacggggaaccgtaagggtacgaagtacgtacgaacggtaacgtaacggtcggtacggtacgtacgaccgtaccgtacgttccgttacgttactttaccgacccttttaccccggtaccccgtacttacgttccggtaacgttcccgtaccgtttacctaccgttacgggtacggtaccgggtccgggtacggttaccgggaaccgtacgggtacctacggtaacgtaggacncgancacagcgctagcncagtcncnncgcgtagtcgtcgtgtgnngnacgnannngngc

SEQ ID NO: 121956 - DNA, 558 bp, Homo sapiens
  misc_feature: GYAE6OF01C95ET.1.46.E02.1.454.CMB.1.raw
  modified_base (242)..(242): a, c, t, g, unknown or other
  misc_feature (242)..(242): n is a, c, g, or t
  modified_base (288)..(288): a, c, t, g, unknown or other
  misc_feature (288)..(288): n is a, c, g, or t
  modified_base (528)..(528): a, c, t, g, unknown or other
  misc_feature (528)..(528): n is a, c, g, or t
  modified_base (532)..(558): a, c, t, g, unknown or other
  misc_feature (532)..(558): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcaggtgggtctggggacagacttcactctcaccatcaccagactggancctagagtattttgcagttgtattactgtcagcagtatagggtacnctaccacctcccagttctacgtactttttgggcccgaaggggacccaaagggttagaaaactaccgaaaacgtaacgtaggtacgggacttacggactaaccgaacttcgtcgttcctttactactttcccttaccccggtcctaatttcccgtacggtaccctttaccggttcccttaccttacgtagggaccgggtccgggtcgtcgggaccgtaaacggcgaccgtaatacgggcanacgnnnnnnnnnnnnnnnnnnnnnnnnnnn

SEQ ID NO: 121957 - DNA, 595 bp, Homo sapiens
  misc_feature: GYAE6OF01BW8U0.1.46.E02.1.454.CMB.1.raw
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtcgcatccagcagggccactggcatcccagacaggttcagtggcagtgggtctgggacagacttcactctcatcattagcagacgtggacgcctggaagtatttccgactagttgttacttactgtcagtccagtagtggtaacttccaccttcgtcggttccgttcgggaccaagggacctaaaggtagaaacgtaggaaaccgaacgttggtacggctacggacccaccgtacttccgttcgttacctttaccgactttccccgttaccccgaccttacttccgtacgtaccgttccgttctaccttacgtggtacggtcggggtctacggacgtaacggcacctagtggctacgntacgngtacnctntcgngtctacncgtacncgacgacgacgacgtcgtcgcgtcgacgtacgcgtacacgtacgtcgcgtcgtcg

SEQ ID NO: 121958 - DNA, 656 bp, Homo sapiens
  misc_feature: GYAE6OF01BJIXM.1.46.E02.1.454.CMB.1.raw
  modified_base (154)..(154): a, c, t, g, unknown or other
  misc_feature (154)..(154): n is a, c, g, or t
  modified_base (630)..(631): a, c, t, g, unknown or other
  misc_feature (630)..(631): n is a, c, g, or t
  modified_base (633)..(656): a, c, t, g, unknown or other
  misc_feature (633)..(656): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtncatccagcagggccactggcactcccagacaggttcaggtggcagtggggtctagggacagacttcacctcgtccaacctatccaccagacgtggacgcctagaacgttattttgacgtagtgttattacttgtacaggtcagttagtggtacgcctacgtaccctccacgttacttaccgttacggttttcgacggtaacggggtaaccgtaaaggttacgggaaaacttaaccggtaaaacgaaccgttagggtacgggttaccgtaccggaccgtaaccgttaacgttccttacgggtttacccttacgttaaccctttccccgtttacccccgtaccgttaccgtttcccgttacccggttccgtttaccccgttaccctttacggtttaacccgtcgggtacccggggtccgggtaccggttaccggggtaccgtaccggggtaccctacggaacgtaggtcgccgtgccnncnnnnnnnnnnnnnnnnnnnnnnnn

SEQ ID NO: 121959 - DNA, 604 bp, Homo sapiens
  misc_feature: GYAE6OF01ELGLZ.1.46.E02.1.454.CMB.1.raw
  modified_base (155)..(155): a, c, t, g, unknown or other
  misc_feature (155)..(155): n is a, c, g, or t
  modified_base (557)..(558): a, c, t, g, unknown or other
  misc_feature (557)..(558): n is a, c, g, or t
  modified_base (560)..(562): a, c, t, g, unknown or other
  misc_feature (560)..(562): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (574)..(578): a, c, t, g, unknown or other
  misc_feature (574)..(578): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (588)..(589): a, c, t, g, unknown or other
  misc_feature (588)..(589): n is a, c, g, or t
  modified_base (591)..(594): a, c, t, g, unknown or other
  misc_feature (591)..(594): n is a, c, g, or t
  modified_base (596)..(596): a, c, t, g, unknown or other
  misc_feature (596)..(596): n is a, c, g, or t
  modified_base (598)..(603): a, c, t, g, unknown or other
  misc_feature (598)..(603): n is a, c, g, or t
tcagacgagtgcgtcacgaccggtgctcgatttagactcatctacagggaaagggccaccctctcctgcagggccagtcagagtgttagcaacaactacttagcctggtaccagcagaacctggccaggcctccaggctcctcatctagtggtcncatccagcgacgggccaacgtggacactacccagactaggttcagtcgcctagggtcggtcgtacgggacacgtaccttcgaccttctaccaacctataccaaactacgtacgtcggccgacgttaagtaacgttacgtttacgacgtaggttacgttaacttacgtacgtacgtaagttacttaggttaacgttacggttaaccgtaccgtaccgttaccgttaccggttacggaccggtaacgggtacgtaagggtacgtaacgtacgtaacgaacgtacgtacgttcggtacgtactcgactacttacgttcttcgtacgtctacgtccgtcctctagttaccgtacgtcctccttcgtacgtacggtacggcggtcgtacgtacggacgacgcgagcnngnnngcncncntgctnnnnntcngtncgcnncnnnncncnnnnnnc

SEQ ID NO: 121960 - DNA, 748 bp, Homo sapiens
  misc_feature: GYAE6OF01A429I.1.46.E02.1.454.CMB.1.raw
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
  modified_base (694)..(694): a, c, t, g, unknown or other
  misc_feature (694)..(694): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
  modified_base (747)..(747): a, c, t, g, unknown or other
  misc_feature (747)..(747): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtagcatccagcagggccactggcactcccagactaggttcagtggcaggtggtcgtggactagacttcactctccaccactccaccgagacgtggacgcctagaagtattttgactagttgtaacttacgtcgtacacgtcgtaagttacgtacggggtacggttacccacccggttaaccgttacccggttttacgggaaccccgggtaacggggggtaaccccgtaaagggggttccgggtaacgtaacgtaaccggtaaccggaacccggtaaaccgtttgggtaccggtaccgtacggacccgtaacccgttaacgtttcccgttaaccgtttaccgtttaccctaaccgttttcccccggtttaccccccggaccctttaccgtttcccgtttaccgggtaccccttttaccccgggtttacccttaccggtttaacccggtacgggtaacccgggggttccgggtaccggttaacggggtacccgaaacggggtccgtaaccgttaacggttcgacgtcncgtnagtcactagtcncncncgacgtcgcgtcgcgtcacgcatacgtcgacgtcgagtacgcactctgnc

SEQ ID NO: 121961 - DNA, 724 bp, Homo sapiens
  misc_feature: GYAE6OF01DG9P5.1.46.E02.1.454.CMB.1.raw
  modified_base (126)..(126): a, c, t, g, unknown or other
  misc_feature (126)..(126): n is a, c, g, or t
  modified_base (152)..(152): a, c, t, g, unknown or other
  misc_feature (152)..(152): n is a, c, g, or t
  modified_base (162)..(162): a, c, t, g, unknown or other
  misc_feature (162)..(162): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (678)..(678): a, c, t, g, unknown or other
  misc_feature (678)..(678): n is a, c, g, or t
tcagacgagtgcgtcacgaccggtgctcgatttagactcatctacagggaaaggccaccctctcctgcagggccagtcagagtgttagcaacaactacttagcctggtaccagcagaacctggccnggctccgagctcctcatctatggtancatccagcgnggccagtggcatcccgagtactggttcagtgcgagtgggtctgggacactnttcacttctcaccagacaanagcgtggcgacctaggtaatcgttttcggacgtagttcgttaattcttagtagaacgtcgtaaggttacgtgggtaacctggtaaccctacggttcccgtaagtcgtaacccttgtttaccggacgggtaacggtaaccgagggtttaaggaacttaacgaaccggttaancggttancccggttaaagtcccgaacgttcccgtaagtttccgtcgtttaaacccgtttacttacccggcccccgtttaactacccgtttcccggtaaacccgtttaccggttacgttacgtttacccgggttaaccgttaacgggtacccggttaccggggttaaccgttaccggtaacccgggtttaacggtaccgtacccggaacgtttaaccgtacgtacgtcgtacgtacgtacgtcgtcgtacgtaccgtcgactcgtacgtcgtcgngtacgtactacgtcgagtcgtaccgtacgtactatacgtcgcgtac

SEQ ID NO: 121962 - DNA, 588 bp, Homo sapiens
  misc_feature: GYAE6OF01DPR1O.1.46.E02.1.454.CMB.1.raw
  modified_base (147)..(147): a, c, t, g, unknown or other
  misc_feature (147)..(147): n is a, c, g, or t
  modified_base (156)..(156): a, c, t, g, unknown or other
  misc_feature (156)..(156): n is a, c, g, or t
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (427)..(427): a, c, t, g, unknown or other
  misc_feature (427)..(427): n is a, c, g, or t
  modified_base (562)..(588): a, c, t, g, unknown or other
  misc_feature (562)..(588): n is a, c, g, or t
tcagacgagtgcgtcacgaccggtgctcgatttagactcatctacagggaaagggccaccctctcctgcgagggccagtcagagtgttagcaacaactacttagcctggtaccagcagaaacctggccaggcctcccgaggctcctnatctatgtncatccagcaggccatgcatcccagactggttcagtggcnggtgggtcgtgggaacngtacttcgacttcctaccaccgntccaccgaggtacgtggacgtccgtaagtaggttaatttttcggacgtaggttagtttactttacttgtacgagtcgtagttagttgggtacctctccgtaccctccgtatacgttacttacgtttcgggaccggaacggggactaagggtagaaactaacgaaacgtacgtggtacgcgtacgacaccgtnttacgtcgtttactccttacttcccctacccgtaccttcttccgtcgttacctttaccgttccttaccgttacggtcggtaacgggtcccgggtaccggcgggaacccggtaggcccgtacgaaacgttcagtcnnnnnnnnnnnnnnnnnnnnnnnnnnn

SEQ ID NO: 121963 - DNA, 697 bp, Homo sapiens
  misc_feature: GYAE6OF01B31P9.1.46.E02.1.454.CMB.1.raw
  modified_base (519)..(519): a, c, t, g, unknown or other
  misc_feature (519)..(519): n is a, c, g, or t
  modified_base (581)..(581): a, c, t, g, unknown or other
  misc_feature (581)..(581): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (642)..(642): a, c, t, g, unknown or other
  misc_feature (642)..(642): n is a, c, g, or t
  modified_base (648)..(648): a, c, t, g, unknown or other
  misc_feature (648)..(648): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
tcagacgagtgcgtcacgaccggtgctcgatttagactcatctacagggaaagggccaccctctcctgcagggccagtcagagtgttagcaacaactacttagcctggtaccagacagaacctggccaggcctcccgaggctccctacatctatggtgaccactccgagccgaacgggcccagtcggccactaccccgaagaccgtaggttcgacggtggcgtaggtggggtcgtagggactacgaccttcactctaccacactaccacagacgtaggacgtacctaggaattagttttcgagtagttagttaactttaccggtacgtactacggtcgtaaggttaaggttacggtacgtaccctaccctacccgtaccctagtaccggtttaccttaccgggtttcggaccggggaacgggttaaccgaaaggggttaacgtaaaccggtaaccgtaaaacggttaccgtacgggttacggacgttacacccgtaacgtacttcgttcgtaacctttntaacccgttcccttaccgcccttaacgttccgtacgttaccgttccgtacccttagtaccgnggtaccggtcggtaagaccggtacgaacggtcgtagaacgttgngtcgncgngtctacacncgtacncgtagatacgtcgtacgacgtcgtagcgagtgcacgtcacgancngngc

SEQ ID NO: 121964 - DNA, 418 bp, Homo sapiens
  misc_feature: GYAE6OF02HASIY.1.46.E02.1.454.CMB.1.raw
  modified_base (408)..(418): a, c, t, g, unknown or other
  misc_feature (408)..(418): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcacatctgtcttcatcttcccgccatcgactcgtctctactgagcgggctggcaaggcgcatagnnnnnnnnnnn

SEQ ID NO: 121965 - DNA, 416 bp, Homo sapiens
  misc_feature: GYAE6OF02IRSK9.1.46.E02.1.454.CMB.1.raw
  modified_base (410)..(416): a, c, t, g, unknown or other
  misc_feature (410)..(416): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccagggaccaaggtggaaatcaaacgaactgtggctgcaccatctgtcttcatcttcccgccatctgactcgtctctactgagcgggctgggcaaggcgcatagnnnnnnn

SEQ ID NO: 121966 - DNA, 416 bp, Homo sapiens
  misc_feature: GYAE6OF02IUJS4.1.46.E02.1.454.CMB.1.raw
  modified_base (408)..(416): a, c, t, g, unknown or other
  misc_feature (408)..(416): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcacatctgtcttcatcttcccgcatctgactcgtctctactgagcgggctggcaaggcgcatagnnnnnnnnn

SEQ ID NO: 121967 - DNA, 422 bp, Homo sapiens
  misc_feature: GYAE6OF02FSA0K.1.46.E02.1.454.CMB.1.raw
  modified_base (380)..(380): a, c, t, g, unknown or other
  misc_feature (380)..(380): n is a, c, g, or t
  modified_base (407)..(422): a, c, t, g, unknown or other
  misc_feature (407)..(422): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccaggacaggttcagtggcagtgggtctgggacagacttcactctcaccatcaccagactggagcctgaagattttgcagtgtattactgtcagcagtatggtagctcactcccatgtacactttggccaggggaccaaggtgaaatcgaaagaacgtgtggctgcaccgatctgtcttcatcttccgcatctgactcgtctntactgagcgggctggcaggcgcatagnnnnnnnnnnnnnnnn

SEQ ID NO: 121968 - DNA, 410 bp, Homo sapiens
  misc_feature: GYAE6OF02G31HX.1.46.E02.1.454.CMB.1.raw
  modified_base (399)..(399): a, c, t, g, unknown or other
  misc_feature (399)..(399): n is a, c, g, or t
  modified_base (404)..(410): a, c, t, g, unknown or other
  misc_feature (404)..(410): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatttaccgtgcatccaccagggccactggtgtcccagacaggttcagtggcggtggatttgggacagagttttctctcaccatcagcgccctacagagtgaagatgttgctagtttattctgccagcaatataattactggcctgcgtcgacgttcggccacgggaccaaggtgaaatcaaacgactgtggctgcacatctgtcttcattcttcccgcatctgactcgtctctactgacgcgggctggcaaggcnatagnnnnnnn

SEQ ID NO: 121969 - DNA, 412 bp, Homo sapiens
  misc_feature: GYAE6OF02HA271.1.46.E02.1.454.CMB.1.raw
  modified_base (402)..(412): a, c, t, g, unknown or other
  misc_feature (402)..(412): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggaagttcacctctgtcgttcggccaagggaccaaggtagaaatgaaacgaactgtggctgcaccatctgtcttcatcttccgcatctgactcgtctctactgagcgggctggcaaggcgcatagnnnnnnnnnnn

SEQ ID NO: 121970 - DNA, 412 bp, Homo sapiens
  misc_feature: GYAE6OF02FLI23.1.46.E02.1.454.CMB.1.raw
  modified_base (404)..(412): a, c, t, g, unknown or other
  misc_feature (404)..(412): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtgaaatcaaacgaactgtgctgcacatctgtcttcatctccgccatctgactcgtctctactgagcggctggcaaggcgcatagnnnnnnnnn

SEQ ID NO: 121971 - DNA, 457 bp, Homo sapiens
  misc_feature: GYAE6OF02HX3LO.1.46.E02.1.454.CMB.1.raw
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (427)..(457): a, c, t, g, unknown or other
  misc_feature (427)..(457): n is a, c, g, or t
tcagacgagtgcgtcacgaccggtgctcgatttagactcatctacagggaaagggcccaccctcctcctcgcagggccgagtcagaggtgtttagctaacaactacttagcctggtaccagcagaaacctggccaggctcccaggctcctcatctatggtgcatccagcagggccactggcatcccagacaggttcagtggcagtgggctgggccagacttccactctcaccatcaaccagtactgggagcctgtaagacttttagcagtgtattactggtcagcagtatggtaggctcgacctccgatggtactacgttttggccaggggacccaaggtggaaatcaaaacgactgtaggctgcacatctgtcttcatcctccgcatctgactcgtctctctgngcggctcggcaggcncagtcgnnnnnnnnnnnnnnnnnnnnnnnnnnnnnnn

SEQ ID NO: 121972 - DNA, 421 bp, Homo sapiens
  misc_feature: GYAE6OF02G2M3O.1.46.E02.1.454.CMB.1.raw
  modified_base (402)..(402): a, c, t, g, unknown or other
  misc_feature (402)..(402): n is a, c, g, or t
  modified_base (406)..(421): a, c, t, g, unknown or other
  misc_feature (406)..(421): n is a, c, g, or t
tcagacgagtgcgtcacgaccggtgctcgatttagactcatctacagggaaaggggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctccatgtacacttttggccaggggaccaaggtggaaatcaaacgaactgtggctgcacatctgtcttcatcttcccgcatctgactcgtctctactgacgcggctggcaaggcnatgnnnnnnnnnnnnnnnn

SEQ ID NO: 121973 - DNA, 412 bp, Homo sapiens
  misc_feature: GYAE6OF02FHHB6.1.46.E02.1.454.CMB.1.raw
  modified_base (404)..(412): a, c, t, g, unknown or other
  misc_feature (404)..(412): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtgaaatcaaacgaactgtggctgcacatctgtcttcatctccgcatctgactcgtctcactgagcgggctggcaaggcgcatagnnnnnnnnn

SEQ ID NO: 121974 - DNA, 404 bp, Homo sapiens
  misc_feature: GYAE6OF02G6XM7.1.46.E02.1.454.CMB.1.raw
  modified_base (391)..(391): a, c, t, g, unknown or other
  misc_feature (391)..(391): n is a, c, g, or t
  modified_base (396)..(404): a, c, t, g, unknown or other
  misc_feature (396)..(404): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaattcactctgtcgttcggccaagggaccaaggtagaaatgaaacgactgtggctgcacatctgtcttcatcttccgcatctgactcgtctctactgagcgggctggcaggcncatgnnnnnnnnn

SEQ ID NO: 121975 - DNA, 414 bp, Homo sapiens
  misc_feature: GYAE6OF02F3UYX.1.46.E02.1.454.CMB.1.raw
  modified_base (408)..(414): a, c, t, g, unknown or other
  misc_feature (408)..(414): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggttagctcacctcccatgtacacttttggccaggggaccaaggtggaaatcaaacgaactgtggctgcacatctgtcttcatcttcccgcatctgactcgtctctactgagcggctggcaaggcgcatagnnnnnnn

SEQ ID NO: 121976 - DNA, 410 bp, Homo sapiens
  misc_feature: GYAE6OF02I9557.1.46.E02.1.454.CMB.1.raw
  modified_base (401)..(410): a, c, t, g, unknown or other
  misc_feature (401)..(410): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtaggtcaccgtacacctttggccaggggaccaaggtggagatcagacgaactgtggctgcacatctgtcttcatcttccgcatctgactcgtctctactgagcgggctggcaaggcgcatagnnnnnnnnnn

SEQ ID NO: 121977 - DNA, 429 bp, Homo sapiens
  misc_feature: GYAE6OF02JQ6PP.1.46.E02.1.454.CMB.1.raw
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (407)..(409): a, c, t, g, unknown or other
  misc_feature (407)..(409): n is a, c, g, or t
  modified_base (411)..(429): a, c, t, g, unknown or other
  misc_feature (411)..(429): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagtattttgcagtgtattctgtcagcagtatggtagctcacctccatgtactacttttggccaggggaccaaggtagaaatcgaaacgaactgtgctgcacatctgtctcatccttccgctatctnactcgtctctcngtcgcggctggcacggcncatagnnncnnnnnnnnnnnnnnnnnnn

SEQ ID NO: 121978 - DNA, 423 bp, Homo sapiens
  misc_feature: GYAE6OF02FSFYN.1.46.E02.1.454.CMB.1.raw
  modified_base (402)..(402): a, c, t, g, unknown or other
  misc_feature (402)..(402): n is a, c, g, or t
  modified_base (407)..(423): a, c, t, g, unknown or other
  misc_feature (407)..(423): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaaatcaaacgaactgtggctgcaccatctgtcttcatcttccgctatctgactcgtctctatgagcggctggcaaggcncatgnnnnnnnnnnnnnnnnn

SEQ ID NO: 121979 - DNA, 410 bp, Homo sapiens
  misc_feature: GYAE6OF02IH1M7.1.46.E02.1.454.CMB.1.raw
  modified_base (342)..(342): a, c, t, g, unknown or other
  misc_feature (342)..(342): n is a, c, g, or t
  modified_base (400)..(410): a, c, t, g, unknown or other
  misc_feature (400)..(410): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttgccagggaccaaggtgaaatcaaacgactgtgctgcacntctgtcttcatcttcccgcatctgactcgtctctatgagcggctggcaggcgcatagnnnnnnnnnnn

SEQ ID NO: 121980 - DNA, 425 bp, Homo sapiens
  misc_feature: GYAE6OF02GJ0BU.1.46.E02.1.454.CMB.1.raw
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (415)..(425): a, c, t, g, unknown or other
  misc_feature (415)..(425): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagttggcagtgggtctgggacagacttcactctcaccatcaccagactggagcctgaagattttgcagtgtattactgtcagcagtatggtagctcacctcccatgtacacttttggccaggggaccaaggtggaaaatcaaacgaactgtaggctgcacatctgtcttcatcctccgctatctgactcgtctctactgagcggctggcaaggcncatagngnngnnnnnnnnnnn

SEQ ID NO: 121981 - DNA, 407 bp, Homo sapiens
  misc_feature: GYAE6OF02JKZM1.1.46.E02.1.454.CMB.1.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
  modified_base (400)..(407): a, c, t, g, unknown or other
  misc_feature (400)..(407): n is a, c, g, or t
tcagacgagtgcgtcacgaccggtgctcgatttagactcatctacagggaaagggaccgaccctcctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcgactctcaccatcaccagactggancctgaagattcgcagtgtattactgtcagcagtatggaagttcacctntgtcgttcggcaagggccaaggtgaaatgaaacgaactgtagctgcaccatcngtcttnatcttccgctatctgactcgtctctactgacgnggctgcaaggcnatgnnnnnnnn

SEQ ID NO: 121982 - DNA, 421 bp, Homo sapiens
  misc_feature: GYAE6OF02GBUST.1.46.E02.1.454.CMB.1.raw
  modified_base (240)..(240): a, c, t, g, unknown or other
  misc_feature (240)..(240): n is a, c, g, or t
  modified_base (409)..(421): a, c, t, g, unknown or other
  misc_feature (409)..(421): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggtagctcacctcccatgtacacttttggccaggggaccaaggtggaaatcaaacgaactgtggctgcacatctgtcttcatcttccgcctatctgactcgtctctactgagcggctggcaaggcgcatacgnnnnnnnnnnnnn

SEQ ID NO: 121983 - DNA, 409 bp, Homo sapiens
  misc_feature: GYAE6OF02IZ4BK.1.46.E02.1.454.CMB.1.raw
  modified_base (342)..(342): a, c, t, g, unknown or other
  misc_feature (342)..(342): n is a, c, g, or t
  modified_base (402)..(409): a, c, t, g, unknown or other
  misc_feature (402)..(409): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgctagtgtattactgtcagcagtatggtagctcacctcccatgtactctttggccagggaccaaggtggaatcaaagactgtgctgcacntctgtctcatccttccgctatctgactcgtctctctgacgcggctggcacggcgcatgcnnnnnnnn

SEQ ID NO: 121984 - DNA, 411 bp, Homo sapiens
  misc_feature: GYAE6OF02GRGE2.1.46.E02.1.454.CMB.1.raw
  modified_base (240)..(240): a, c, t, g, unknown or other
  misc_feature (240)..(240): n is a, c, g, or t
  modified_base (405)..(411): a, c, t, g, unknown or other
  misc_feature (405)..(411): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggtagctcactcccatgtacacttttggccaggggaccaaggtggaaatcaaacgaactgtggctgcacatctgtcttcatcttccgcatctgactcgtctctactgagcggctggcaaggcgcatagnnnnnnn

SEQ ID NO: 121985 - DNA, 409 bp, Homo sapiens
  misc_feature: GYAE6OF02F5VLZ.1.46.E02.1.454.CMB.1.raw
  modified_base (298)..(298): a, c, t, g, unknown or other
  misc_feature (298)..(298): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (400)..(409): a, c, t, g, unknown or other
  misc_feature (400)..(409): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggacgcctgaagattttgcagtgtattactgtcagcagtatggtagctcacctccatgtacnctttggccaggggaccaaggtggaaatcaaacgaactgtgctgcacatctgtcttcactctccgcntcngactcgtctctctgngcggctggcaggcnatgnnnnnnnnnn

SEQ ID NO: 121986 - DNA, 409 bp, Homo sapiens
  misc_feature: GYAE6OF02FJELY.1.46.E02.1.454.CMB.1.raw
  modified_base (399)..(399): a, c, t, g, unknown or other
  misc_feature (399)..(399): n is a, c, g, or t
  modified_base (404)..(409): a, c, t, g, unknown or other
  misc_feature (404)..(409): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtgaaatcaaacgactgtggctgcacatctgtcttcatcctcccgctatctgactcgtctctactgagcggctggcaggcncatgnnnnnn

SEQ ID NO: 121987 - DNA, 442 bp, Homo sapiens
  misc_feature: GYAE6OF02HX7MT.1.46.E02.1.454.CMB.1.raw
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (420)..(442): a, c, t, g, unknown or other
  misc_feature (420)..(442): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcacatcaccagactggagcctgaagattttgcagtgtattactgttcagcagtatggtagctcacctcccatgtacacttttggccaggggaccaaaggtgggaaaatcgaaacgaacgtgtaggctgcacatctgtctcatctttcccgcatctnactcgtctctactgagcgggctggcaaggcgcatacantnagnnnnnnnnnnnnnnnnnnnnnnn

SEQ ID NO: 121988 - DNA, 412 bp, Homo sapiens
  misc_feature: GYAE6OF02JFB8X.1.46.E02.1.454.CMB.1.raw
  modified_base (396)..(412): a, c, t, g, unknown or other
  misc_feature (396)..(412): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatgctgggtcccacagggccactggcatcccagacaggttcagtggcagtgggtctgggacagacttcactctcatcattagcagactggacgcctgaagatttcgcagtgtattactgtcagcagtatggaagttcactctgtcgttcgcaaggaccaaggtagaaatgaaacgactgtgctgcacatctgtctcatccttcccgcatctgactcgtctctactgagcggtctggcaggcacatagnnnnnnnnnnnnnnnnn

SEQ ID NO: 121989 - DNA, 417 bp, Homo sapiens
  misc_feature: GYAE6OF02GE8SA.1.46.E02.1.454.CMB.1.raw
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (407)..(417): a, c, t, g, unknown or other
  misc_feature (407)..(417): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgactgtggctgcacatctgtcttcatcttccgcctatctgactcgtctctactnagcggctggcaaggcncatagnnnnnnnnnnn

SEQ ID NO: 121990 - DNA, 437 bp, Homo sapiens
  misc_feature: GYAE6OF02I5OAJ.1.46.E02.1.454.CMB.1.raw
  modified_base (375)..(375): a, c, t, g, unknown or other
  misc_feature (375)..(375): n is a, c, g, or t
  modified_base (418)..(437): a, c, t, g, unknown or other
  misc_feature (418)..(437): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatcgtacacttttgccaggggaccaaggtaggaaatacaaacgaacgtgtagctgcaccatctgtcttcatctcccgctatctnactcgtctctactgacgcggactggcgtaacggcgacatacgnnnnnnnnnnnnnnnnnnnn

SEQ ID NO: 121991 - DNA, 414 bp, Homo sapiens
  misc_feature: GYAE6OF02HPQ6N.1.46.E02.1.454.CMB.1.raw
  modified_base (240)..(240): a, c, t, g, unknown or other
  misc_feature (240)..(240): n is a, c, g, or t
  modified_base (377)..(377): a, c, t, g, unknown or other
  misc_feature (377)..(377): n is a, c, g, or t
  modified_base (402)..(414): a, c, t, g, unknown or other
  misc_feature (402)..(414): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggaagttcacctctgtcgttcggccaagggaccaaggtagaaatgaaacgactgtggctgcacatctgtcttcattctccgccatctgactcgtctctacngagcgggctggcaaggcgcatacgnnnnnnnnnnnnn

SEQ ID NO: 121992 - DNA, 446 bp, Homo sapiens
  misc_feature: GYAE6OF02HHNOY.1.46.E02.1.454.CMB.1.raw
  modified_base (241)..(241): a, c, t, g, unknown or other
  misc_feature (241)..(241): n is a, c, g, or t
  modified_base (418)..(446): a, c, t, g, unknown or other
  misc_feature (418)..(446): n is a, c, g, or t
tcagacgagtgcgtcacgaccggtgctcgatttagactcatctacagggaaagggccaccctctcctgcagggccagtcagagtgttagcaaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagtattttgcagtgtattactgtcagcagtatgtagctcactcccatgtacacttttgctaggggaccaaggtggaaatcaaacgaactgtaggctggcacgatctgtacttcatcttcccgcatctgaactcgtctctactgacgcggctaggtcgaaggctacatagctnnnnnnnnnnnnnnnnnnnnnnnnnnnnn

SEQ ID NO: 121993 - DNA, 416 bp, Homo sapiens
  misc_feature: GYAE6OF02GUK8F.1.46.E02.1.454.CMB.1.raw
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (407)..(416): a, c, t, g, unknown or other
  misc_feature (407)..(416): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtactacttttggccaggggaccaaggtggaaatcaaacgactgtgctgcacatctgtcttcatcctccgccatctgactcgtctctactgngcggctggcaggcncgatacgnnnnnnnnnn

SEQ ID NO: 121994 - DNA, 434 bp, Homo sapiens
  misc_feature: GYAE6OF02J12NQ.1.46.E02.1.454.CMB.1.raw
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (410)..(434): a, c, t, g, unknown or other
  misc_feature (410)..(434): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctccatgtacacttttggcctagggacctaaggtacggaaatcgaaacgaactgtggctgcacatctgtctcatcttccnctatctgactcgtctcactgagcggctggcaacggngcatacgnnnnnnnnnnnnnnnnnnnnnnnnn

SEQ ID NO: 121995 - DNA, 413 bp, Homo sapiens
  misc_feature: GYAE6OF02HZOW6.1.46.E02.1.454.CMB.1.raw
  modified_base (407)..(413): a, c, t, g, unknown or other
  misc_feature (407)..(413): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatgtacacttttggccaggggaccaaggtggaaatcaaacgaactgtggctgcacatctgtcttcatcttcccgcatctgactcgtctctactgagcgggctggcaaggcgcatagnnnnnnn

SEQ ID NO: 121996 - DNA, 424 bp, Homo sapiens
  misc_feature: GYAE6OF02G1BGK.1.46.E02.1.454.CMB.1.raw
  modified_base (369)..(369): a, c, t, g, unknown or other
  misc_feature (369)..(369): n is a, c, g, or t
  modified_base (412)..(424): a, c, t, g, unknown or other
  misc_feature (412)..(424): n is a, c, g, or t
tcagacgagtgcgtcacgaccggtgctcgatttagactcatctacagggaaagggacaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggacgcctgaagattttgctagtgtattactgtcagcagtatggtagctcacctccatgtactacttttggccgagggaccaaggtaggaaatacaaacgactgtggctgcacatctgtcttcatcttccgtnactctgtactcgtctctctgacgcggtctggacaggcgcatgnnnnnnnnnnnnn

SEQ ID NO: 121997 - DNA, 430 bp, Homo sapiens
  misc_feature: GYAE6OF02IPORM.1.46.E02.1.454.CMB.1.raw
  modified_base (415)..(430): a, c, t, g, unknown or other
  misc_feature (415)..(430): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcaccctcccatcgtacacttttggccaggggaccaaggtggagatcagacaactgtagctgcaccatctgtctcatcttcccgctatctcgactcgtctcctactgacgcgggctggccaaggcgcataggnnnnnnnnnnnnnnnn

SEQ ID NO: 121998 - DNA, 657 bp, Homo sapiens
  misc_feature: GYAE6OF02IKBHZ.1.46.E02.1.454.CMB.1.raw
tcagacgagtgcgtcacgaccggtgctcgatttagactcatctacagggaaagggccacccgtctacctgccagggccagtcacgagtgttagcaacaactacttagcctggtaccagcagaacctggccaggcttccaggctcctcatctatggtgcatccagcaggccactggcatcccagacaggttcaggtggcaggtcggtctgggacagtaccttcgactctacgacctatccgaccagtacttggaacgcctagaagtattttgacgtaggttgtattacgtgtcagacagtatggtagctacaccgtccatcgtactcgttttcggaccgaggggaccaaggtacggaaactacgaaaacgtacgtgtacggctacgacgtaccgtagttcgtacggttacctttaccgtaacgttccgtttaccccgacctacgttccgtacgaccttaccggtaccttaccgttaacgtacggtaacggttccggggtaccgttcgggtaaccgtaaacgggtacccgtacgtaacgttacggacgtagacgtacggtcagacgtacgaccggtctagtacgttaacgttatccggtagtacggccgaggttacacgttaccgtagtacgttacgtgtaccggtagtacgtagtacg

SEQ ID NO: 121999 - DNA, 430 bp, Homo sapiens
  misc_feature: GYAE6OF02JF7XQ.1.46.E02.1.454.CMB.1.raw
  modified_base (239)..(239): a, c, t, g, unknown or other
  misc_feature (239)..(239): n is a, c, g, or t
  modified_base (361)..(361): a, c, t, g, unknown or other
  misc_feature (361)..(361): n is a, c, g, or t
  modified_base (412)..(430): a, c, t, g, unknown or other
  misc_feature (412)..(430): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggctgggacagacttcactctcaccatcaccagactggancctgaagattttgcagtgtattactgtcagcagtatggtagctcacctccatgtacacttttggccaggggtaccaaggtcggaaattcgaaacgaactgtagactgacacatctgtcttcntacttccgcatcctgactcgtctctactgagcggctgctagcgcatagctnnnnnnnnnnnnnnnnnnn

SEQ ID NO: 122000 - DNA, 480 bp, Homo sapiens
  misc_feature: GYAE6OF02FJRY5.1.46.E02.1.454.CMB.1.raw
  modified_base (244)..(244): a, c, t, g, unknown or other
  misc_feature (244)..(244): n is a, c, g, or t
  modified_base (407)..(407): a, c, t, g, unknown or other
  misc_feature (407)..(407): n is a, c, g, or t
  modified_base (452)..(452): a, c, t, g, unknown or other
  misc_feature (452)..(452): n is a, c, g, or t
  modified_base (454)..(458): a, c, t, g, unknown or other
  misc_feature (454)..(458): n is a, c, g, or t
  modified_base (460)..(480): a, c, t, g, unknown or other
  misc_feature (460)..(480): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggcctcccaggctcctcatctatggtgcatccagcagggccactggcatcccagacaggttcagtggcaggtgggtctgggacagtacttcactctcaccatcaccagactggacncctgaagtattttgactagtgttattactgtcagcagtagtggtagctcacctcccatgtactacttttggaccgacggggaccgaagggtaggaaacttacgaaaacgtaactggtaggctgaccacctatctgtcttactacttccttcccgcctatcctntacctccgtctcgtactggacgcgggcgtggacaggcacagtcgncnnnnncnnnnnnnnnnnnnnnnnnnnn

SEQ ID NO: 122001 - DNA, 467 bp, Homo sapiens
  misc_feature: GYAE6OF02HECLB.1.46.E02.1.454.CMB.1.raw
  modified_base (241)..(241): a, c, t, g, unknown or other
  misc_feature (241)..(241): n is a, c, g, or t
  modified_base (429)..(429): a, c, t, g, unknown or other
  misc_feature (429)..(429): n is a, c, g, or t
  modified_base (442)..(443): a, c, t, g, unknown or other
  misc_feature (442)..(443): n is a, c, g, or t
  modified_base (445)..(451): a, c, t, g, unknown or other
  misc_feature (445)..(451): n is a, c, g, or t
  modified_base (453)..(467): a, c, t, g, unknown or other
  misc_feature (453)..(467): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatccaccagactggancctgaagattttgcaatgtattactgtcagcaatatcgctccaccccccgatccaccttcggccaagggacacgactgcagatgaaacgactgtggctgcacatctgtctctatccttcccgcactctcgacttcgtctctactcgacggcgggtctcgggaccgtaagggccgacgtaagttacggntcgagctacagcnngnnnnnnngnnnnnnnnnnnnnnn

SEQ ID NO: 122002 - DNA, 425 bp, Homo sapiens
  misc_feature: GYAE6OF02F5TE1.1.46.E02.1.454.CMB.1.raw
  modified_base (285)..(285): a, c, t, g, unknown or other
  misc_feature (285)..(285): n is a, c, g, or t
  modified_base (376)..(376): a, c, t, g, unknown or other
  misc_feature (376)..(376): n is a, c, g, or t
  modified_base (412)..(414): a, c, t, g, unknown or other
  misc_feature (412)..(414): n is a, c, g, or t
  modified_base (416)..(425): a, c, t, g, unknown or other
  misc_feature (416)..(425): n is a, c, g, or t
tcagacgagtgcgtcacgaccggtgctcgatttagactcatctacagggaaagggccaccctctcctgcagggccagtcagagtgttagcaacaactacttagcctggtaccagcagaacctggccaggctcccaggctcctcatctatggtgcatccagcagggccactggcatcccagacaggttcagtggcagtgggtctgggacagacttcactctcaccatcaccagacctggagcctgaagacttttgcagtgtattactgtcagcagtatggtagctnaccctcccatcgtacacttttggcccaggggaccaaggtggaaatcaaacgaactgtggctgcaccatctgtcttcatcttcccgcatctnactcgtctctactgacgcggctggcaggcgcatagnnntnnnnnnnnnn

SEQ ID NO: 122003 - DNA, 469 bp, Homo sapiens
  misc_feature: GYAE6OF02G9RP1.1.46.E02.1.454.CMB.1.raw
  modified_base (447)..(469): a, c, t, g, unknown or other
  misc_feature (447)..(469): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggacgcctgaagtattttgcagtgtattactgtcagcagtatggtagctcacctcccatgtactcttttggccgagggaccaaggtaggaaatacgaaacgactgtggctgcacattctgttcttactacttccgttcccgcctatcctgtaccttcgttctaccttacgtcgacgggtcgggcgtacgggacgaacggtccgactagtgnnnnnnnnnnnnnnnnnnnnnnn

SEQ ID NO: 122004 - DNA, 713 bp, Homo sapiens
  misc_feature: GYAE6OF02GBNEP.1.46.E02.1.454.CMB.1.raw
  modified_base (297)..(297): a, c, t, g, unknown or other
  misc_feature (297)..(297): n is a, c, g, or t
tcagacgagtgcgtcacgaccggtgctcgatttagactcatctacagggaaagggccaccctctcctgcagggccagtcagtagtgtttagcaacaactacttagcctggtaccagcagaaacctggccaggctccaggctcctcagttctatggtgctatccagcagggccactggcatcccagacaggttcaggtggcagtggtctgggacagtacttcactctccaccatcaccagaccgtggacgccgtgaacgattttagctagtgtattactgtcagtcagtactaggtcncgtaccaaccgttccctagtcgtacgtacgttttcggccgttaaggggacctaagggtacggtaaacgtacgaaaacggtaacgttggttacggacgttaggactaacccgtatttaccggtacgttaccgttttactaacggtttccctttaccccgtaccctactttacctaccggttaaccttcccgggtttacttaccgttaaccgtacgggtaaacggggtcccggggtaccgttacggggtacctaaaccgggggttaccgtacccgtaaagttaaccgggactaccgtaagtcgagtaccggtaagtacgttactacgtacgtacgtacgtacggaggtacggtacggtacggtacggtacgtacgtacgtacgtcgtacgtacgtacggtacggtacggtaccggtcg

SEQ ID NO: 122005 - DNA, 495 bp, Homo sapiens
  misc_feature: GYAE6OF02HV0R1.1.46.E02.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (468)..(495): a, c, t, g, unknown or other
  misc_feature (468)..(495): n is a, c, g, or t
tcagacgagtgcgtcacgaccggtgctcgatttagactcatctacagggaaagggccaccctcctcctgcagggccagtcagagtgttagcaacaactacttagcctggtaccagcagaaactggccaggctcccaggctcctcatctatggtgcatccagcagggccactggcatcccagacaggttcagtggcagtgggtctggggacagacttcactcncaccaatcaccgagactgggagcctgaagattttgntagttgtattactgtcagtcagtagnggtagcttccacctccatcgtactacttttggccgagggaccaaggtagaaatcaaaacgtacgtgaggntcgacacaagtctgtcttctactccgttacccgctactaccttgaaccgttcgtcctactttacacgggtaacgttccgggcttaggaccgaaacgggttcacctagtaacggnnnnnnnnnnnnnnnnnnnnnnnnnnnn

SEQ ID NO: 122006 - DNA, 441 bp, Homo sapiens
  misc_feature: GYAE6OF02I4AA0.1.46.E02.1.454.CMB.1.raw
  modified_base (240)..(240): a, c, t, g, unknown or other
  misc_feature (240)..(240): n is a, c, g, or t
  modified_base (412)..(412): a, c, t, g, unknown or other
  misc_feature (412)..(412): n is a, c, g, or t
  modified_base (414)..(415): a, c, t, g, unknown or other
  misc_feature (414)..(415): n is a, c, g, or t
  modified_base (419)..(441): a, c, t, g, unknown or other
  misc_feature (419)..(441): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggtagctcacctcccatgtacacttttggccaggggaccaaggtggaaatcaaacgaactgtggctgcaccatctgtcttcatcctcccgcatctgactcgtctctactgacgcgggctggcaaggcgcagtagangnntcgnnnnnnnnnnnnnnnnnnnnnnn

SEQ ID NO: 122007 - DNA, 430 bp, Homo sapiens
  misc_feature: GYAE6OF02FU1QB.1.46.E02.1.454.CMB.1.raw
  modified_base (288)..(288): a, c, t, g, unknown or other
  misc_feature (288)..(288): n is a, c, g, or t
  modified_base (414)..(430): a, c, t, g, unknown or other
  misc_feature (414)..(430): n is a, c, g, or t
tcagacgagtgcgtcacgaccggtgctcgatttagactcatctacagggaaagggccaccctctcctgcagggccagtcagagtgttagcaacaactacttagcctggtaccagcagaacctggccaggctcccaggctcctcatctatggtgcatccagcagggccactggcatcccagacaggttcagtggcagtgggtctgggacagacttcactctcaccatcaccagactggagcctgaagatttcgcagtgtattactgtcagcagtatggaagttcacctntgtcgttcggccaagggaccaaggtagaaatgaaacgatgtgctgcaccatctgtcttcatccttcccgctatctgtaccttcgtctctactgacggcgggtctcgggactaacggcgtacatcgnnnnnnnnnnnnnnnnn

SEQ ID NO: 122008 - DNA, 511 bp, Homo sapiens
  misc_feature: GYAE6OF02F6ONX.1.46.E02.1.454.CMB.1.raw
  modified_base (487)..(487): a, c, t, g, unknown or other
  misc_feature (487)..(487): n is a, c, g, or t
  modified_base (489)..(511): a, c, t, g, unknown or other
  misc_feature (489)..(511): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagtattttgcagtgtattactgtcagcagtatggtagctcacctcccatcgtactacgttttcggaccgtagggggacctaagggtacggaaaataccgaaaacggtaactggtagggcctaggccaacctatcttcgttcttctaacgttcccttacccgcctactccgttcgtaccttccgttcttaccttacgtggacggtccgggtctcgggtacgacgggtccgtacgtagtacggncnnnnnnnnnnnnnnnnnnnnnnn

SEQ ID NO: 122009 - DNA, 499 bp, Homo sapiens
  misc_feature: GYAE6OF02IUEGA.1.46.E02.1.454.CMB.1.raw
  modified_base (396)..(396): a, c, t, g, unknown or other
  misc_feature (396)..(396): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (473)..(475): a, c, t, g, unknown or other
  misc_feature (473)..(475): n is a, c, g, or t
  modified_base (477)..(499): a, c, t, g, unknown or other
  misc_feature (477)..(499): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcagggccactggcatcccagacaggttcagtggcaggtgggtctgggacagacttcactctcaccatcacccagactgggacgcctgaagattttgactagtgtattactgtcagtcagtatcggtagcgtcaccgtcctatcgtactcgttttcggaccgaggggacctaagggtagaaactcgaaacgtagtgtaggactgcaactagtcgtcgtcttcgacttccgtttcccncctatcctagtacttcgtcttcctacgtcggacggtccgggtcgtacggcgaacgggcctacaacgtcngngcagtnnngnnnnnnnnnnnnnnnnnnnnnnn

SEQ ID NO: 122010 - DNA, 416 bp, Homo sapiens
  misc_feature: GYAE6OF02FL5VC.1.46.E02.1.454.CMB.1.raw
  modified_base (240)..(240): a, c, t, g, unknown or other
  misc_feature (240)..(240): n is a, c, g, or t
  modified_base (401)..(401): a, c, t, g, unknown or other
  misc_feature (401)..(401): n is a, c, g, or t
  modified_base (407)..(416): a, c, t, g, unknown or other
  misc_feature (407)..(416): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggancctgaagattttgcagtgtattactgtcagcagtatggtagctcacctcccatgtacacttttggccaggggaccaaggtggaaatcaaacgaactgtggctgcacatctgtctcactcttcccgcatctgactcgtctctactgaggcggctggcaggcncgatgnnnnnnnnnn

SEQ ID NO: 122011 - DNA, 638 bp, Homo sapiens
  misc_feature: GYAE6OF02IJADQ.1.46.E02.1.454.CMB.1.raw
  modified_base (242)..(242): a, c, t, g, unknown or other
  misc_feature (242)..(242): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcaggtgggtctgggacagacttcactctcaccatcaccagactggacncctagaagtatttgcagtgtatactgtcagcagtatggtagctcacctcccgtaatcgtactacgtttttcggaccgtacggggtacccgtaaagggttagggaaaactttaaccgaaaaccggtaaacgttacgggtttacgggcgttacggacctaacccgtaacttccgtttacggttacctttaccgtaaccttcccgtttccccgtaccgtaacgttccgtacgtaaccttccggttccttaccgttacgttacggtaacggtccggggttaccgttacgggaaccggttaacgggaccgtacccgtaacggttaaaggtcgtaaccggtacgtacgtacgtacgtacgtacgtacgtacgtacgtacgtacgtaccgttacgtacgtacg

SEQ ID NO: 122012 - DNA, 452 bp, Homo sapiens
  misc_feature: GYAE6OF02FTMI6.1.46.E02.1.454.CMB.1.raw
  modified_base (278)..(278): a, c, t, g, unknown or other
  misc_feature (278)..(278): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(452): a, c, t, g, unknown or other
  misc_feature (423)..(452): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcatcattagcagactggagcctgaagatttcgcagttgtattactgtcagcagttanggattcaccttctgtcgttcggccaagggacctaaggtagaaatgaaacgactgtggctgcaccattctagtcttcacttcctccgcctatctcgtactcgtctctactgcggcggtctggacgaacggtcgcacgttagntncnnnnnnnnnnnnnnnnnnnnnnnnnnnnnn

SEQ ID NO: 122013 - DNA, 502 bp, Homo sapiens
  misc_feature: GYAE6OF02IOMFD.1.46.E02.1.454.CMB.1.raw
  modified_base (403)..(403): a, c, t, g, unknown or other
  misc_feature (403)..(403): n is a, c, g, or t
  modified_base (476)..(502): a, c, t, g, unknown or other
  misc_feature (476)..(502): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcactcccagacaggttcagtggcaggtgggtctgggactagtagtttttctctcaccatcagccgaccctacagagtagaagtatgttgcgtaagttttatttctcgcctagtacaaattaattaattacgtggtacctggccgtcggtaacggttccggaccgaacgggaaccaaagggtagaaactacgaaaacgtactggtaggctagaccactattctgttcttanactccttcccgctatctcgacttctcctactacgtgacggtcgggactacgggacaacgggcacgtaatggannnnnnnnnnnnnnnnnnnnnnnnnnn

SEQ ID NO: 122014 - DNA, 451 bp, Homo sapiens
  misc_feature: GYAE6OF02HAWPR.1.46.E02.1.454.CMB.1.raw
  modified_base (363)..(363): a, c, t, g, unknown or other
  misc_feature (363)..(363): n is a, c, g, or t
  modified_base (413)..(413): a, c, t, g, unknown or other
  misc_feature (413)..(413): n is a, c, g, or t
  modified_base (435)..(451): a, c, t, g, unknown or other
  misc_feature (435)..(451): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccaccggcatcccagacaggttcagtggcagtgggtctgggacagacttcactctcaccatcaccagactggagcctgaagattttgcagttgtatttactgtcagcagtatggtagctcacctccccatgtactacgttttggccgaggggaccaagggtaggaaatacgaaacgtaactgtggctgccacatctnttcttctatccttcccgctatctgtacctcgtcttctactgagcgggtcncggacgaggcgacctagtacgnnnnnnnnnnnnnnnnn

SEQ ID NO: 122015 - DNA, 539 bp, Homo sapiens
  misc_feature: GYAE6OF02IZ0QP.1.46.E02.1.454.CMB.1.raw
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
  modified_base (522)..(525): a, c, t, g, unknown or other
  misc_feature (522)..(525): n is a, c, g, or t
  modified_base (527)..(529): a, c, t, g, unknown or other
  misc_feature (527)..(529): n is a, c, g, or t
  modified_base (531)..(532): a, c, t, g, unknown or other
  misc_feature (531)..(532): n is a, c, g, or t
  modified_base (534)..(539): a, c, t, g, unknown or other
  misc_feature (534)..(539): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcaggtgggtctgggacagacttcactctcaccatcaccagactggagcctgaagattttgctaggtgtattactgtcagctatatggtagctcgacctcctatcgtactcgttttcggacccgtagggacctaaggtacggtaaatccgaaaacgtactggtacgggcttacggcaccgtattccgtcgttacttacacttcccgtttcccgacctacgttacctgtaccttcgtacttccgtaacgtggacgtaccggggccttacgggcgtaacgggtccgtacgtaacgttaggnttcgngactcgatgcgcancgcagcctngnnnngnnngnngnnnnnn

SEQ ID NO: 122016 - DNA, 459 bp, Homo sapiens
  misc_feature: GYAE6OF02I9T7B.1.46.E02.1.454.CMB.1.raw
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (432)..(440): a, c, t, g, unknown or other
  misc_feature (432)..(440): n is a, c, g, or t
  modified_base (442)..(444): a, c, t, g, unknown or other
  misc_feature (442)..(444): n is a, c, g, or t
  modified_base (446)..(459): a, c, t, g, unknown or other
  misc_feature (446)..(459): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggaattcacctntggtccgttcggccaagggaccaaggtagaaatgaaacgatgnggtcngcaaccntctntcttcattccttcccgctagtctcgtactcgtctctacgtgagcgggctcggacaacgggcactaagtacggncgatnangactnnnnnnnnncnnngnnnnnnnnnnnnnn

SEQ ID NO: 122017 - DNA, 675 bp, Homo sapiens
  misc_feature: GYAE6OF02F0JF8.1.46.E02.1.454.CMB.1.raw
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (633)..(634): a, c, t, g, unknown or other
  misc_feature (633)..(634): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (668)..(670): a, c, t, g, unknown or other
  misc_feature (668)..(670): n is a, c, g, or t
  modified_base (672)..(674): a, c, t, g, unknown or other
  misc_feature (672)..(674): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatccaccagacgtaggacgtcctagaagttattttgacctaggttgttaacttacgtgtacagtacgtaggttagttagggtaacgttccctaccttcgttacggtttccgggttaccgggtaaccggtaaacggggaacccggtaaagggttaaaggtaaaacgttaacggtaaaacggtaaccgttaggggtacgggtaccgttcggaacctaaccgtaacgtttccgttacggttacctttacctaaccgtttccccgtttccccggaccttacgtttaccgttaccgtaccgttccgttaccgtaccgtttttttaaccgacggtaccgggtccgggtaccggtaccgggtacggtaacggtaccggttacgtaacgtacgtacgtatagcgngtnctcgngcnncgacncngcgtntcncncgcatcgcncgntnacnnncnnng

SEQ ID NO: 122018 - DNA, 414 bp, Homo sapiens
  misc_feature: GYAE6OF02GL6N0.1.46.E02.1.454.CMB.1.raw
  modified_base (372)..(372): a, c, t, g, unknown or other
  misc_feature (372)..(372): n is a, c, g, or t
  modified_base (407)..(414): a, c, t, g, unknown or other
  misc_feature (407)..(414): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatggtagctcacctcccatcgtacacttttggccaggggaccaaggtggaaatcaaacgactgtggctggcacatctgtcttcatcttcccgcatctnactcgtctctactgagcggctggcaaggcgcatgnnnnnnnn

SEQ ID NO: 122019 - DNA, 571 bp, Homo sapiens
  misc_feature: GYAE6OF02GFPZX.1.46.E02.1.454.CMB.1.raw
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (557)..(558): a, c, t, g, unknown or other
  misc_feature (557)..(558): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
  modified_base (566)..(566): a, c, t, g, unknown or other
  misc_feature (566)..(566): n is a, c, g, or t
  modified_base (569)..(571): a, c, t, g, unknown or other
  misc_feature (569)..(571): n is a, c, g, or t
tcagacgagtgcgtcacgaccggtgctcgatttagactcatctacaggggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatccaaccagactggacgcctagaagattttggcaggttgtattactgtcagtcagtatggtacgctcaccctccagtcgtactactttcggaccgtaggggaccaagggtaggtaaactacgaaaacggtaacgtggtacggactacggacctactacgtctacgttccttacgtacttccctcccgtacctattcctacgtacttccggttaccttccgttaacgttcggaacgggtccgggtaccgttagggacccgtaacgggccgtacctaagtacgganctcggtacngacctgatacgcgtacncgacgncncncgnanacgtnngcncnncnctnnn

SEQ ID NO: 122020 - DNA, 412 bp, Homo sapiens
  misc_feature: GYAE6OF02FG14L.1.46.E02.1.454.CMB.1.raw
  modified_base (392)..(392): a, c, t, g, unknown or other
  misc_feature (392)..(392): n is a, c, g, or t
  modified_base (397)..(412): a, c, t, g, unknown or other
  misc_feature (397)..(412): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcaatgtattactgtcagcatatgctcacccccgatcaccttcgccaagggacacgactgcagatgaaacactgtgctgcacatctgtcttcactctcccgccatctgactcgtctctactgagcgggctggcaaggcgnatagnnnnnnnnnnnnnnnn

SEQ ID NO: 122021 - DNA, 491 bp, Homo sapiens
  misc_feature: GYAE6OF02GI0FQ.1.46.E02.1.454.CMB.1.raw
  modified_base (462)..(462): a, c, t, g, unknown or other
  misc_feature (462)..(462): n is a, c, g, or t
  modified_base (464)..(465): a, c, t, g, unknown or other
  misc_feature (464)..(465): n is a, c, g, or t
  modified_base (467)..(491): a, c, t, g, unknown or other
  misc_feature (467)..(491): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatccaccagactggagcctagaagtattttgacagtgtattacgtgtcagcagttatggtagctcacctccatgtactcgttttggaccagggggacctaagggtacggtaaactcgaaaaccgtaacttggcggtcgtcgcaactactcttgttcttctacttcctttcccgctacttcctcaccttcgtcctcgtactggacggccgggacgtcggaccgtacgggcgctagtgntnncnnnnnnnnnnnnnnnnnnnnnnnnn

SEQ ID NO: 122022 - DNA, 605 bp, Homo sapiens
  misc_feature: GYAE6OF02HQ7MO.1.46.E02.1.454.CMB.1.raw
  modified_base (185)..(185): a, c, t, g, unknown or other
  misc_feature (185)..(185): n is a, c, g, or t
  modified_base (231)..(231): a, c, t, g, unknown or other
  misc_feature (231)..(231): n is a, c, g, or t
  modified_base (552)..(552): a, c, t, g, unknown or other
  misc_feature (552)..(552): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (577)..(578): a, c, t, g, unknown or other
  misc_feature (577)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(597): a, c, t, g, unknown or other
  misc_feature (586)..(597): n is a, c, g, or t
  modified_base (599)..(605): a, c, t, g, unknown or other
  misc_feature (599)..(605): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcactcccagacnggttcaggtggcaggtgggtcgtgggacagtacttcactctcaccntccacacgtcgtaggacgcctgtaacgtagttttcgcgagttgtactttacgtgttccagtctagttagtcggtacgtacctccgtacccttacccatttacgtaccgttttacggttttccgggaccggtaacggggtaaccgtaaggggttaacggtaaaacgtaacgaaaccggttaacgtcggtacggtacgtcgaacctaccgtacttacgtcgtttcctttacctacttcccggtttcccctactactttccgtacgtccttccgtaccttcgtaccgtggtaccgggtccggtcgtacggacggtacggtaccncgtaagttacncgttnagtntacgnncncncngnnnnnnnnnnnncnnnnnnn

SEQ ID NO: 122023 - DNA, 561 bp, Homo sapiens
  misc_feature: GYAE6OF02GDY68.1.46.E02.1.454.CMB.1.raw
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
  modified_base (544)..(546): a, c, t, g, unknown or other
  misc_feature (544)..(546): n is a, c, g, or t
  modified_base (549)..(549): a, c, t, g, unknown or other
  misc_feature (549)..(549): n is a, c, g, or t
  modified_base (552)..(556): a, c, t, g, unknown or other
  misc_feature (552)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatccaccagacctggacgtcctgaagtattttgcagtgtattactgtcagcagtatggtagctcaccctcccatcgttacctacgttttcggaccgtaggggtaaccgaagggtacggtaaacgtaccgaaacgtaacgttgtacgggcttcgacctaccatctgttccttacgtacttccttccccgtacctacgttcctcgtaaccttccgttccttaccgttaccgtggtaaccgggtccgggtccgtacggggtaccgaacgggtccgaccttacgtaagctagactgctancncncncncgctcncgcgcgcgnnnatngtnnnnnagntn

SEQ ID NO: 122024 - DNA, 480 bp, Homo sapiens
  misc_feature: GYAE6OF02IASO0.1.46.E02.1.454.CMB.1.raw
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (462)..(480): a, c, t, g, unknown or other
  misc_feature (462)..(480): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggcctcccaggctcctcatctatgctcgggtcccacgagggccactggcactcccgagacgtaggttacaggtggctaggtggggtcgtgggacagtacttcactctcattctattagctagcgtggacncgtagtaagtactttcgctagtgttattacgngtcgagctaaggtagtaggtacttctctcgtcgtcgttcgaccgaacgggaacgtaaggtagaaataggaacgtgtgtcggtcncgacctactnttacgtnttctacnttccctcctactntctcgtacttcgccttcncgtggcgcggtcgacggacgacggnacagtncnnnnnnnnnnnnnnnnnnn

SEQ ID NO: 122025 - DNA, 577 bp, Homo sapiens
  misc_feature: GYAE6OF02IUYSE.1.46.E02.1.454.CMB.1.raw
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (539)..(540): a, c, t, g, unknown or other
  misc_feature (539)..(540): n is a, c, g, or t
  modified_base (545)..(545): a, c, t, g, unknown or other
  misc_feature (545)..(545): n is a, c, g, or t
  modified_base (552)..(556): a, c, t, g, unknown or other
  misc_feature (552)..(556): n is a, c, g, or t
  modified_base (559)..(560): a, c, t, g, unknown or other
  misc_feature (559)..(560): n is a, c, g, or t
  modified_base (563)..(566): a, c, t, g, unknown or other
  misc_feature (563)..(566): n is a, c, g, or t
  modified_base (568)..(577): a, c, t, g, unknown or other
  misc_feature (568)..(577): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggttcctcatctatggctgggtcccacgacgggccactggcactcccagaccgaggttcaggtggcgtaggtggggtcgtgggaaccagtacttccactctcactctatagacagtacgtggacacctagaagtacttcgactagttgtaattctgtcagtacaggttacgtagtaacgtcctacgtcttggttccggtacgacgacggaactaaggtaagaaactaacggaaactaacgtggacgtcacgacctactacgtcttacgttccttacgtaacttccgtacccgcgttaacttcggtccgttacgttccttactcgttaacgtacgggtacggggtaccgtcggttacggggcgttaaacccggcgtaacctaaggtccgatacgcgngcnngannagacncgtgacnnnnncgnngcnnnntnnnnnnnnnn

SEQ ID NO: 122026 - DNA, 687 bp, Homo sapiens
  misc_feature: GYAE6OF02FL2IY.1.46.E02.1.454.CMB.1.raw
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (604)..(604): a, c, t, g, unknown or other
  misc_feature (604)..(604): n is a, c, g, or t
  modified_base (615)..(615): a, c, t, g, unknown or other
  misc_feature (615)..(615): n is a, c, g, or t
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctctcatctatggtgcatccagacgagggccactggcatcccagacaggttcagtggcaggtgggtctgggacagacttcactctcacccatccaccacgtactaggacgctagaagtatttgctacgtgttattactgtacgagtactagtagtcggtaacnccgttcctaccctaccngtacgtaccgtacgttttcggacccggaggggtacccgtaaggggttaacgaacttaaccgaaaccgtaacgttcgtagggtaccgtgaccggtaacctacgttccgttacgttacccgttaccgtacgtttccccttaaccccgtccgtttaacgttcccgttaacgggttaacctttccggttaaccgttacgtttaaccgtacccggggacgggttaccggggaccgtttcgggaaccggttaaccgggtaccgtaccgaacgggttacggacgtcagctagngtataccgttnaccgttntacgngtagacgtacgtagcgtacgtacgtagttagtgtactactaccgttatacgtcgtatacg

SEQ ID NO: 122027 - DNA, 667 bp, Homo sapiens
  misc_feature: GYAE6OF02F19X5.1.46.E02.1.454.CMB.1.raw
  modified_base (295)..(295): a, c, t, g, unknown or other
  misc_feature (295)..(295): n is a, c, g, or t
  modified_base (607)..(607): a, c, t, g, unknown or other
  misc_feature (607)..(607): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
  modified_base (626)..(626): a, c, t, g, unknown or other
  misc_feature (626)..(626): n is a, c, g, or t
  modified_base (638)..(638): a, c, t, g, unknown or other
  misc_feature (638)..(638): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (664)..(664): a, c, t, g, unknown or other
  misc_feature (664)..(664): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcactcccgagacaggttcaggtgcgtaggtgggtctagggacaggtaccttcacttcctcaccatccaccagtacgtggacgtcctaggaactattttcgcgtagtgttatttacgttcgtntagactaggtaagttgggtacgtcctaccacccctccacgttcgttaccttacgttttcggaccggtaacggggtaaccgtaagggttaagaaactacgaaacgtacgttggtcgtaccgtagaccgtacttaacgtcgttacgtttaccgtttacctaccgttttaccccgtaccccgtaccgtttaccgttaccgttacgtaaccgtttcccgtttaccgttaccttaccgtacggggttacccggtccggggtaccgttaccggggttaacgaaccggtaccgtacgttaaccggtacgggtcgcgtcncgacgtagngtcgtcncgngcacgtgtctangtctacgctctgctntcncgntctcntcg

SEQ ID NO: 122028 - DNA, 605 bp, Homo sapiens
  misc_feature: GYAE6OF02JZ4FG.1.46.E02.1.454.CMB.1.raw
  modified_base (189)..(189): a, c, t, g, unknown or other
  misc_feature (189)..(189): n is a, c, g, or t
  modified_base (569)..(570): a, c, t, g, unknown or other
  misc_feature (569)..(570): n is a, c, g, or t
  modified_base (574)..(574): a, c, t, g, unknown or other
  misc_feature (574)..(574): n is a, c, g, or t
  modified_base (576)..(580): a, c, t, g, unknown or other
  misc_feature (576)..(580): n is a, c, g, or t
  modified_base (583)..(604): a, c, t, g, unknown or other
  misc_feature (583)..(604): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctcccaggctcctcatctatggtgcatccagcagggccactggcatcccagacaggttnacgtggcaggtgggtctgggacaggtacttcactctcaccatcaccacgactggagcctagtaacgtagtttcgctagtagttaacttatcgttacagtcgtagtagtacggtaacgttcctaccgtcgttcggttccggtttaccgggacccgtaaggggtaaccctaaagggttaacgaaagtaaccggtaaacggaaccgttagggtcggtagttaccgaccaactacgttcgttagttacccgttactaacccgttcctttaccccggacttaacgtcctccggtttaaccttcccggttcccgtttactttaacggtacgggtacgggtccggggtacttcggggaacgtacggtaccgacgtacggtagccgtnnctantnnnnntcnnnnnnnnnnnnnnnnnnnnnnc

SEQ ID NO: 122029 - DNA, 656 bp, Homo sapiens
  misc_feature: GYAE6OF02H02I1.1.46.E02.1.454.CMB.1.raw
  modified_base (250)..(250): a, c, t, g, unknown or other
  misc_feature (250)..(250): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (620)..(620): a, c, t, g, unknown or other
  misc_feature (620)..(620): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (633)..(633): a, c, t, g, unknown or other
  misc_feature (633)..(633): n is a, c, g, or t
  modified_base (644)..(644): a, c, t, g, unknown or other
  misc_feature (644)..(644): n is a, c, g, or t
  modified_base (650)..(651): a, c, t, g, unknown or other
  misc_feature (650)..(651): n is a, c, g, or t
tcagacgagtgcgtcacgaccggtgctcgatttagactcatctacagggaaagggccaccctctcctgcagggccagtcagagtgttagcaacaactacttagcctggtaccagcagaaacctggccaggctccaggctcctcatctatggtgcatccagcgacgggccactggcactcccagactaggttcagtggcgaggtcgggtctgggacagtacttacactctcaccacgtcaccagctggacnccgtagaagtattttgctaggttagtatttacgtgtcgagtctaggtagtaggtacgccttaccgaccctacccgtattacggtaacctttaccgttttacgggacccggtaacggggtaccggtaaagggtacggtaaaacgtaaccggaaaacggtaccgtaggttcgggtcctacgactaccgtacgttccgttagtttacctttactaaccgtttccccgtttccccgtacccttacgttcccgtttaccgtacccgttacccgtaccgttacggttacgacggggtacccggggtcggtaaccgggtaaccgtaaccggggtccgtacgtacgttaaggctaggcagtcgatcagngatntgacntgtcgncgnctcngcgtgtctacncgatannacgtc

SEQ ID NO: 122030 - DNA, 667 bp, Homo sapiens
  misc_feature: GYAE6OF01BKQNK.53.57.F02.1.454.CMB.1.raw
tcagcgcgtatacacacgaccggtgctcgatttagctcgatatagttgggtttgggggagtcagtcccaaccaggacacagcatggacatgagggtccctgctcagctcctggggctcctgctgctctggctctcaggtgccagatgtgacatccagatgacccagtcctccatccctccctgtctgcatcgtgtaggagacagacgtcaccatcctacttgaccaggcgagtcaggactaattagaaacttatttaaatgtatcagacaagaaacgaggaactaccctaactcctagactctagatgactatactaaagttagaaacgtacgggtaccagtacgtaaggttcgagtaggaacgtggaagttcggtaggactagttacttttactacacgtagtcgtacacgccgtacgacgtacgacgtaagaagttattacgtacgtaactaactaagttacgtttacgtcgtacgtaacgtataacggttagtaacgtaaactttaaccgtaccctacccgtaactcccgttaaccgggtttacggaaaccggggtaaccggaaacgggttaaaccggggtagggtaaacgtaaaccgtaaacccggtaaaaggtaaccggtttagggtaacgggacccttacggaaaccgacccggtttaacg

SEQ ID NO: 122031 - DNA, 523 bp, Homo sapiens
  misc_feature: GYAE6OF02F98JO.53.57.F02.1.454.CMB.1.raw
  modified_base (312)..(312): a, c, t, g, unknown or other
  misc_feature (312)..(312): n is a, c, g, or t
tcagcgcgtatacacacgaccggtgctcgatttagctcgatatagttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatagaaactatttaaatggtatcagcagaaccaggaaagcccctaaactcctgatctacgatgcatccaatttggaaacngggtcccatcaaggttcagtggaagtggatctgggacagtattttacttcaccatcggcagcctgcagcctgaagatattgcacatattactgtcagcagtatgattaactctacccacttccaacttttcgggaccgaaggggtacccaagggttcggaacgaagttaccaaacggtaacgttggtacggtccgttagcccgaccgtaac

SEQ ID NO: 122032 - DNA, 129 bp, Homo sapiens
  misc_feature: GYAE6OF01B6CX2.5.41.D08.1.454.CMB.1.raw
  modified_base (125)..(129): a, c, t, g, unknown or other
  misc_feature (125)..(129): n is a, c, g, or t
tcagatcagacacgcacgaccggtgctcgatttagtcacgcgagaaagggaaggggctggccctgacgtgtttctgttcccacctcctccgtgtctgatctgagcgggctggcaaggcgcatagnnnnn

SEQ ID NO: 122033 - DNA, 133 bp, Homo sapiens
  misc_feature: GYAE6OF01CZJ90.5.41.D08.1.454.CMB.1.raw
  modified_base (126)..(133): a, c, t, g, unknown or other
  misc_feature (126)..(133): n is a, c, g, or t
tcagatcagacacgcacgaccggtgctcgatttagtcacgcgagaaagggaaggggctggccctgacgtgtttctgttcccgcctcctccgtgtctgatctgagcgggctggcaaggcgcattagnnnnnnnn

SEQ ID NO: 122034 - DNA, 126 bp, Homo sapiens
  misc_feature: GYAE6OF01DU4R2.5.41.D08.1.454.CMB.1.raw
  modified_base (126)..(126): a, c, t, g, unknown or other
  misc_feature (126)..(126): n is a, c, g, or t
tcagatcagacacgcacgaccggtgctcgatttagtcacgcgagaaagggaaggggctggccctgacgtgtttctgttcccgccctcctccgtgtctgatctgagcgggctggcaaggcgcatagn

SEQ ID NO: 122035 - DNA, 127 bp, Homo sapiens
  misc_feature: GYAE6OF01DBP9P.5.41.D08.1.454.CMB.1.raw
  modified_base (127)..(127): a, c, t, g, unknown or other
  misc_feature (127)..(127): n is a, c, g, or t
tcagatcagacacgcacgaccggtgctcgatttagtcacgcgagaaagggaaaggggctggccctgacgtgtttctgttcccgccctcctccgtgtctgatctgagcgggctggcaaggcgcatagn

SEQ ID NO: 122036 - DNA, 127 bp, Homo sapiens
  misc_feature: GYAE6OF01CI18J.5.41.D08.1.454.CMB.1.raw
  modified_base (127)..(127): a, c, t, g, unknown or other
  misc_feature (127)..(127): n is a, c, g, or t
tcagatcagacacgcacgaccggtgctcgatttagtcacgcgagaaagggaaaggggctggccctgacgtgtttctgttcccaccctcctccgtgtctgatctgagcgggctggcaaggcgcatagn

SEQ ID NO: 122037 - DNA, 132 bp, Homo sapiens
  misc_feature: GYAE6OF01D9W6R.5.41.D08.1.454.CMB.1.raw
  modified_base (76)..(76): a, c, t, g, unknown or other
  misc_feature (76)..(76): n is a, c, g, or t
  modified_base (125)..(132): a, c, t, g, unknown or other
  misc_feature (125)..(132): n is a, c, g, or t
tcagatcagacacgcacgaccggtgctcgatttagtcacgcgagaaagggaagggggctggccctgacgtgtttcngttcccgcctctccgtgtctgatctgagcgggctggcaaggcgcatagnnnnnnnn

SEQ ID NO: 122038 - DNA, 137 bp, Homo sapiens
  misc_feature: GYAE6OF01CR6P8.5.41.D08.1.454.CMB.1.raw
  modified_base (127)..(137): a, c, t, g, unknown or other
  misc_feature (127)..(137): n is a, c, g, or t
tcagatcagacacgcacgaccggtgctcgatttagtcacgcgagaaagggaaaggggctggccctgacgtgtttctgttcccaccctcctccgtgtctgatctgagcgggctggcaaggcgcatagnnnnnnnnnnn

SEQ ID NO: 122039 - DNA, 128 bp, Homo sapiens
  misc_feature: GYAE6OF01DSB4J.5.41.D08.1.454.CMB.1.raw
  modified_base (124)..(128): a, c, t, g, unknown or other
  misc_feature (124)..(128): n is a, c, g, or t
tcagatcagacacgcacgaccggtgctcgatttagtcacgcgagaaagggaaggggctggccctgacgtgtttctgttcccgcctctccgtgtctgatctgagcgggctggcaaggcgcatagnnnnn

SEQ ID NO: 122040 - DNA, 127 bp, Homo sapiens
  misc_feature: GYAE6OF01C3Z0Q.5.41.D08.1.454.CMB.1.raw
tcagatcagacacgcacgaccggtgctcgatttagtcacgcgagaaagggaaagggggctggccctgacgtgtttctgttcccaccctcctccgtgtctgatctgagcgggctggcaaggcgcatag

SEQ ID NO: 122041 - DNA, 542 bp, Homo sapiens
  misc_feature: GYAE6OF01DHJHP.5.41.D08.1.454.CMB.1.raw
tcagatcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagaagcctgggtcctcggtgacactctcctgcaaggcgtctggacgccaccttcaccaactatgtcttcaacgtgggtcgcggacgggccctgggcagggcttgagtggcgtggggcgatcactccctacgtgatgtgacaactatgcacagacgttcgagggcagagtcaactaacgttaccggacggacaacggtcccgacgacgacacacgacctacacgtggacgcgtagaaccacgtgagatcgtagaacgacgacggtcctatacttacgacgtacgaccgtcgcgtacgtacggacgtactaccgtctacgtgtcgtccggcttaag

SEQ ID NO: 122042 - DNA, 736 bp, Homo sapiens
  misc_feature: GYAE6OF01AJ64S.5.41.D08.1.454.CMB.1.raw
  modified_base (230)..(230): a, c, t, g, unknown or other
  misc_feature (230)..(230): n is a, c, g, or t
tcagatcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagagcctgggtcctcggtgacnctctcctgcaggcgtctggacgccaccttcacctaactatcgtccttttacaacgtgggtcgccggaccggggtccccgtgggcgtaggggtacgttggacggtcggtcggtgggggcggtagtccacgttccccgttaccggtttggacgttggtacgggtaccaaaccgttagtacgaccgtaacgtaacggtaacggttacccggaaggggacctaaggtacgttacccaaccgtaaacgtttaccccgggaccgggtaaccgtaaacgggttccccggacgtaacggcccgaaacgaccgtacccgttaacaacggttcggggaacctccggtaacggaaacccgtaaccgtggaacgtacgtaccgtaaggaacgaccgtaccgggtcccgttacttacgttacgtacggtaccgtaccgtcggtaccggtacgtaccgggttccgtaacccgttccccggtctttacggtacggtcccggtttccgggtaacccttaggg

SEQ ID NO: 122043 - DNA, 133 bp, Homo sapiens
  misc_feature: GYAE6OF01EE118.5.41.D08.1.454.CMB.1.raw
  modified_base (128)..(133): a, c, t, g, unknown or other
  misc_feature (128)..(133): n is a, c, g, or t
tcagatcagacacgcacgaccggtgctcgatttagtcacgcgagaaagggaaaggtggctggccctgacgtgtttctgttcccgccctcctccgtgtctgatctgagcgggctggcaaggcgcatagnnnnnn

SEQ ID NO: 122044 - DNA, 127 bp, Homo sapiens; identical to SEQ ID NO: 122036
  misc_feature: GYAE6OF01EPP0P.5.41.D08.1.454.CMB.1.raw
  modified_base (127)..(127): a, c, t, g, unknown or other
  misc_feature (127)..(127): n is a, c, g, or t

SEQ ID NO: 122045 - DNA, 123 bp, Homo sapiens
  misc_feature: GYAE6OF02I7QC9.5.41.D08.1.454.CMB.1.raw
  modified_base (123)..(123): a, c, t, g, unknown or other
  misc_feature (123)..(123): n is a, c, g, or t
tcagatcagacacgcacgaccggtgctcgatttagtcacgcgagaaagggaagggctggcctagcgtgttcctgttcccgcctcctccgtgtctgatctgagcgggctggcaaggcgcatagn

SEQ ID NO: 122046 - DNA, 126 bp, Homo sapiens
  misc_feature: GYAE6OF02FTVJS.5.41.D08.1.454.CMB.1.raw
  modified_base (126)..(126): a, c, t, g, unknown or other
  misc_feature (126)..(126): n is a, c, g, or t
tcagatcagacacgcacgaccggtgctcgatttagtcacgcgagaaagggaaaggggctggccctgacgtgtttctgttcccacctcctccgtgtctgatctgagcgggctggcaaggcgcatagn

SEQ ID NO: 122047 - DNA, 129 bp, Homo sapiens
  misc_feature: GYAE6OF02HW0MR.5.41.D08.1.454.CMB.1.raw
  modified_base (128)..(129): a, c, t, g, unknown or other
  misc_feature (128)..(129): n is a, c, g, or t
tcagatcagacacgcacgaccggtgctcgatttagtcacgcgagaaagggaaagggggctggccctgacgtgtttctgttcccgccctcctccgtgtctgatctgagcgggctggcaaggcgcatagnn

SEQ ID NO: 122048 - DNA, 126 bp, Homo sapiens
  misc_feature: GYAE6OF02F7LYD.5.41.D08.1.454.CMB.1.raw
tcagatcagacacgcacgaccggtgctcgatttagtcacgcgagaaagggaaaggggctggccctgacgtgtttctgttcccaccctcctccgtgtctgatctgagcgggctggcaaggcgcatag

SEQ ID NO: 122049 - DNA, 126 bp, Homo sapiens; identical to SEQ ID NO: 122048
  misc_feature: GYAE6OF02GU0GK.5.41.D08.1.454.CMB.1.raw

SEQ ID NO: 122050 - DNA, 127 bp, Homo sapiens; identical to SEQ ID NO: 122035
  misc_feature: GYAE6OF02H643B.5.41.D08.1.454.CMB.1.raw
  modified_base (127)..(127): a, c, t, g, unknown or other
  misc_feature (127)..(127): n is a, c, g, or t

SEQ ID NO: 122051 - DNA, 127 bp, Homo sapiens; identical to SEQ ID NO: 122036
  misc_feature: GYAE6OF02FHRJI.5.41.D08.1.454.CMB.1.raw
  modified_base (127)..(127): a, c, t, g, unknown or other
  misc_feature (127)..(127): n is a, c, g, or t

SEQ ID NO: 122052 - DNA, 128 bp, Homo sapiens
  misc_feature: GYAE6OF02G8M61.5.41.D08.1.454.CMB.1.raw
  modified_base (128)..(128): a, c, t, g, unknown or other
  misc_feature (128)..(128): n is a, c, g, or t
tcagatcagacacgcacgaccggtgctcgatttagtcacgcgagaaagggaaagggggctggccctgacgtgtttctgttcccgccctcctccgtgtctgatctgagcgggctggcaaggcgcatagn

SEQ ID NO: 122053 - DNA, 572 bp, Homo sapiens
  misc_feature: GYAE6OF02GM6RO.5.41.D08.1.454.CMB.1.raw
tcagatcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagagcctgggtcctcggtgacactctcctgcaaggcgtctggacgccaccttcaccaactatgcttcaactgggtgcgacgggccctgggcagggacttgagtggcgtggggcgatcgactcccgtacgttgatgtgacaactatgacacagaacgttcgagggcagagtcacaagttaccgcgacaacgtccgcgacgcacgacgacctacagtggagctacgaaacctaacgtgaagtactacgtagaacgaccgacggtaccgttactacgttaccgtacgtaccgtaccgtcgaccgtaccgtaccggtacgtacccgttacccgtcgttccgtacggtccgtttaccgggaccttacgg

SEQ ID NO: 122054 - DNA, 704 bp, Homo sapiens
  misc_feature: GYAE6OF02HGUX2.5.41.D08.1.454.CMB.1.raw
tcagatcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtcgtggggctgccgtgaagaagcctgggtcctcggtgacactctcctgcaaggcgtctggacgccaccttcaacctaactatcgtctttacaacgtgggtcgacggaccggggccccgtgggccgacgggtacttggaggtcggcgtggggcgtatccgtactcccgtaccggttgacgtggtacggactaaacgtcgtacgacaacgtaacggtaacgttccgagggaccgtaagtacgtacaacgtaacgtacccggacggaactaacggtccggacgaacgaccaacgaccgtaccgtaacgacgtacggacgtacctaacggaaaccgtaacccgtaggaacgtaacgtacgtaacggaacgaaccggtaccgggtacccgttaacttacgttaaccgtaccgggttaaccgtaccgttacggacccggttaccggtaaccgggttacgtaacccgttacccggccgttaccggttccggtacccggtttaccgggtacccttaacgg

SEQ ID NO: 122055 - DNA, 127 bp, Homo sapiens
  misc_feature: GYAE6OF02FMA98.5.41.D08.1.454.CMB.1.raw
tcagatcagacacgcacgaccggtgctcgatttagtcacgcgagaaagggaaagggggctggccctgacgtgtttctgttcccgccctcctccgtgtctgatctgagcgggctggcaaggcgcatag

SEQ ID NO: 122056 - DNA, 129 bp, Homo sapiens
  misc_feature: GYAE6OF02HWCE2.5.41.D08.1.454.CMB.1.raw
  modified_base (122)..(122): a, c, t, g, unknown or other
  misc_feature (122)..(122): n is a, c, g, or t
  modified_base (128)..(129): a, c, t, g, unknown or other
  misc_feature (128)..(129): n is a, c, g, or t
tcagatcagacacgcacgaccggtgctcgatttagtcacgcgagaaagggaaagggggctggccctgacgtgtttctgttcccaccctcctccgtgtctgatctgagcgggctggcaaggcncatagnn

SEQ ID NO: 122057 - DNA, 130 bp, Homo sapiens
  misc_feature: GYAE6OF02HFLAC.5.41.D08.1.454.CMB.1.raw
  modified_base (96)..(96): a, c, t, g, unknown or other
  misc_feature (96)..(96): n is a, c, g, or t
  modified_base (128)..(130): a, c, t, g, unknown or other
  misc_feature (128)..(130): n is a, c, g, or t
tcagatcagacacgcacgaccggtgctcgatttagtcacgcgagaaagggaaagggggctggccctagcgtgttcctgttcccaccctcctccgtntctgatctgagcgggctggcaaggcgcatagnnn

SEQ ID NO: 122058 - DNA, 547 bp, Homo sapiens
  misc_feature: GYAE6OF01CC2HZ.52.38.D05.1.454.CMB.1.raw
  modified_base (537)..(537): a, c, t, g, unknown or other
  misc_feature (537)..(537): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagacggccctcgagggatcccgtgacgcgattctctggctccaggtcagggacaacggtcacattcggccatcagtggagtccaggcagaggacgaggctgactattattgtacaatcaacacgacacctattcggtaacttagtgtcgttacggaactcgaccgtaccgtaacggtccaacccggttccgtacgggtccacggaccccgaacgggaccccaaacccccgngtcggtaccc

SEQ ID NO: 122059 - DNA, 585 bp, Homo sapiens
  misc_feature: GYAE6OF01BYVC3.52.38.D05.1.454.CMB.1.raw
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (575)..(575): a, c, t, g, unknown or other
  misc_feature (575)..(575): n is a, c, g, or t
tcagcgcagtacgacacgaccggtgctcgatttagtatctgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtcgtcccaggacagacgccaggatcacctgctctggagatgctattgaccaaacgntatgcttatggtaccagcagaagccggcaggcccctgtgtggtgatgtanaaagacactgagacgccctacgagggactcccgtaggacgcgtattctcgtggtcctccgaggtacgaacggggaccaaacgggttcaacgtaattcgggacctagttacgaggtaggacgtaccgaggacgaggaaggacgagctagtacgtattagtcgtacaaattcaacaagacgaacctagttacggttaacttagtcgtacgttaccgtaacgtcgacggaaccgtaaggtaccaccggttcgtacgggtacctacgacccgaacggacccaaaccccngtcgtacccg

SEQ ID NO: 122060 - DNA, 696 bp, Homo sapiens
  misc_feature: GYAE6OF01CJXWS.52.38.D05.1.454.CMB.1.raw
  modified_base (175)..(175): a, c, t, g, unknown or other
  misc_feature (175)..(175): n is a, c, g, or t
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagcgcagtacgacacgaccggtgctcgatttagtatctgatagttgggtttgggctgtgggtccaggaggcagaactctgggtgtctcaccatggcctggatccctctacttctcccctctcactctctgcacaggctctgaggcctctatgagctgacacagccacctggtntcagtcgtcccaggacagacggccaggatcactgctctgganatgctattcgaccaaacgntatgtcttatggtaccagtcagaacgccggacacggtcccctgtcgttggtcgtactgtaactaaagctacgtgacgtacggtccctacgacgggtaactcccgtagacgtcgtaacttcgtcgtcggtctaccgaggttcgaacgggtacctaacgggtccaacgtacgtttacggaccctagttaccgaaggttcggtaaccgtccgtaagggtaccgtaacgggtaacgggtaccggtacgggtaccgttaggtaaccgtttaagtttacgttcggttaacgaaacgttacgaaaccggtaacgtaccgtaaaccgtacgtttacgggttaaacctttagtaccgttaccggttaacggtaaaccgttcggaacccgtaaccggttaacggtccgtaacccggttcggtacggtacgtacggaccctaacggaccctaacccgtagttcgtaacccg

SEQ ID NO: 122061 - DNA, 522 bp, Homo sapiens
  misc_feature: GYAE6OF01BSFYC.52.38.D05.1.454.CMB.1.raw
  modified_base (513)..(513): a, c, t, g, unknown or other
  misc_feature (513)..(513): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgttggtgatgtataaagacactgagaggcctcagggatccctgacgcgattctctggctccgaggtcagggacaacggtcacattggccatcgagtggagtccaggcaggaggacgaggctagacttattagttgtcaatacaacaacgacacctattaggtacttatcgtacttcggaactgaccgacgacggtcacccgtctcgggtcacgcccaaggaccccaacccncgtgtaccc

SEQ ID NO: 122062 - DNA, 555 bp, Homo sapiens
  misc_feature: GYAE6OF01AGP54.52.38.D05.1.454.CMB.1.raw
  modified_base (242)..(242): a, c, t, g, unknown or other
  misc_feature (242)..(242): n is a, c, g, or t
tcagcgcagtacgacacgaccggtgctcgatttagtatctgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgacccaaaccgntatgcttattggtaccagcagaagccggccacggcccctgtgttggtgatgtataaagacactgagacggccctacgacgggactccctaggacgcgtattctcgtggcctaccgagggtacgagggaccaacggtcgactagttcggccagtcgaggtggacgtccgaggcaaggacggacggaggcgtagacttattagttgtacaactcaacaacgactacgtattcggtacttagtcgtcttacggactcggacaccgaacgtccaccggtcgtcggtacacgtaccacggacccacccctgtcgtacc

SEQ ID NO: 122063 - DNA, 581 bp, Homo sapiens
  misc_feature: GYAE6OF01BATN1.52.38.D05.1.454.CMB.1.raw
  modified_base (431)..(431): a, c, t, g, unknown or other
  misc_feature (431)..(431): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccggcacggcccctgtcgttggtgatagtataaagacacgtgagaggccctcgagggtactcccgtgacgcgtattctcgtggctccgaggtcaagggacaacgggtcacgattggaccatcaggtgacgtccaagcgaggaggacgagctgactattatctanaactacaacagaccaaccgtagttacgttaatttagtacgtttcgttacgaaacgttcggaaccgtaaccgaaacggttccacccggttcccgttacgggtccaccgggtaccccacgggaacccccaaacccccgtagtccgtaacccc

SEQ ID NO: 122064 - DNA, 659 bp, Homo sapiens
  misc_feature: GYAE6OF01DU17D.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtataaagacactgagaggccctgagggactcccgtgacgcgtattctacgtcggctccgaggtcaaggggactaaacggtcaacctagttacggacctatcgtaggtagggacgttcccgaagggcgaaacgggaaggacgtaggaggtacgttaggtaacttattttaagtttagtactaaataaccgaaacaacggtaacctaaccgtaagtttacggttaaccttttagttggttaccgtttacgggaaaccgttcggaaccggaaaccgtaagggttacccgtaaccccggttacccggttcgggttaacccgtacggaacccccctaaacgggacccccaaacccccgtacgttaaccccgg

SEQ ID NO: 122065 - DNA, 568 bp, Homo sapiens
  misc_feature: GYAE6OF01AYBTM.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcgagggactcccgtgagcgtattctcgtcggcctccgaggtcgagggaccaacggtccactattcgggacctagtcgaggtcgggacgtccgaggcaaggaggacgaggctgactattattgtactaatacaacagacaccgtaagttcggtaactttagtcgttaccttacggaactcgacgaccgtaaggttcccgaccgttccgtcgggtcacggtaccccgaacggaccccaaaccctcgttcgtaccc

SEQ ID NO: 122066 - DNA, 597 bp, Homo sapiens
  misc_feature: GYAE6OF01DODW8.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctcgtggagatgctattcgaccaaaccgtatatgcttatggtaccagcagaacgccgggccacggcccctgtgttggtgagtagtaataaacgactacgtgagacggccctacgaggactccgtgacgcgtattctcgtcggtcctcgaggtcgaacgggactaacggtcaatgttcggactactcgaggtcgacgtaccgaggcaaggaggacggagtctgtacttaatttcgttagacaacgttcaaacgacgtaaccacgtagtttacggtaactttacgtgttaccttacggaacttcggtacgaaccgtaaggtacctaccggttccggtcggtaccaccggtacccaacggaccccaacccctgtcgtaccc

SEQ ID NO: 122067 - DNA, 648 bp, Homo sapiens
  misc_feature: GYAE6OF01BCL76.52.38.D05.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattcgaccaaaccgntatgcttagttggtaccagcagaacgccggccacggcccctgtgttggtgatgtaataaagacacgtaggagacggccctacgacgggtactcccgtgacgcgtattccgtcgtcggcctaccgaggtcgacgggaccgaacggtcacgtagttcggaccatcgaggtcggacgtccgaggcgaggacgggacgacggcgtagtactttattagtttgtactaactacaacgaacgaacctaacccgtagtttacgttaacttacgttagttaccgttacggtaaaccttcgggaacccgtaaccgtaaccgggttacccaacccgggtttcccgtaccgggtaccgaacccggtaccccgaacccgggaccccctaaacccccgtacgttccggttaacccc

SEQ ID NO: 122068 - DNA, 727 bp, Homo sapiens
  misc_feature: GYAE6OF01DUL4F.52.38.D05.1.454.CMB.1.raw
  modified_base (260)..(260): a, c, t, g, unknown or other
  misc_feature (260)..(260): n is a, c, g, or t
tcagcgcagtacgacacgaccggtgctcgatttagtatctgatagttgggtttggggctgtgggtccaggaggcagaactctgggtgtctcaccatggcctggatccctctacttcctccccctttcctcactctctgcacaggctctgaggcctcctatgagctgacacacgcccaccctggtgtcagtcgtccccgaggacagaccggccaggactccacctgcctcgtaggagatcgctagttcgaaccaaaccgtntagtgtactttagttcggtaccagtacgacggaacggcccgggacccgacggtccccgtggttcggtttaggtagtacgttaggtaaataaacgaccagtaggacgtaccggtccccttacggacgggtaacctcccgtagtacgtcgtactttcgtcgtcgccgtacggacggtacgaacgggtacgtaccgtatacgtgttcgactagtacgtgggtacgtacgtaccggaggtacgaaggacgggacgtacggtacgttacgtaacgtttaagtttacttacggtaactaaagttaaccgaacgtaactaaccgttaacttacggttttacgttaacttttagtcgtttacgttaccgaccttcggaacctaaccggtacgttacccgtacccgggttcgaaccgggtaccaacccggtaaccccaacccgggacccccaaaccccgtccgtaccggttacccc

SEQ ID NO: 122069 - DNA, 570 bp, Homo sapiens
  misc_feature: GYAE6OF02JZZFY.52.38.D05.1.454.CMB.1.raw
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
tcagcgcagtacgacacgaccggtgctcgatttagtatctgatagttgggtttggggcgtgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgttggngatgataaagcactgagacggccctcgagggactccctagagcgattcgtctggtcctcgaggtccagggacaacggtcacgattacggccatcaacgtggagtccagggacaggaggacggaggctaggacttagttattgtacaagtaccaacgtagacctaaccgattacggtaactttatacgtcgttacggaaccttggaccgtaaccgtaagggtcctaaccggttccgtggggtacctacggaccccgtaaggaccctaaccccgacctaggtacccc

SEQ ID NO: 122070 - DNA, 571 bp, Homo sapiens
  misc_feature: GYAE6OF02ICGF0.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgctctggagatgcattgccaaaccgatatgcttattggtaccagcagaagccggccaggccctgtgttgtgatgtaataaagacactgagaggccctcgagggactccctgagcgattctctggctccgaggtcgagggaacaacggtcacgagttcggccagtcaggtcgggagtccgaggcaagggaggaccggaggtctgaacttattattgtacaaattcaaacacgaccaaccgtagtttacggtaactttacgtgttccgttacggaactcgaccgtaaccgtaacggtccaacccggttccgtacgggtccgaacgacccgaacggtacccccaaccctacgtcgtaaccg

SEQ ID NO: 122071 - DNA, 551 bp, Homo sapiens
  misc_feature: GYAE6OF02GBEL6.52.38.D05.1.454.CMB.1.raw
  modified_base (543)..(543): a, c, t, g, unknown or other
  misc_feature (543)..(543): n is a, c, g, or t
tcagcgcagtacgacacgaccggtgctcgatttagtatctgatagttgggtttggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccacggcccctgtgttggtgatgtataaagacactgagacggccctcgagggactccctgacgcgtattctctggctccgaggtcgagggacaacggtcactattcggcctatcgaggtggacgtccgaggcgaggacgggacggaggcgttagacgttattattgtacaatacaacagaccacctattcggtaacttatcgttcgttagacttggcgaacccgtaggtaccaccggtcgtcgggtacaccggacccaagggccccaacccgtntacgtccc

SEQ ID NO: 122072 - DNA, 510 bp, Homo sapiens
  misc_feature: GYAE6OF02JA4W4.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagcactgagaggccctcgagggatcccgtgagcgattctctggctccaggtcagggacaacggtcacattggccatcagtgagtccaggcagaggacgaggctgactattatgtacaatcaacagacacctattaggtacttagtgttcttacgactgtcgacctaaggtcaccggtcctgggtcacgtcccaacggcccaacccgctgtacc

SEQ ID NO: 122073 - DNA, 507 bp, Homo sapiens
  misc_feature: GYAE6OF02GAP4H.52.38.D05.1.454.CMB.1.raw
  modified_base (501)..(501): a, c, t, g, unknown or other
  misc_feature (501)..(501): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtcgttggtgatgtataaagacactgagaggccctcagggatccctgagcgattctctggctcaggtcagggacaacggtcacattcggcatcagtggagtccgaggcagaggacgaggctgactattattgtacaatcaacagacaccattggtaacttatgtacttcgactgcgacgaaggtcaccgtcctggtacacgccaacggcccaaccctacncgtacc

SEQ ID NO: 122074 - DNA, 584 bp, Homo sapiens
  misc_feature: GYAE6OF02GEL4Y.52.38.D05.1.454.CMB.1.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccggcaggcccctgtcgttggtgagtgtaataaagacacgtaggagacggccctacgacgggactccctgacgcgtattctcgtgctccgaggtcagggacaacggtcactacgttcggcctagtcgagtggacgtccgaggcaggaggacgacggctgacttattattgtctaactcgaanacgactaccgtattacggttaacttnttacgttcgttacgtactcggaccgtaaccgtaacggtcctaacccggttccgtacgggtacctaccggaccccgtaaacggtacccccaaccccggtacctcgttaaccccg

SEQ ID NO: 122075 - DNA, 791 bp, Homo sapiens
  misc_feature: GYAE6OF02FOV4R.52.38.D05.1.454.CMB.1.raw
tcagcgcagtacgacacgaccggtgctcgatttagtatctgatagttgggtttggggctgtgggtccaggaggcagaactctgggtgtctcaccagtcggccgtggactccctctacttcctcccctcctcactctctgcacgaggctcgtggacggcctacctagtgagctagacacacgcccacccgtcggtcgtacgtagttccgtaccccgaggacgacggaccggaccgaggactccaccgtgtcctcgtaggagagtcgactagttccgaacccaaacgtattatcgtactttagttcggtaaccagacaaggaacggcccgggaccaccgggtcccccgttggttgggtttcgggtagtagttaggttaaacgtaaaagacctacgtaggaacggaccggtccctacggacgggtactcccgtggacgcgttacttcctacgtcggtcctaccgacggtacggacggggaacccgtaacgggtccaacgttacggtttccggacctagtacgtagggtacgggtaccgtaccggacggcgaagggacgggacggacggcgttaggtaactttagtttacgttcgtaccaattaccaacgacgaaccctaccgttagtttacggttaaccttttagtaccggtttacgtttaaccgggtacgttccggtaacccggtaacccgtaacggggttaccctacccccgggttacggttaccggggttacccaaccgggtaccccgtaacccgggaacccccaaccccgttaccggttaccgtaccccg

SEQ ID NO: 122076 - DNA, 557 bp, Homo sapiens
  misc_feature: GYAE6OF02F0AUM.52.38.D05.1.454.CMB.1.raw
  modified_base (242)..(242): a, c, t, g, unknown or other
  misc_feature (242)..(242): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaacgccgggccaggcccctgtgttggtgatgtataaagacactggagacggccctcgagggactcccgtgagcgattctctggcctcgaggtcagggacaacggtcacgtattggccatcgagtggacgtccgaggcaggaggacgaggctgacttattatgtacaatcaacagaccactagtttcgtaactttatcgttacgttaccggaacttcgaccggaaccgtaacggtcctaacccggtcccgttagggtaccacgccccgaacggccccaacccctacgtcgtaccc

SEQ ID NO: 122077 - DNA, 648 bp, Homo sapiens
  misc_feature: GYAE6OF02GXOB6.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtccagtgtccccaggacagacggccaggatcacctgctctggagatgcattgaccaaaccgatatgcttattggtaccagcagaagccgggcaggcccctgtgttggtgatgtataaagacactgagaggccctagagggactcccgtgacgcgtattctacgtcggcttcccgaggttacgagggaccaaacgggtcacgtagtttcggacccatcgaggtgggacgtcccgaaggcaagggacggtaacggacggtcgttaggaacttagtttaacgttcgttacaagttaccaaacgtaacgaaccgtacctaagtttacggttaactttagttcgttacgttaccggtaacttcggaccgtaacccgtaaacggttacccgtaacccggttcccgttcggggtacctaaccggtacccccgtaaacgggacccccctaacccccgtaccggttcgtaaccccg

SEQ ID NO: 122078 - DNA, 757 bp, Homo sapiens
  misc_feature: GYAE6OF02F4LBY.52.38.D05.1.454.CMB.1.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (741)..(741): a, c, t, g, unknown or other
  misc_feature (741)..(741): n is a, c, g, or t
tcagcgcagtacgacacgaccggtgctcgatttagtatctgatagtttggggttttgggggactggtagggtccaggaggcccaggaacttctgggtgtctcgaccatggcctcggagtccctctacttctcccctactcactctctgcacaggctcgtggaggcctcctagtgagctgacacagcccacctcggtgtcagtcgtccccaggacagacggcaggatcacctgctctgganactgcattcgacccaaacgntactgtcttattcggtaccagaccaggaacggcccgggcacggtcccctggtggtttcggtgattacgtaaataaaggacctatagaaggtaccgggccctacggacgggtacctcccgtaggacgtacgtacttccgttacgtcgggtacctacccggagggttaccggaacggggtaaacctaaccggggtttaccaaacgttagtttaccgggaccctaacgttccgtaaggtcgggtaccggtacccggaagggtccgaaagggtaacgggaccggtaacgggtcgttaacggacctttaagtttacttacggtactaaccgtacgaaacacggtaaccaccgttaagtttacggtttaaactgtttcgttaacgttaccgaacgttcggaacctaccggtaacggttcccgtaacccggttcggtacccgggttacaacccggttaccccgaaacccggggtccctaaacccccgngtttccccggtaaccc

SEQ ID NO: 122079 - DNA, 679 bp, Homo sapiens
  misc_feature: GYAE6OF02G2YRF.52.38.D05.1.454.CMB.1.raw
  modified_base (228)..(228): a, c, t, g, unknown or other
  misc_feature (228)..(228): n is a, c, g, or t
  modified_base (527)..(527): a, c, t, g, unknown or other
  misc_feature (527)..(527): n is a, c, g, or t
  modified_base (538)..(538): a, c, t, g, unknown or other
  misc_feature (538)..(538): n is a, c, g, or t
  modified_base (639)..(639): a, c, t, g, unknown or other
  misc_feature (639)..(639): n is a, c, g, or t
  modified_base (672)..(672): a, c, t, g, unknown or other
  misc_feature (672)..(672): n is a, c, g, or t
tcagcgcagtacgacacgaccggtgctcgatttagtatctgatagttgggtttggggctgtgggtccaggaggcagaactctgggtgtctcaccatggcctggatccctctacttcctcccctcctcactctctgcacaggctctgaggccctcctatgagctgacacacgcccaccctcggtgtcagtcgtccccaggacagacggccaggatcacctgctctgganatgctattcgaccaaaaccgtatactgtcttaagttcggtaccagacaaggaacggtccgggccacggccccctggttcgttggtagattagtaataaacggactacgtggaacgacggccctacggagggtactcccgtagacgcgtatcgtcgtggaccctcgaggggtacgtacggggaaacgacggtacaacgtacgttcggtaccaacttacggagggttaggaccgttaccggaagggaccgtaagggggaacggtaacggacggtaccgtagtaaaccgttaattttacggnttaaccgtaanaaccgtaaacgacgaccaaccgttagttacggtttaacttagtcgttaccgtacgacgtagaccggttaacgaccggttacgacccggttcgacggtaccnccggtacccggaacgtaccccgaacctaccgtntaccccg

SEQ ID NO: 122080 - DNA, 609 bp, Homo sapiens
  misc_feature: GYAE6OF02HI48Z.52.38.D05.1.454.CMB.1.raw
  modified_base (286)..(286): a, c, t, g, unknown or other
  misc_feature (286)..(286): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcactgctctggagatgcattcgaccaaaccgatatgcttattcggtacagcagacgccggccaggccctgtgttggngatgtaataaagcagtgacgacggccctgagggtactccgtgacgcgtattctctggctcgaggtcagggaccaacggtcacgtagttcggacctagtacgaggtggacgtccgaggtacgagggacggaacggaggtcgtagtaactttattacgttacgtacaacgtacaaacgtagaccgtaagttacggttagttaacttagtgtacgtacgttacgggttccgggaacgggaacgggtaaccgtagtccgtaaccggttaccccgtacggttacggtccgaaccggtacccgaacgggtccctcccggttacccccgg

SEQ ID NO: 122081 - DNA, 712 bp, Homo sapiens
  misc_feature: GYAE6OF02G7ECO.52.38.D05.1.454.CMB.1.raw
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctctatgagctgacacagccaccctggtgtcagtgtccccaggacagaccggccaggatcacctgctcgtaggagatgacctattcgaccaaaccgntatgtacttagtggtaccagcaggaacgcccgggaccacggcccctaggtgttggnagttagtaataaagacacgtgacgacggtcccctgagggtctccggtagaggccgtagttccttacgtgggccttaccggagggtcgaacgggggtaacctaacggggtaccacggtagttaccgggaccctaaggtccgtaaggttagggtaaccgttccggaagggtccgaagggacgggaaccgggtaggacgttacgtaacgtttaattacgttacgtaacctaaagttaccaaacgtaaccgtaaccgaaaccgttaagtttcggttaacttttagtacgttaccggttacggaacttcggtaaccgaaccggttaaacggtcccgttaaccggttccgttaccgggtaacacccgggtaacccgtaaccgtacccccgtaaacccgtacggtaccgtaccccg

SEQ ID NO: 122082 - DNA, 725 bp, Homo sapiens
  misc_feature: GYAE6OF02FWCDV.52.38.D05.1.454.CMB.1.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
tcagcgcagtacgacacgaccggtgctcgatttagtatctgatagttgggtttggggctgtgggtccaggaggcagaactctgggtgtctcaccatggcctggatccctctacttctccccctcctcactctctgccacaggctctgaggcctcctatgagctgaccacagcccacccgtcggtgtcagtcgtccccaggacagaccggccaggntccacctgcctcngganatgcattgaccaaaccgntatgcttattggtaccagcagaacgccgaccaggcccctgtgttggtgatgtataaagacactgagacggccctgagggtactcccgtggacgcgtacttctacgtcggcctacccgtaggtacggaacgggacgtaacgggtccgtaacgtagttacggacctacttccgaggtaggaccggtaccggaacgggtcgaaggtacggggaaacggacgggtaccgttaggtaaccgtttagttttaacgtttcggttaaactaaacgttaccaaaaccgtacgtaaaccctacctaacggttttacggttaacttttaagttcggtttacgttaacccggtaaccgttaccgaccggtaaccgttaaaaccgggtcccttaaacccggttaccccggttaggggtacccaacccgggtaccccggaaacccggtaaccccccgtaaaccccccgttacgttacccgttacccccg

SEQ ID NO: 122083 - DNA, 678 bp, Homo sapiens
  misc_feature: GYAE6OF02IGRGJ.52.38.D05.1.454.CMB.1.raw
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagcgcagtacgacacgaccggtgctcgatttagtatctgatagttgggtttggggctgtgggtccaggaggcagaactctgggtgtctcaccatggcctggactccctctacttcctccccctcctcactctctgcacaggctctgacggccctctatgagctgacacacgcccacccgtcggtgtcagtcgtcccgaggacaggacggccaggatcacctgctgtggangtcgcagttaccgaccaacgatatgtacttagtcggtacagacgaaggacggccggcgaccggcccttgtgtgtnagtagtaanaagcagtgacgacggcctggacggactccgagacgcgtacttcctcggtacgcctacggaggtaccggaacgggtaaccacggtcaacttaggtccgactagcgtaggcggtacaccgaggacgacgggaacggtacggacggtacgtaccgttaagtttaagtttacgtaacgtacaaagttaaccggaaacaacggttaccctaaacgtttacgttttaacgtttaacttagtttaccggttaccttaacgggaacgtaccggaccggtaacgggtaacccgtccgtaccgggttcgtaccggaaccgtcccggaacccggtaaacccggaccccttaacccggaccgttaccgtaaccc

SEQ ID NO: 122084 - DNA, 819 bp, Homo sapiens
  misc_feature: GYAE6OF02FS5JG.52.38.D05.1.454.CMB.1.raw
  modified_base (184)..(184): a, c, t, g, unknown or other
  misc_feature (184)..(184): n is a, c, g, or t
tcagcgcagtacgacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgagctgaccacacgccaccctcggtntcagttcgtccccaggacacggaccggccgaaggtactacaccctcgtactcgtaggagtactcgcacttacgaccaaacgtatatcgtcttacgttcggtaaccagtacgaaggaacggcccgggacctaccggtcccttaggttggttacgggtagtaacgttgtaaacgttaaacgaccgaagttacggaacggaaccggtccccgtcgggaacggtaccctcccgtaaggacgtccgttatttaccgtccgtacggtaccgtacccggtacggttacggaacgggtaacccggtaacggtacccaacgttacggttacgtcctacgtacgacgggttcggtaccggtaacggacggaccggtaaggaaccggggtaaccgacggtaccgtacggtaacttttaacgttacgttacgtaccttaaacacggtaaaccgtaacgttaaccgaacggttttaccttaaggtttaaccgtttaaggttacccgtttacggttaccggttaacttcgggaacccgtaaccggttaacccggttaccgttaacccgggttacggttaccgggttacccgacccggtaaccccggtaaccgggtacccccctaccgttacccgttaccggttaccccc

SEQ ID NO: 122085 - DNA, 643 bp, Homo sapiens
  misc_feature: GYAE6OF02FO0UM.52.38.D05.1.454.CMB.1.raw
tcagcgcagtacgacacgaccggtgctcgatttagtatctgatagttgggtttggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcaccgtgctcgtggagatgcattcgaccaaaaccgatatgcttagttcgtaccagacaagaacggccggaccacggtcccctgtgttcggtgagtagtaactaaagactacgtagacgacggtccctaggacgggactccgtgacgcgtactcgtacgtcggcctacgacggtacgacgggactacggtacacgtacgtcgactacgttcgaacggttggacgtcgaacggtcgaagggagggtacggacgtacgttagaactttattaggttgtaacgtaataccgaaacacgaacctaccgtacggtttaagttacttagttcgttaccgttacggtaacgtcgtaaccgaaccgtaacggtcctaccgggtccgtaggaccggaccgtacccggtaaaccgaacccctaccgtccgtacgtaacccg

SEQ ID NO: 122086 - DNA, 794 bp, Homo sapiens
  misc_feature: GYAE6OF02F5OZ2.52.38.D05.1.454.CMB.1.raw
  modified_base (142)..(142): a, c, t, g, unknown or other
  misc_feature (142)..(142): n is a, c, g, or t
  modified_base (483)..(483): a, c, t, g, unknown or other
  misc_feature (483)..(483): n is a, c, g, or t
tcagcgcagtacgacacgaccggtgctcgatttagtatctgatagttggggtttggggctgtgggtccaggaggcagaactctgggtgtctcaccatggcctggactccctctacttcctcccctctcgactctctcgcacncggctctaggacggccttcctagtgacgtcgtacgacacgacgtccctacccgtcggtacgtctacgtcgttaccccggaggaacgcggaccggccgtaaggtactccgaccgttaggcccttaggacggtaacgtacgtacggacttacgttaccggtaacccaaaacggttacttacgtacgtacgtttaacgtacggtaacctaacggtacgtaacggaaccgggtcccggacgtacccgggtaccttgggttaccggttgggtaagtacgttacggtaaacttaaacggaccgtaagtacggtacgaccgggtccctaagggacgggtccttaccgngggtaactcggttaacttccgtacggtcgtccttacggagggttacgacgggtaacaccggtcaacggttctacgacgacgttacgtaggtcggtaccgagacggcggaacggacggtaaccggtagtaccggtattacgttaacgttagttacgactaaacgtacgaactaacggtccaagtttacgttacggtaactttaggtactttaacggaccggttaagtccggtaaccgtaaccggtaggtacccgtaccgttacggaccggtacaaccggtacccgacgtacccggaccctaggttcccaccg

SEQ ID NO: 122087 - DNA, 671 bp, Homo sapiens
  misc_feature: GYAE6OF02INJSK.52.38.D05.1.454.CMB.1.raw
  modified_base (226)..(226): a, c, t, g, unknown or other
  misc_feature (226)..(226): n is a, c, g, or t
tcagcgcagtacgacacgaccggtgctcgatttagtatctgatagttgggtttggggctgtgggtccaggaggcagaactctgggtgtctcaccatggcctggatccctctacttcctccccctcctcactctctgcacaggctctgaggcctcctatgagctgacacagcccaccctggtgtcagtcgtccccaggacagacggcaggatcacctgctcgtgganatgcattcgaccaaaaccgatatgcttattaggtaaccagacaaggaacgcccgggccacggtccccctaggttggttcgggtagagtaggtaataaacgacaactgaaggacggccctacgaagggaccttcccgtaggacgccgtaactcctacgtcggcctaccgaggttacgaaggaacctaacgggtaccaacgtacgtttcggactactcgtaggtagggacgtccgaaggtacaaagggtacggaacggacgtacgtgtaaacttagtttaaccgttgtactaaagtaccaaacgaacgtaccgtaaccgtaatttcggtaactttagttacgttaccgttacggtaactacggtacgtaaccgtaacgtaccgacccggttcgtacgggtacctaacggaccccgtaaaggaccccctaaccgtacccgtgtaaccc

SEQ ID NO: 122088 - DNA, 248 bp, Homo sapiens
  misc_feature: GYAE6OF01BFB1Q.51.16.B05.1.454.CMB.1.raw
  modified_base (248)..(248): a, c, t, g, unknown or other
  misc_feature (248)..(248): n is a, c, g, or t
tcagcgatcgtatacacgaccggtgctcgatttagagctcacgtattggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccgccatctgatcgtagcactctgagcgggctggcaaggcgcatagn

SEQ ID NO: 122089 - DNA, 251 bp, Homo sapiens
  misc_feature: GYAE6OF01C4KQ1.51.16.B05.1.454.CMB.1.raw
  modified_base (251)..(251): a, c, t, g, unknown or other
  misc_feature (251)..(251): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaaggctgccccctcggtcactctgttcccgccatctgatcgtagcactctgagcgggctggcaaggcgcatagn

SEQ ID NO: 122090 - DNA, 251 bp, Homo sapiens
  misc_feature: GYAE6OF01CGMUT.51.16.B05.1.454.CMB.1.raw
  modified_base (250)..(251): a, c, t, g, unknown or other
  misc_feature (250)..(251): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnn

SEQ ID NO: 122091 - DNA, 256 bp, Homo sapiens
  misc_feature: GYAE6OF01DXQ33.51.16.B05.1.454.CMB.1.raw
  modified_base (249)..(256): a, c, t, g, unknown or other
  misc_feature (249)..(256): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggaggaccaagctgaccgtcctaggtcagcccaaggctgcccctcggtcactctgttcccgcatctggatcgtagcactcgtgagcgggctggcaaggcgcatagnnnnnnnn

SEQ ID NO: 122092 - DNA, 254 bp, Homo sapiens
  misc_feature: GYAE6OF01A8UCR.51.16.B05.1.454.CMB.1.raw
  modified_base (250)..(254): a, c, t, g, unknown or other
  misc_feature (250)..(254): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnn

SEQ ID NO: 122093 - DNA, 281 bp, Homo sapiens
  misc_feature: GYAE6OF01EKUA4.51.16.B05.1.454.CMB.1.raw
  modified_base (250)..(250): a, c, t, g, unknown or other
  misc_feature (250)..(250): n is a, c, g, or t
  modified_base (252)..(281): a, c, t, g, unknown or other
  misc_feature (252)..(281): n is a, c, g, or t
tcagcgatcgtatacacgaccggtgctcgatttagagctcacgtagttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnannnnnnnnnnnnnnnnnnnnnnnnnnnnnn

SEQ ID NO: 122094 - DNA, 250 bp, Homo sapiens
  misc_feature: GYAE6OF01C0YS6.51.16.B05.1.454.CMB.1.raw
  modified_base (249)..(250): a, c, t, g, unknown or other
  misc_feature (249)..(250): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggaggaccaagctgaccgtcctaggtcagcccaaggctgccccctcggtcactctgttcccgccatctgatcgtagcactctgagcgggctggcaaggcgcatagnn

SEQ ID NO: 122095 - DNA, 252 bp, Homo sapiens
  misc_feature: GYAE6OF01D0EG6.51.16.B05.1.454.CMB.1.raw
  modified_base (250)..(252): a, c, t, g, unknown or other
  misc_feature (250)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnn

SEQ ID NO: 122096 - DNA, 252 bp, Homo sapiens; identical to SEQ ID NO: 122095
  misc_feature: GYAE6OF01DRPD5.51.16.B05.1.454.CMB.1.raw
  modified_base (250)..(252): a, c, t, g, unknown or other
  misc_feature (250)..(252): n is a, c, g, or t

SEQ ID NO: 122097 - DNA, 253 bp, Homo sapiens
  misc_feature: GYAE6OF01EFNV0.51.16.B05.1.454.CMB.1.raw
  modified_base (250)..(253): a, c, t, g, unknown or other
  misc_feature (250)..(253): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnn

SEQ ID NO: 122098 - DNA, 251 bp, Homo sapiens; identical to SEQ ID NO: 122090
  misc_feature: GYAE6OF01BQHQG.51.16.B05.1.454.CMB.1.raw
  modified_base (250)..(251): a, c, t, g, unknown or other
  misc_feature (250)..(251): n is a, c, g, or t

SEQ ID NO: 122099 - DNA, 251 bp, Homo sapiens
  misc_feature: GYAE6OF01D915A.51.16.B05.1.454.CMB.1.raw
  modified_base (249)..(251): a, c, t, g, unknown or other
  misc_feature (249)..(251): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggatggaccaagctgaccgtcctaggtcagcccaaggctgccccctggtcactctgttcccgccatctgatcgtagcactctgagcgggctggcaaggcgcatagnnn

SEQ ID NO: 122100 - DNA, 251 bp, Homo sapiens; identical to SEQ ID NO: 122090
  misc_feature: GYAE6OF01BLJR5.51.16.B05.1.454.CMB.1.raw
  modified_base (250)..(251): a, c, t, g, unknown or other
  misc_feature (250)..(251): n is a, c, g, or t

SEQ ID NO: 122101 - DNA, 253 bp, Homo sapiens; identical to SEQ ID NO: 122097
  misc_feature: GYAE6OF01DXM5N.51.16.B05.1.454.CMB.1.raw
  modified_base (250)..(253): a, c, t, g, unknown or other
  misc_feature (250)..(253): n is a, c, g, or t

SEQ ID NO: 122102 - DNA, 277 bp, Homo sapiens
  misc_feature: GYAE6OF01A5YGD.51.16.B05.1.454.CMB.1.raw
  modified_base (253)..(277): a, c, t, g, unknown or other
  misc_feature (253)..(277): n is a, c, g, or t
tcagcgatcgtatacacgaccggtgctcgatttagagctcacgtattgggggcgaaagctgccctggaccctttcgggtgccgcagtcctgaggtatgaggctgagtattactgcttgctctcctatagtggtgttcgggtgttcggcggagggaccaagctgaccgtcctaggtcagcccaaggctgccccctggtcactctgttcccgccagtctgatcgtagcactgagcgggctggcaaggcgcatagnnnnnnnnnnnnnnnnnnnnnnnnn

SEQ ID NO: 122103 - DNA, 277 bp, Homo sapiens
  misc_feature: GYAE6OF01DGADJ.51.16.B05.1.454.CMB.1.raw
  modified_base (251)..(277): a, c, t, g, unknown or other
  misc_feature (251)..(277): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcagtagnnnnnnnnnnnnnnnnnnnnnnnnnnn

SEQ ID NO: 122104 - DNA, 254 bp, Homo sapiens; identical to SEQ ID NO: 122092
  misc_feature: GYAE6OF01AXMCM.51.16.B05.1.454.CMB.1.raw
  modified_base (250)..(254): a, c, t, g, unknown or other
  misc_feature (250)..(254): n is a, c, g, or t

SEQ ID NO: 122105 - DNA, 250 bp, Homo sapiens
  misc_feature: GYAE6OF01A7O8M.51.16.B05.1.454.CMB.1.raw
  modified_base (250)..(250): a, c, t, g, unknown or other
  misc_feature (250)..(250): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttagggtgttcggcggagggaccaagctgaccgtcctaggtcagcccaaggctgccccctcggtcactctgttcccgccatctgatcgtagcactctgagcgggctggcaaggcgcatagn

SEQ ID NO: 122106 - DNA, 253 bp, Homo sapiens
  misc_feature: GYAE6OF01B07RG.51.16.B05.1.454.CMB.1.raw
  modified_base (249)..(253): a, c, t, g, unknown or other
  misc_feature (249)..(253): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnnnnn

SEQ ID NO: 122107 - DNA, 253 bp, Homo sapiens; identical to SEQ ID NO: 122097
  misc_feature: GYAE6OF01B1FG0.51.16.B05.1.454.CMB.1.raw
  modified_base (250)..(253): a, c, t, g, unknown or other
  misc_feature (250)..(253): n is a, c, g, or t

SEQ ID NO: 122108 - DNA, 294 bp, Homo sapiens
  misc_feature: GYAE6OF01D77U9.51.16.B05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (261)..(294): a, c, t, g, unknown or other
  misc_feature (261)..(294): n is a, c, g, or t
tcagcgatcgtatacacgaccggtgctcgatttagagctcacgtattggggggcaaagctagccctgaccctttcgggtggcgcagcctgaggatgaggctgagtacttaactgcttgtctctcctatagtggtgttcggggtgtttcggcggaggggaccaaggctgaccgtcctaggtcagcccaaggctgccccctggtnactctgttcccgcagtctgatcgtagcactctgancgggctaggcaaggtcncatagnnnnnnnnnnnnnnnnnnnnnnnnnnnnnnnnnn

SEQ ID NO: 122109 - DNA, 252 bp, Homo sapiens
  misc_feature: GYAE6OF01DK1S3.51.16.B05.1.454.CMB.1.raw
  modified_base (251)..(252): a, c, t, g, unknown or other
  misc_feature (251)..(252): n is a, c, g, or t
tcagcgatcgtatacacgaccggtgctcgatttagagctcacgtagttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnn

SEQ ID NO: 122110 - DNA, 254 bp, Homo sapiens; identical to SEQ ID NO: 122092
  misc_feature: GYAE6OF01CISSV.51.16.B05.1.454.CMB.1.raw
  modified_base (250)..(254): a, c, t, g, unknown or other
  misc_feature (250)..(254): n is a, c, g, or t

SEQ ID NO: 122111 - DNA, 253 bp, Homo sapiens; identical to SEQ ID NO: 122106
  misc_feature: GYAE6OF01BPUQZ.51.16.B05.1.454.CMB.1.raw
  modified_base (249)..(253): a, c, t, g, unknown or other
  misc_feature (249)..(253): n is a, c, g, or t

SEQ ID NO: 122112 - DNA, 273 bp, Homo sapiens
  misc_feature: GYAE6OF01BJ850.51.16.B05.1.454.CMB.1.raw
  modified_base (253)..(273): a, c, t, g, unknown or other
  misc_feature (253)..(273): n is a, c, g, or t
tcagcgatcgtatacacgaccggtgctcgatttagagctcacgtattggggggcaaagctgccctgaccctttcgggtgcgcagcctgaggatgacggctgagtattactgcttgctctcctatagtggtgttcgggtgttcggcggagggaccaagctgaccgtcctaggtcagcccaaggcctgccccctcggtcactctgttcccgccatctgatcgtagcactctgagcgggctggcaaggcgcatagnnnnnnnnnnnnnnnnnnnnn

SEQ ID NO: 122113 - DNA, 252 bp, Homo sapiens; identical to SEQ ID NO: 122095
  misc_feature: GYAE6OF01AUSSL.51.16.B05.1.454.CMB.1.raw
  modified_base (250)..(252): a, c, t, g, unknown or other
  misc_feature (250)..(252): n is a, c, g, or t

SEQ ID NO: 122114 - DNA, 253 bp, Homo sapiens; identical to SEQ ID NO: 122097
  misc_feature: GYAE6OF01EV26V.51.16.B05.1.454.CMB.1.raw
  modified_base (250)..(253): a, c, t, g, unknown or other
  misc_feature (250)..(253): n is a, c, g, or t

SEQ ID NO: 122115 - DNA, 254 bp, Homo sapiens; identical to SEQ ID NO: 122092
  misc_feature: GYAE6OF01D2W64.51.16.B05.1.454.CMB.1.raw
  modified_base (250)..(254): a, c, t, g, unknown or other
  misc_feature (250)..(254): n is a, c, g, or t

SEQ ID NO: 122116 - DNA, 295 bp, Homo sapiens
  misc_feature: GYAE6OF01BAJBM.51.16.B05.1.454.CMB.1.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (257)..(295): a, c, t, g, unknown or other
  misc_feature (257)..(295): n is a, c, g, or t
tcagcgatcgtatacacgaccggtgctcgatttagagctcacgtattggggggcgaaagctgccctgaccctttcgggtgcgcagcctgaggatgaggctgagtattactgtccttgctctcctatagtggtgttcgggtgttcggcggagggaccaagctgaccgtcctaggtcagcccaaggctgccccctggtcactctgttcccgcatctgatcgtancactctggagcgggctggcaaggtcgcattagngnnnnnnnnnnnnnnnnnnnnnnnnnnnnnnnnnnnnnnn

SEQ ID NO: 122117 - DNA, 254 bp, Homo sapiens; identical to SEQ ID NO: 122092
  misc_feature: GYAE6OF01DGTJS.51.16.B05.1.454.CMB.1.raw
  modified_base (250)..(254): a, c, t, g, unknown or other
  misc_feature (250)..(254): n is a, c, g, or t

SEQ ID NO: 122118 - DNA, 252 bp, Homo sapiens; identical to SEQ ID NO: 122095
  misc_feature: GYAE6OF01CAL9X.51.16.B05.1.454.CMB.1.raw
  modified_base (250)..(252): a, c, t, g, unknown or other
  misc_feature (250)..(252): n is a, c, g, or t

SEQ ID NO: 122119 - DNA, 253 bp, Homo sapiens; identical to SEQ ID NO: 122097
  misc_feature: GYAE6OF01DSOD2.51.16.B05.1.454.CMB.1.raw
  modified_base (250)..(253): a, c, t, g, unknown or other
  misc_feature (250)..(253): n is a, c, g, or t

SEQ ID NO: 122120 - DNA, 252 bp, Homo sapiens; identical to SEQ ID NO: 122095
  misc_feature: GYAE6OF01EXZ2C.51.16.B05.1.454.CMB.1.raw
  modified_base (250)..(252): a, c, t, g, unknown or other
  misc_feature (250)..(252): n is a, c, g, or t

SEQ ID NO: 122121 - DNA, 252 bp, Homo sapiens
  misc_feature: GYAE6OF01A1TZS.51.16.B05.1.454.CMB.1.raw
  modified_base (249)..(252): a, c, t, g, unknown or other
  misc_feature (249)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccctcctcacgcactcgtctgagcgggctggcaaggcgcatagnnnn

SEQ ID NO: 122122 - DNA, 251 bp, Homo sapiens
  misc_feature: GYAE6OF01EXIEW.51.16.B05.1.454.CMB.1.raw
  modified_base (250)..(251): a, c, t, g, unknown or other
  misc_feature (250)..(251): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcgggcggagggaccaagctgaccgtcctaggtcagcccaaggctgccccctggtcactctgttcccgcatctgatcgtagcactctggagcgggctggcaaggcgcatagnn

SEQ ID NO: 122123 - DNA, 252 bp, Homo sapiens; identical to SEQ ID NO: 122095
  misc_feature: GYAE6OF01D3MO5.51.16.B05.1.454.CMB.1.raw
  modified_base (250)..(252): a, c, t, g, unknown or other
  misc_feature (250)..(252): n is a, c, g, or t

SEQ ID NO: 122124 - DNA, 250 bp, Homo sapiens
  misc_feature: GYAE6OF01DS7W7.51.16.B05.1.454.CMB.1.raw
  modified_base (250)..(250): a, c, t, g, unknown or other
  misc_feature (250)..(250): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagn

SEQ ID NO: 122125 - DNA, 255 bp, Homo sapiens
  misc_feature: GYAE6OF01CS0WU.51.16.B05.1.454.CMB.1.raw
  modified_base (249)..(255): a, c, t, g, unknown or other
  misc_feature (249)..(255): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgcatcctgatcgtagcactctgagcgggctggcaaggcgcatagnnnnnnn

SEQ ID NO: 122126 - DNA, 250 bp, Homo sapiens; identical to SEQ ID NO: 122124
  misc_feature: GYAE6OF01DYZRS.51.16.B05.1.454.CMB.1.raw
  modified_base (250)..(250): a, c, t, g, unknown or other
  misc_feature (250)..(250): n is a, c, g, or t

SEQ ID NO: 122127 - DNA, 252 bp, Homo sapiens
  misc_feature: GYAE6OF01ETSRB.51.16.B05.1.454.CMB.1.raw
  modified_base (250)..(252): a, c, t, g, unknown or other
  misc_feature (250)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcacgcactcgtctgagcgggctggcaaggcgcatagnnn

SEQ ID NO: 122128 - DNA, 252 bp, Homo sapiens; identical to SEQ ID NO: 122095
  misc_feature: GYAE6OF01BV2KE.51.16.B05.1.454.CMB.1.raw
  modified_base (250)..(252): a, c, t, g, unknown or other
  misc_feature (250)..(252): n is a, c, g, or t

SEQ ID NO: 122129 - DNA, 252 bp, Homo sapiens
  misc_feature: GYAE6OF01A6SAM.51.16.B05.1.454.CMB.1.raw
  modified_base (249)..(252): a, c, t, g, unknown or other
  misc_feature (249)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgcatctgatcgtagcactctgagcgggctggcaaggcgcatagnnnn

SEQ ID NO: 122130 - DNA, 252 bp, Homo sapiens
  misc_feature: GYAE6OF01DZJ01.51.16.B05.1.454.CMB.1.raw
  modified_base (250)..(252): a, c, t, g, unknown or other
  misc_feature (250)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggaggaccaagctgaccgtcctaggtcagcccaaggctcgccccctcggtcactctgttcccgccatctgatcgtagcactctgagcgggctggcaaggcgcatagnnn

SEQ ID NO: 122131 - DNA, 252 bp, Homo sapiens; identical to SEQ ID NO: 122095
  misc_feature: GYAE6OF01DSNMG.51.16.B05.1.454.CMB.1.raw
  modified_base (250)..(252): a, c, t, g, unknown or other
  misc_feature (250)..(252): n is a, c, g, or t

SEQ ID NO: 122132 - DNA, 253 bp, Homo sapiens
  misc_feature: GYAE6OF01CRIHI.51.16.B05.1.454.CMB.1.raw
  modified_base (250)..(253): a, c, t, g, unknown or other
  misc_feature (250)..(253): n is a, c, g, or t
tcagcgatcgtatacacgaccggtgctcgatttagagctcacgtattgggggcaaagctgccctgaccctttcgggtgcgcatcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnn

SEQ ID NO: 122133 - DNA, 289 bp, Homo sapiens
  misc_feature: GYAE6OF01AIQRQ.51.16.B05.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (259)..(289): a, c, t, g, unknown or other
  misc_feature (259)..(289): n is a, c, g, or t
tcagcgatcgtatacacgaccggtgctcgatttagagctcacgtattggggggcgaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcacttctgttcccgccatctgatcgtagcactctgagcggctggcaaggcncatagnatgatgcnnnnnnnnnnnnnnnnnnnnnnnnnnnnnnn

SEQ ID NO: 122134 - DNA, 252 bp, Homo sapiens
  misc_feature: GYAE6OF01DVXO8.51.16.B05.1.454.CMB.1.raw
  modified_base (248)..(252): a, c, t, g, unknown or other
  misc_feature (248)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtctaggtcagcccaaggctgccccctggtcactctgttcccgccatctgatcgtagcactctgagcgggctggcaaggcgcatagnnnnn

SEQ ID NO: 122135 - DNA, 254 bp, Homo sapiens
  misc_feature: GYAE6OF01BWX2U.51.16.B05.1.454.CMB.1.raw
  modified_base (248)..(254): a, c, t, g, unknown or other
  misc_feature (248)..(254): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgcatctgatcgtagcactctgagcgggctggcaaggcgcatagnnnnnnn

SEQ ID NO: 122136 - DNA, 251 bp, Homo sapiens
  misc_feature: GYAE6OF01BODPT.51.16.B05.1.454.CMB.1.raw
  modified_base (241)..(241): a, c, t, g, unknown or other
  misc_feature (241)..(241): n is a, c, g, or t
  modified_base (247)..(251): a, c, t, g, unknown or other
  misc_feature (247)..(251): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgtcccgcatctgatcgtagcactctgagcgggctggcaaggcncatagnnnnn

SEQ ID NO: 122137 - DNA, 257 bp, Homo sapiens
  misc_feature: GYAE6OF01D9I8D.51.16.B05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (247)..(257): a, c, t, g, unknown or other
  misc_feature (247)..(257): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggaggaccaagctgaccgtctaggtcagcccaaggctgccccctggtcactctgtcccnccctctcacgcactcgtctgagcgggctggcaagggcncatagnnnnnnnnnnn

SEQ ID NO: 122138 - DNA, 251 bp, Homo sapiens
  misc_feature: GYAE6OF01EOMAG.51.16.B05.1.454.CMB.1.raw
  modified_base (249)..(251): a, c, t, g, unknown or other
  misc_feature (249)..(251): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctgtcactctgttcccgccatctgatcgtagcactctgagcgggctggcaaggcgcatagnnn

SEQ ID NO: 122139 - DNA, 263 bp, Homo sapiens
  misc_feature: GYAE6OF01ESYZM.51.16.B05.1.454.CMB.1.raw
  modified_base (257)..(263): a, c, t, g, unknown or other
  misc_feature (257)..(263): n is a, c, g, or t
tcagcgatcgtatacacgaccggtgctcgatttagagctcacgtattggggggcaaagctgccctgaccctttcgggtgcgcagcctgaggatgaggctgagtattactgcttgctctctatagtggtgttcgggtgttcgggcggaggaccaagctgaccgtcctaggtcagcccaaggcctcgcccctcggtcactctcgttcccgcatctgactcgtagcactctggacggcggctggacaacggcgacatagnnnnnnn

SEQ ID NO: 122140 - DNA, 257 bp, Homo sapiens
  misc_feature: GYAE6OF01BEFF8.51.16.B05.1.454.CMB.1.raw
  modified_base (252)..(257): a, c, t, g, unknown or other
  misc_feature (252)..(257): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgtcccgccatctgatcgtagcactctgagcgggctggacaggcgcatagnnnnnn

SEQ ID NO: 122141 - DNA, 259 bp, Homo sapiens
  misc_feature: GYAE6OF01AU7RW.51.16.B05.1.454.CMB.1.raw
  modified_base (252)..(259): a, c, t, g, unknown or other
  misc_feature (252)..(259): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctcgttcccgccatctgatcgtagcactcgtgagcgggctggcaaggcgcatagnnnnnnnn

SEQ ID NO: 122142 - DNA, 255 bp, Homo sapiens
  misc_feature: GYAE6OF01B23K1.51.16.B05.1.454.CMB.1.raw
  modified_base (223)..(223): a, c, t, g, unknown or other
  misc_feature (223)..(223): n is a, c, g, or t
  modified_base (249)..(255): a, c, t, g, unknown or other
  misc_feature (249)..(255): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggaggaccaagctgaccgtctaggtcagcccaaggctcgcccctggtcactctcgtcccgcatctgatcgtagcactcngagcgggctggcaacggcgacatagnnnnnnn

SEQ ID NO: 122143 - DNA, 264 bp, Homo sapiens
  misc_feature: GYAE6OF01AR3O0.51.16.B05.1.454.CMB.1.raw
  modified_base (249)..(264): a, c, t, g, unknown or other
  misc_feature (249)..(264): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctgttcccgcatctgatcgagcactctgaggcggctggacaggcgcatagnnnnnnnnnnnnnnnn

SEQ ID NO: 122144 - DNA, 262 bp, Homo sapiens
  misc_feature: GYAE6OF01ARJ1F.51.16.B05.1.454.CMB.1.raw
  modified_base (257)..(262): a, c, t, g, unknown or other
  misc_feature (257)..(262): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctgttcccgcatctgatcgtagctactcgtgagcgggctgggcaagggcgactatagnnnnnn

SEQ ID NO: 122145 - DNA, 317 bp, Homo sapiens
  misc_feature: GYAE6OF01EDNQG.51.16.B05.1.454.CMB.1.raw
  modified_base (275)..(275): a, c, t, g, unknown or other
  misc_feature (275)..(275): n is a, c, g, or t
  modified_base (277)..(317): a, c, t, g, unknown or other
  misc_feature (277)..(317): n is a, c, g, or t
tcagcgatcgtatacacgaccggtgctcgatttagagctcacgtattgggggggcaaagctgccctgaccctttcgggtgcgcagcctgaggatgaggctgagtattactgccttgctctcctatagtggtgttcgggtgttcgggcggagggaccaagctgtaccgtcctaggtcaacgcccaaggcctcgccccctcggtcactctcgttcccgcctatcgtgacgtcggtacgctactcctggcggcgggctggaccgaagggccatatagncnnnnnnnnnnnnnnnnnnnnnnnnnnnnnnnnnnnnnnnnn

SEQ ID NO: 122146 - DNA, 259 bp, Homo sapiens
  misc_feature: GYAE6OF01ANL0M.51.16.B05.1.454.CMB.1.raw
  modified_base (248)..(259): a, c, t, g, unknown or other
  misc_feature (248)..(259): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgcatctgatcgtagcactctgagcgggctggcaaggcgcatagnnnnnnnnnnnn

SEQ ID NO: 122147 - DNA, 307 bp, Homo sapiens
  misc_feature: GYAE6OF01B7NB9.51.16.B05.1.454.CMB.1.raw
  modified_base (80)..(80): a, c, t, g, unknown or other
  misc_feature (80)..(80): n is a, c, g, or t
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (264)..(265): a, c, t, g, unknown or other
  misc_feature (264)..(265): n is a, c, g, or t
  modified_base (270)..(307): a, c, t, g, unknown or other
  misc_feature (270)..(307): n is a, c, g, or t
tcagcgatcgtatacacgaccggtgctcgatttagagctcacgtagttgggggggcaaagctgccctgaccctttcgggngcgcagcctgaggatgaggctgagtattactgcttgctctctatagtggtgttcgggtgtcggaggaggaccaagctcgaccgtctaaggtcacgcccaaggcctccgccccctggtcactcgtcgtccccgcctcgcacgcactcgtacnggacggcgggctaggacgaagggccanagagcnngcagnnnnnnnnnnnnnnnnnnnnnnnnnnnnnnnnnnnnnn

SEQ ID NO: 122148 - DNA, 276 bp, Homo sapiens
  misc_feature: GYAE6OF01BBIYJ.51.16.B05.1.454.CMB.1.raw
  modified_base (226)..(226): a, c, t, g, unknown or other
  misc_feature (226)..(226): n is a, c, g, or t
  modified_base (260)..(276): a, c, t, g, unknown or other
  misc_feature (260)..(276): n is a, c, g, or t
tcagcgatcgtatacacgaccggtgctcgatttagagctcacgtattggggggcaaagctgccctgaccctttcgggtgcgcagcctgaggatgaggctgagtattactgcttgctctctatagtggtgttcgggtgttcggcggagggaccaagctgaccgtctaggtcagcccaggcctcgccccctcggtcactcgtcgttcccgcatctgatcgtagcactntggaggcgggctcgggacgaacggcgacagtagnnnnnnnnnnnnnnnnn

SEQ ID NO: 122149 - DNA, 328 bp, Homo sapiens
  misc_feature: GYAE6OF01EY1HP.51.16.B05.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (287)..(287): a, c, t, g, unknown or other
  misc_feature (287)..(287): n is a, c, g, or t
  modified_base (294)..(328): a, c, t, g, unknown or other
  misc_feature (294)..(328): n is a, c, g, or t
tcagcgatcgtatacacgaccggtgctcgatttagagctcacgtagttggggggcaaagctgccctgaccccgtttcgggtgcgcagcctgaggatgaggctgatattactgcttgctcctctatagtggtgttcgggtgttcgggcggaggaccaagtcctagaccgtccgtaggtccacgcccgaaggcctccgcccccgtggtctaccttccgtcgtccccactatcgtgactcgtanacctaccttcgnggacggtcgggccgtacggaacgaacggccgtanaagtgcnnnnnnnnnnnnnnnnnnnnnnnnnnnnnnnnnnn

SEQ ID NO: 122150 - DNA, 246 bp, Homo sapiens
  misc_feature: GYAE6OF02H7YHR.51.16.B05.1.454.CMB.1.raw
  modified_base (245)..(246): a, c, t, g, unknown or other
  misc_feature (245)..(246): n is a, c, g, or t
tcagcgatcgtatacacgaccggtgctcgatttagagctcacgtattgggcaaagctgccctgacccttcggtgcgcagcctgaggatgaggctgagtattactgcttgctctcctatagtggtgttcgggtgttcggcggagggaccaagctgaccgtcctaggtcagcccaaggctgcccctcggtcactctgttcccgccatctgatcgtagcactctgagcgggctggcaaggcgcatagnn

SEQ ID NO: 122151 - DNA, 257 bp, Homo sapiens
  misc_feature: GYAE6OF02H1U0O.51.16.B05.1.454.CMB.1.raw
  modified_base (251)..(257): a, c, t, g, unknown or other
  misc_feature (251)..(257): n is a, c, g, or t
tcagcgatcgtatacacgaccggtgctcgatttagagctcacgtattgggggcgaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnnnn

SEQ ID NO: 122152 - DNA, 250 bp, Homo sapiens
  misc_feature: GYAE6OF02FU0QF.51.16.B05.1.454.CMB.1.raw
  modified_base (249)..(250): a, c, t, g, unknown or other
  misc_feature (249)..(250): n is a, c, g, or t
tcagcgatcgtatacacgaccggtgctcgatttagagctcacgtattggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnn

SEQ ID NO: 122153 - DNA, 251 bp, Homo sapiens; identical to SEQ ID NO: 122090
  misc_feature: GYAE6OF02FN0FU.51.16.B05.1.454.CMB.1.raw
  modified_base (250)..(251): a, c, t, g, unknown or other
  misc_feature (250)..(251): n is a, c, g, or t

SEQ ID NO: 122154 - DNA, 251 bp, Homo sapiens; identical to SEQ ID NO: 122090
  misc_feature: GYAE6OF02HC0DZ.51.16.B05.1.454.CMB.1.raw
  modified_base (250)..(251): a, c, t, g, unknown or other
  misc_feature (250)..(251): n is a, c, g, or t

SEQ ID NO: 122155 - DNA, 257 bp, Homo sapiens
  misc_feature: GYAE6OF02GLUU8.51.16.B05.1.454.CMB.1.raw
  modified_base (250)..(257): a, c, t, g, unknown or other
  misc_feature (250)..(257): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnnnnn

SEQ ID NO: 122156 - DNA, 252 bp, Homo sapiens
  misc_feature: GYAE6OF02JGTZ3.51.16.B05.1.454.CMB.1.raw
  modified_base (248)..(252): a, c, t, g, unknown or other
  misc_feature (248)..(252): n is a, c, g, or t
tcagcgatcgtatacacgaccggtgctcgatttagagctcacgtattggggcaaagctgccctgaccctttcggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnn

SEQ ID NO: 122157 - DNA, 308 bp, Homo sapiens
  misc_feature: GYAE6OF02HCC6O.51.16.B05.1.454.CMB.1.raw
  modified_base (252)..(254): a, c, t, g, unknown or other
  misc_feature (252)..(254): n is a, c, g, or t
  modified_base (259)..(308): a, c, t, g, unknown or other
  misc_feature (259)..(308): n is a, c, g, or t
tcagcgatcgtatacacgaccggtgctcgatttagagctcacgtagttggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctggatcgtagcactctgagcgggctggcaaggcgcatagnnngatcnnnnnnnnnnnnnnnnnnnnnnnnnnnnnnnnnnnnnnnnnnnnnnnnnn

SEQ ID NO: 122158 - DNA, 252 bp, Homo sapiens; identical to SEQ ID NO: 122095
  misc_feature: GYAE6OF02IM2VP.51.16.B05.1.454.CMB.1.raw
  modified_base (250)..(252): a, c, t, g, unknown or other
  misc_feature (250)..(252): n is a, c, g, or t

SEQ ID NO: 122159 - DNA, 252 bp, Homo sapiens; identical to SEQ ID NO: 122095
  misc_feature: GYAE6OF02HULVF.51.16.B05.1.454.CMB.1.raw
  modified_base (250)..(252): a, c, t, g, unknown or other
  misc_feature (250)..(252): n is a, c, g, or t

SEQ ID NO: 122160 - DNA, 254 bp, Homo sapiens; identical to SEQ ID NO: 122092
  misc_feature: GYAE6OF02JFMUZ.51.16.B05.1.454.CMB.1.raw
  modified_base (250)..(254): a, c, t, g, unknown or other
  misc_feature (250)..(254): n is a, c, g, or t

SEQ ID NO: 122161 - DNA, 252 bp, Homo sapiens
  misc_feature: GYAE6OF02H8OZY.51.16.B05.1.454.CMB.1.raw
  modified_base (248)..(252): a, c, t, g, unknown or other
  misc_feature (248)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggaggaccaagctgaccgtcctaggtcagcccaaggctgccccctggtcactctgttcccgccatctgatcgtagcactctgagcgggctggcaaggcgcatagnnnnn

SEQ ID NO: 122162 - DNA, 251 bp, Homo sapiens
  misc_feature: GYAE6OF02HQPKZ.51.16.B05.1.454.CMB.1.raw
  modified_base (250)..(251): a, c, t, g, unknown or other
  misc_feature (250)..(251): n is a, c, g, or t
tcagcgatcgtatacacgaccggtgctcgatttagagctcacgtattgggggcaaagctgccccgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnn

SEQ ID NO: 122163 - DNA, 253 bp, Homo sapiens; identical to SEQ ID NO: 122097
  misc_feature: GYAE6OF02IFYZE.51.16.B05.1.454.CMB.1.raw
  modified_base (250)..(253): a, c, t, g, unknown or other
  misc_feature (250)..(253): n is a, c, g, or t

SEQ ID NO: 122164 - DNA, 318 bp, Homo sapiens
  misc_feature: GYAE6OF02I3ISB.51.16.B05.1.454.CMB.1.raw
  modified_base (268)..(270): a, c, t, g, unknown or other
  misc_feature (268)..(270): n is a, c, g, or t
  modified_base (273)..(318): a, c, t, g, unknown or other
  misc_feature (273)..(318): n is a, c, g, or t
tcagcgatcgtatacacgaccggtgctcgatttagagctcacgtattggggggccaaaagctcgcccctggaccctttcgggtcgcgcagcctgaggatgaggctgagtattactgcttgctcttcctatagtggtgttcgggtgttcggcggagggacccaagcctgtaccgtcctaggtcacgcccaaggctcgccccctcggtcactctcgttcccgccagtctgatcgtagcactctgagcggtctggacaacggcgacatagnnngcnnnnnnnnnnnnnnnnnnnnnnnnnnnnnnnnnnnnnnnnnnnnnn

SEQ ID NO: 122165 - DNA, 248 bp, Homo sapiens; identical to SEQ ID NO: 122088
  misc_feature: GYAE6OF02HFOTR.51.16.B05.1.454.CMB.1.raw
  modified_base (248)..(248): a, c, t, g, unknown or other
  misc_feature (248)..(248): n is a, c, g, or t

SEQ ID NO: 122166 - DNA, 290 bp, Homo sapiens
  misc_feature: GYAE6OF02JYZ3Z.51.16.B05.1.454.CMB.1.raw
  modified_base (256)..(290): a, c, t, g, unknown or other
  misc_feature (256)..(290): n is a, c, g, or t
tcagcgatcgtatacacgaccggtgctcgatttagagctcacgtattgggggcaaagctcgccctgaccctttcgggtgcgcagcctgaggatggacggctgagtattactggcttgctctcctatagtggtgttccgggtgttcggcggagggaccaagctgaccgtcctaggtcagcccaaggctgcccctcggtcactctgttcccgccatctgatcgtagcactctgagcgggctgggcaaggcgcgatagnnnnnnnnnnnnnnnnnnnnnnnnnnnnnnnnnnn

SEQ ID NO: 122167 - DNA, 252 bp, Homo sapiens; identical to SEQ ID NO: 122095
  misc_feature: GYAE6OF02HFQ2F.51.16.B05.1.454.CMB.1.raw
  modified_base (250)..(252): a, c, t, g, unknown or other
  misc_feature (250)..(252): n is a, c, g, or t

SEQ ID NO: 122168 - DNA, 283 bp, Homo sapiens
  misc_feature: GYAE6OF02GNGBH.51.16.B05.1.454.CMB.1.raw
  modified_base (255)..(283): a, c, t, g, unknown or other
  misc_feature (255)..(283): n is a, c, g, or t
tcagcgatcgtatacacgaccggtgctcgatttagagctcacgtattgggggtcgaaagctggccctgaccctttcgggtgcgcagcctgaggactgaggctgagtacttactgcttgctctcctatagtggtgttcgggtgttcggcggagggaccaagctggaccgtcctaggtcagcccaaggctgccccctggtcactctgttcccgccatctgatcgtagcactctgagcgggctggcaaggcgcatagnnnnnnnnnnnnnnnnnnnnnnnnnnnnn

SEQ ID NO: 122169 - DNA, 253 bp, Homo sapiens; identical to SEQ ID NO: 122097
  misc_feature: GYAE6OF02HEHEO.51.16.B05.1.454.CMB.1.raw
  modified_base (250)..(253): a, c, t, g, unknown or other
  misc_feature (250)..(253): n is a, c, g, or t

SEQ ID NO: 122170 - DNA, 254 bp, Homo sapiens
  misc_feature: GYAE6OF02IJ5WP.51.16.B05.1.454.CMB.1.raw
  modified_base (249)..(254): a, c, t, g, unknown or other
  misc_feature (249)..(254): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnnnnnn

SEQ ID NO: 122171 - DNA, 251 bp, Homo sapiens
  misc_feature: GYAE6OF02FSACC.51.16.B05.1.454.CMB.1.raw
  modified_base (250)..(251): a, c, t, g, unknown or other
  misc_feature (250)..(251): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctcttcccgccatctgatcgtagcactctgagcgggctggcaaggcgcatagnn

SEQ ID NO: 122172 - DNA, 252 bp, Homo sapiens
  misc_feature: GYAE6OF02HV9X2.51.16.B05.1.454.CMB.1.raw
  modified_base (249)..(252): a, c, t, g, unknown or other
  misc_feature (249)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnnnn

SEQ ID NO: 122173 - DNA, 260 bp, Homo sapiens
  misc_feature: GYAE6OF02FU6TF.51.16.B05.1.454.CMB.1.raw
  modified_base (251)..(260): a, c, t, g, unknown or other
  misc_feature (251)..(260): n is a, c, g, or t
tcagcgatcgtatacacgaccggtgctcgatttagagctcacgtattgggggcgaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnnnnnnn

SEQ ID NO: 122174 - DNA, 255 bp, Homo sapiens
  misc_feature: GYAE6OF02GW6H9.51.16.B05.1.454.CMB.1.raw
  modified_base (249)..(255): a, c, t, g, unknown or other
  misc_feature (249)..(255): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnnnnnnn

SEQ ID NO: 122175 - DNA, 254 bp, Homo sapiens; identical to SEQ ID NO: 122092
  misc_feature: GYAE6OF02FX8XB.51.16.B05.1.454.CMB.1.raw
  modified_base (250)..(254): a, c, t, g, unknown or other
  misc_feature (250)..(254): n is a, c, g, or t

SEQ ID NO: 122176 - DNA, 316 bp, Homo sapiens
  misc_feature: GYAE6OF02ISXB5.51.16.B05.1.454.CMB.1.raw
  modified_base (256)..(257): a, c, t, g, unknown or other
  misc_feature (256)..(257): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (269)..(316): a, c, t, g, unknown or other
  misc_feature (269)..(316): n is a, c, g, or t
tcagcgatcgtatacacgaccggtgctcgatttagagctcacgtattggggggcaaaggctgccctgaccctttcgggtgcgcagcctgaggatcgaggctgagtattactgcttgctctcctatagtggtcgttcgggtgttcggcggaaggtaccaagctgaccgtcctaggtcagcccaaggctgccccctggtcactcgtgttcccgcatcctgatcgtagcactctgagcgggctggcaaaggcgcatagnnatncagncagcnnnnnnnnnnnnnnnnnnnnnnnnnnnnnnnnnnnnnnnnnnnnnnnn

SEQ ID NO: 122177 - DNA, 251 bp, Homo sapiens; identical to SEQ ID NO: 122090
  misc_feature: GYAE6OF02HANJF.51.16.B05.1.454.CMB.1.raw
  modified_base (250)..(251): a, c, t, g, unknown or other
  misc_feature (250)..(251): n is a, c, g, or t

SEQ ID NO: 122178 - DNA, 249 bp, Homo sapiens
  misc_feature: GYAE6OF02G0I0Q.51.16.B05.1.454.CMB.1.raw
  modified_base (247)..(249): a, c, t, g, unknown or other
  misc_feature (247)..(249): n is a, c, g, or t
tcagcgatcgtatacacgaccggtgctcgatttagagctcacgtattggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgcatctgatcgtagcactctgagcgggctggcaaggcgcatagnnn

SEQ ID NO: 122179 - DNA, 258 bp, Homo sapiens
  misc_feature: GYAE6OF02I7R2H.51.16.B05.1.454.CMB.1.raw
  modified_base (219)..(219): a, c, t, g, unknown or other
  misc_feature (219)..(219): n is a, c, g, or t
  modified_base (248)..(258): a, c, t, g, unknown or other
  misc_feature (248)..(258): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtancactctgagcggctggcaaggcgcatagnnnnnnnnnnn

SEQ ID NO: 122180 - DNA, 254 bp, Homo sapiens; identical to SEQ ID NO: 122092
  misc_feature: GYAE6OF02IUN06.51.16.B05.1.454.CMB.1.raw
  modified_base (250)..(254): a, c, t, g, unknown or other
  misc_feature (250)..(254): n is a, c, g, or t

SEQ ID NO: 122181 - DNA, 256 bp, Homo sapiens
  misc_feature: GYAE6OF02ICWLZ.51.16.B05.1.454.CMB.1.raw
  modified_base (251)..(256): a, c, t, g, unknown or other
  misc_feature (251)..(256): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctggtcactctcgttcccgccatctgatcgtagcactctgagcgggctggcaaggcgcatagnnnnnn

SEQ ID NO: 122182 - DNA, 252 bp, Homo sapiens; identical to SEQ ID NO: 122095
  misc_feature: GYAE6OF02JDFA3.51.16.B05.1.454.CMB.1.raw
  modified_base (250)..(252): a, c, t, g, unknown or other
  misc_feature (250)..(252): n is a, c, g, or t

SEQ ID NO: 122183 - DNA, 265 bp, Homo sapiens
  misc_feature: GYAE6OF02GESE1.51.16.B05.1.454.CMB.1.raw
  modified_base (244)..(244): a, c, t, g, unknown or other
  misc_feature (244)..(244): n is a, c, g, or t
  modified_base (250)..(265): a, c, t, g, unknown or other
  misc_feature (250)..(265): n is a, c, g, or t
tcagcgatcgtatacacgaccggtgctcgatttagagctcacgtattgggggcaaagctgccctgaccctttcgggtgcgcagcctgaggatgaggctgagtattactgccttgctctcctatagtggtgttcgggtgttcggcggagggaccaagctgaccgtcctaggtcagcccaaggctgccccctcggtcactctgttcccgccatctgatcgtagcactctgagcggctggcaaggcncatagnnnnnnnnnnnnnnnn

SEQ ID NO: 122184 - DNA, 254 bp, Homo sapiens
  misc_feature: GYAE6OF02IDQJ5.51.16.B05.1.454.CMB.1.raw
  modified_base (251)..(254): a, c, t, g, unknown or other
  misc_feature (251)..(254): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnn

SEQ ID NO: 122185 - DNA, 254 bp, Homo sapiens; identical to SEQ ID NO: 122092
  misc_feature: GYAE6OF02I6RMC.51.16.B05.1.454.CMB.1.raw
  modified_base (250)..(254): a, c, t, g, unknown or other
  misc_feature (250)..(254): n is a, c, g, or t

SEQ ID NO: 122186 - DNA, 255 bp, Homo sapiens
  misc_feature: GYAE6OF02I0Y1P.51.16.B05.1.454.CMB.1.raw
  modified_base (250)..(255): a, c, t, g, unknown or other
  misc_feature (250)..(255): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgcatctgatcgtagcactctgagcgggctggcaaggcgcatagnnnnnn

SEQ ID NO: 122187 - DNA, 254 bp, Homo sapiens; identical to SEQ ID NO: 122184
  misc_feature: GYAE6OF02FK3O6.51.16.B05.1.454.CMB.1.raw
  modified_base (251)..(254): a, c, t, g, unknown or other
  misc_feature (251)..(254): n is a, c, g, or t

SEQ ID NO: 122188 - DNA, 252 bp, Homo sapiens; identical to SEQ ID NO: 122095
  misc_feature: GYAE6OF02JF88U.51.16.B05.1.454.CMB.1.raw
  modified_base (250)..(252): a, c, t, g, unknown or other
  misc_feature (250)..(252): n is a, c, g, or t

SEQ ID NO: 122189 - DNA, 255 bp, Homo sapiens
  misc_feature: GYAE6OF02ITPMZ.51.16.B05.1.454.CMB.1.raw
  modified_base (250)..(255): a, c, t, g, unknown or other
  misc_feature (250)..(255): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctgagcgggctggcaaggcgcatagnnnnnn

SEQ ID NO: 122190 - DNA, 261 bp, Homo sapiens
  misc_feature: GYAE6OF02GRPUN.51.16.B05.1.454.CMB.1.raw
  modified_base (248)..(261): a, c, t, g, unknown or other
  misc_feature (248)..(261): n is a, c, g, or t
tcagcgatcgtatacacgaccggtgctcgatttagagctcacgtattgggggcgaaagctgccctgaccctttcgggtgcgcagcctgaggatgaggctgagtattactgcttgctctcctatagtggtgttcgggtgttcggcgagggaccaagctgaccgtcctaggtcagcccaaggctgcccctcggtcactctgttcccgccatctgatcgtagcactctgagcgggctggcaaggcgcatgnnnnnnnnnnnnnn

SEQ ID NO: 122191 - DNA, 250 bp, Homo sapiens; identical to SEQ ID NO: 122124
  misc_feature: GYAE6OF02FJ4Q8.51.16.B05.1.454.CMB.1.raw
  modified_base (250)..(250): a, c, t, g, unknown or other
  misc_feature (250)..(250): n is a, c, g, or t

SEQ ID NO: 122192 - DNA, 255 bp, Homo sapiens
  misc_feature: GYAE6OF02ITHJR.51.16.B05.1.454.CMB.1.raw
  modified_base (251)..(255): a, c, t, g, unknown or other
  misc_feature (251)..(255): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnn

SEQ ID NO: 122193 - DNA, 260 bp, Homo sapiens
  misc_feature: GYAE6OF02H88Z5.51.16.B05.1.454.CMB.1.raw
  modified_base (253)..(260): a, c, t, g, unknown or other
  misc_feature (253)..(260): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccatctgatcgtagcactctggagcggggctggacaaggcgcatagnnnnnnnn

SEQ ID NO: 122194 - DNA, 257 bp, Homo sapiens
  misc_feature: GYAE6OF02III8K.51.16.B05.1.454.CMB.1.raw
  modified_base (244)..(244): a, c, t, g, unknown or other
  misc_feature (244)..(244): n is a, c, g, or t
  modified_base (249)..(257): a, c, t, g, unknown or other
  misc_feature (249)..(257): n is a, c, g, or t
tcagcgatcgtatacacgaccggtgctcgatttagagctcacgtattgggggggcaaagctgccctgaccctttcgggtgcgcagcctgaggatgaggctgagtattactgcttgctctcctatagtggtgttcgggtgttcggcggagggacaagctgaccgtcctaggtcagcccaaggctgccccctggtcactctgttcccgcatctgatcgtagcactctgagcgggctggcaaggcgnatagnnnnnnnnn

SEQ ID NO: 122195 - DNA, 255 bp, Homo sapiens
  misc_feature: GYAE6OF02IT6Y0.51.16.B05.1.454.CMB.1.raw
  modified_base (219)..(219): a, c, t, g, unknown or other
  misc_feature (219)..(219): n is a, c, g, or t
  modified_base (250)..(255): a, c, t, g, unknown or other
  misc_feature (250)..(255): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgcatctgactcgtancactctgacgcgggctggacaaggcgcatgnnnnnn

SEQ ID NO: 122196 - DNA, 265 bp, Homo sapiens
  misc_feature: GYAE6OF02HCR56.51.16.B05.1.454.CMB.1.raw
  modified_base (254)..(265): a, c, t, g, unknown or other
  misc_feature (254)..(265): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgttcccgccatctgatcgtagcactctgagcgggctggacaaggcgcatagnnnnnnnnnnnn

SEQ ID NO: 122197 - DNA, 260 bp, Homo sapiens
  misc_feature: GYAE6OF02GXUQB.51.16.B05.1.454.CMB.1.raw
  modified_base (251)..(260): a, c, t, g, unknown or other
  misc_feature (251)..(260): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcatagnnnnnnnnnn

SEQ ID NO: 122198 - DNA, 255 bp, Homo sapiens
  misc_feature: GYAE6OF02G9E99.51.16.B05.1.454.CMB.1.raw
  modified_base (250)..(255): a, c, t, g, unknown or other
  misc_feature (250)..(255): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcacgcactcgtctgagcgggctggcaaggcgcatagnnnnnn

SEQ ID NO: 122199 - DNA, 263 bp, Homo sapiens
  misc_feature: GYAE6OF02I125V.51.16.B05.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (250)..(253): a, c, t, g, unknown or other
  misc_feature (250)..(253): n is a, c, g, or t
  modified_base (255)..(263): a, c, t, g, unknown or other
  misc_feature (255)..(263): n is a, c, g, or t
tcagcgatcgtatacacgaccggtgctcgatttagagctcacgtattgggggcaaagctgccctgacccttcgggtgcgcagcctgaggatgaggctgagtattactgcttgctctcctatagtggtgttcgggtgttcggcggagggaccaagctgaccgtcctaggtcagcccaaggctgccccctggtcactctcgttcccncatctgactcgtagctactctgacgcggctggcaaggcncatagnnnncnnnnnnnnn

SEQ ID NO: 122200 - DNA, 265 bp, Homo sapiens
  misc_feature: GYAE6OF02F11C4.51.16.B05.1.454.CMB.1.raw
  modified_base (252)..(265): a, c, t, g, unknown or other
  misc_feature (252)..(265): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctggtcactctcgttcccgcatctgatcgtagcactctgagcgggctggcaaggcgacatagnnnnnnnnnnnnnn

SEQ ID NO: 122201 - DNA, 277 bp, Homo sapiens
  misc_feature: GYAE6OF02GUAO0.51.16.B05.1.454.CMB.1.raw
  modified_base (256)..(257): a, c, t, g, unknown or other
  misc_feature (256)..(257): n is a, c, g, or t
  modified_base (259)..(277): a, c, t, g, unknown or other
  misc_feature (259)..(277): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgttcccgccatctgatcgtagccactctggagcgggctcggcaaggcgcatagnngnnnnnnnnnnnnnnnnnnn

SEQ ID NO: 122202 - DNA, 269 bp, Homo sapiens
  misc_feature: GYAE6OF02HJE4J.51.16.B05.1.454.CMB.1.raw
  modified_base (209)..(209): a, c, t, g, unknown or other
  misc_feature (209)..(209): n is a, c, g, or t
  modified_base (257)..(269): a, c, t, g, unknown or other
  misc_feature (257)..(269): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgttcccnctatctgactcgtagcactctggacgcgggctggcaaggcgacatagnnnnnnnnnnnnn

SEQ ID NO: 122203 - DNA, 301 bp, Homo sapiens
  misc_feature: GYAE6OF02IPHXP.51.16.B05.1.454.CMB.1.raw
  modified_base (213)..(213): a, c, t, g, unknown or other
  misc_feature (213)..(213): n is a, c, g, or t
  modified_base (257)..(301): a, c, t, g, unknown or other
  misc_feature (257)..(301): n is a, c, g, or t
tcagcgatcgtatacacgaccggtgctcgatttagagctcacgtattgggggggcaaagctgccctgaccctttcgggtgcgcagcctgaggatgaggctgagtattactgcttgctctcctatagtgggtgttcgggtgttcggcggagggaccaagctgaccgtctaggtcagccaaggctcgcccctggtcactcgtcgttcccgcatcngatcgtagcactctggaggcggcgtcggcgaagggcacagtagnnnnnnnnnnnnnnnnnnnnnnnnnnnnnnnnnnnnnnnnnnnnn

SEQ ID NO: 122204 - DNA, 278 bp, Homo sapiens
  misc_feature: GYAE6OF02GXHIX.51.16.B05.1.454.CMB.1.raw
  modified_base (144)..(144): a, c, t, g, unknown or other
  misc_feature (144)..(144): n is a, c, g, or t
  modified_base (246)..(260): a, c, t, g, unknown or other
  misc_feature (246)..(260): n is a, c, g, or t
  modified_base (262)..(278): a, c, t, g, unknown or other
  misc_feature (262)..(278): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggngagggaccaagctgacgtctaggtcagcccaaggctgccccctggtcactctgtcccgccatctgatcgtagcactctgagcggctggcaaggcgacatagnnnnnnnnnnnnnnngnnnnnnnnnnnnnnnnn

SEQ ID NO: 122205 - DNA, 252 bp, Homo sapiens
  misc_feature: GYAE6OF02GET2O.51.16.B05.1.454.CMB.1.raw
  modified_base (249)..(252): a, c, t, g, unknown or other
  misc_feature (249)..(252): n is a, c, g, or t
tcagcgatcgtatacacgaccggtgctcgatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgtcccgcatctgatcgtagcactctgagcggctggcaaggcgcatagnnnn

SEQ ID NO: 122206 - DNA, 308 bp, Homo sapiens
  misc_feature: GYAE6OF02IXA3H.51.16.B05.1.454.CMB.1.raw
  modified_base (258)..(258): a, c, t, g, unknown or other
  misc_feature (258)..(258): n is a, c, g, or t
  modified_base (268)..(308): a, c, t, g, unknown or other
  misc_feature (268)..(308): n is a, c, g, or t
tcagcgatcgtatacacgaccggtgctcgatttagagctcacgtattggggggcaaagctgccctgaccctttcgggtgcgcagcctgaggatgaggctgagtattactgcttgctcctcctatagtggtgttcgggtgttcggcggagggaccaagctgaccgtcctaggtcagcccaaggctcgccccctggtcactctgttcccgccatcctgatcgtagccactctgagcgggctgggacaaggtcgacatagntagcatgcannnnnnnnnnnnnnnnnnnnnnnnnnnnnnnnnnnnnnnnn

SEQ ID NO: 122207 - DNA, 272 bp, Homo sapiens
  misc_feature: GYAE6OF02IUAUX.51.16.B05.1.454.CMB.1.raw
  modified_base (255)..(272): a, c, t, g, unknown or other
  misc_feature (255)..(272): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctgttcccgccatctgatcgtagcactctgagcgggctggcaaacggcgacatagnnnnnnnnnnnnnnnnnn

SEQ ID NO: 122208 - DNA, 260 bp, Homo sapiens
  misc_feature: GYAE6OF02HAQMG.51.16.B05.1.454.CMB.1.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (248)..(260): a, c, t, g, unknown or other
  misc_feature (248)..(260): n is a, c, g, or t
tcagcgatcgtatacacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagccaaggctgccccctcggtcactctgttccccgcatcngatcgtagcactcngagcgggctggcaaggcnatgnnnnnnnnnnnnn

SEQ ID NO: 122209 - DNA, 157 bp, Homo sapiens
  misc_feature: GYAE6OF01A8AEL.2.14.B03.1.454.CMB.1.raw
  modified_base (157)..(157): a, c, t, g, unknown or other
  misc_feature (157)..(157): n is a, c, g, or t
tcagacgctcgacacacgaccggtgctcgatttagtgtgagtagttccgcgggatttagtgtgagtagttccgcgggctggcaaggcgcataggctatgcgcctggtcaaagactacttcctgtcgagcgtctgagcgggctggcaaggcgcatagn

SEQ ID NO: 122210 - DNA, 220 bp, Homo sapiens
  misc_feature: GYAE6OF01CJUP6.2.14.B03.1.454.CMB.1.raw
  modified_base (215)..(220): a, c, t, g, unknown or other
  misc_feature (215)..(220): n is a, c, g, or t
tcagacgctcgacacacgaccggtgctcgatttagtgtgagtagttccgcgggccagggaaccctggtcaccgtcacctcagcctccaccaaggcccatcggtcttcccctggcgccctgctccaggagcacctccgagagcacagcggccctgggctgcctggtcaaggactacttcctgtcgagcgtctgagcgggctggcaaggcgcatagnnnnnn

SEQ ID NO: 122211 - DNA, 227 bp, Homo sapiens
  misc_feature: GYAE6OF01BNU3Z.2.14.B03.1.454.CMB.1.raw
  modified_base (218)..(227): a, c, t, g, unknown or other
  misc_feature (218)..(227): n is a, c, g, or t
tcagacgctcgacacacgaccggtgctcgatttagtgtgagtagttccgcgggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnnnnn

SEQ ID NO: 122212 - DNA, 223 bp, Homo sapiens
  misc_feature: GYAE6OF01B4EKV.2.14.B03.1.454.CMB.1.raw
  modified_base (219)..(223): a, c, t, g, unknown or other
  misc_feature (219)..(223): n is a, c, g, or t
tcagacgctcgacacacgaccggtgctcgatttagtgtgagtagttccgcgggggccagggaaccctggtcaccgtcacctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnn

SEQ ID NO: 122213 - DNA, 220 bp, Homo sapiens
  misc_feature: GYAE6OF01ASB1V.2.14.B03.1.454.CMB.1.raw
  modified_base (216)..(220): a, c, t, g, unknown or other
  misc_feature (216)..(220): n is a, c, g, or t
tcagacgctcgacacacgaccggtgctcgatttagtgtgagtagttccgcggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcggctggcaaggcgcatagnnnnn

SEQ ID NO: 122214 - DNA, 221 bp, Homo sapiens
  misc_feature: GYAE6OF01BYPI0.2.14.B03.1.454.CMB.1.raw
  modified_base (218)..(221): a, c, t, g, unknown or other
  misc_feature (218)..(221): n is a, c, g, or t
tcagacgctcgacacacgaccggtgctcgatttagtgtgagtagttccgcgggggccagggaaccctggtcaccgtcacctcagcctccaccaagggcccatcggtcttcccctggcgccctgctccaggagcacctccgagagcacagcggccctgggctgcctggtaaaggactacttcctgtcgagcgtctgagcgggctggcaaggcgcatagnnnn

SEQ ID NO: 122215 - DNA, 222 bp, Homo sapiens
  misc_feature: GYAE6OF01EQT6J.2.14.B03.1.454.CMB.1.raw
  modified_base (220)..(222): a, c, t, g, unknown or other
  misc_feature (220)..(222): n is a, c, g, or t
tcagacgctcgacacacgaccggtgctcgatttagtgtgagtagttccgcggggggccagggaaccctggtcaccgtcacctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnn

SEQ ID NO: 122216 - DNA, 221 bp, Homo sapiens
  misc_feature: GYAE6OF01EJ77F.2.14.B03.1.454.CMB.1.raw
  modified_base (219)..(221): a, c, t, g, unknown or other
  misc_feature (219)..(221): n is a, c, g, or t
tcagacgctcgacacacgaccggtgctcgatttagtgtgagtagttccgcggggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnn

SEQ ID NO: 122217 - DNA, 275 bp, Homo sapiens
  misc_feature: GYAE6OF01BD4MX.2.14.B03.1.454.CMB.1.raw
  modified_base (231)..(275): a, c, t, g, unknown or other
  misc_feature (231)..(275): n is a, c, g, or t
tcagacgctcgacacacgaccggtgctcgatttagtgtgagtagttccgcggggggccagggaaccctggggtcaccgtcacctcagcctccaccaagggcccatcggtcttccccctggccgcccgtgctccaggagccacctcccgagagcacaggcggccctggggctggcctggtcaaggcctacttcctgtcgagcgtctggagcgggctggcaagggcgcatagnnnnnnnnnnnnnnnnnnnnnnnnnnnnnnnnnnnnnnnnnnnnn

SEQ ID NO: 122218 - DNA, 225 bp, Homo sapiens
  misc_feature: GYAE6OF01C2WMM.2.14.B03.1.454.CMB.1.raw
  modified_base (219)..(225): a, c, t, g, unknown or other
  misc_feature (219)..(225): n is a, c, g, or t
tcagacgctcgacacacgaccggtgctcgatttagtgtgagtagttccgcggggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnnnnn

SEQ ID NO: 122219 - DNA, 225 bp, Homo sapiens
  misc_feature: GYAE6OF01DQZLA.2.14.B03.1.454.CMB.1.raw
  modified_base (221)..(225): a, c, t, g, unknown or other
  misc_feature (221)..(225): n is a, c, g, or t
tcagacgctcgacacacgaccggtgctcgatttagtgtgagtagttccgcgggggggccagggaaccctggtcaccgtcacctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnn

SEQ ID NO: 122220 - DNA, 229 bp, Homo sapiens
  misc_feature: GYAE6OF01E50P8.2.14.B03.1.454.CMB.1.raw
  modified_base (224)..(229): a, c, t, g, unknown or other
  misc_feature (224)..(229): n is a, c, g, or t
tcagacgctcgacacacgaccggtgctcgatttagtgtgagtagttccggcggggggccagggaaccctggtcaccgtcacctcagcctccaccaagggcccatcggtcttccccctggccgccctgctccaggagccacctccgagagcacagcggccctgggctgcctggtcaaggctacttcctgtcgagcgtctggagcgggctggcaaggcgacatagnnnnnn

SEQ ID NO: 122221 - DNA, 635 bp, Homo sapiens
  misc_feature: GYAE6OF01ED9YA.2.14.B03.1.454.CMB.1.raw
  modified_base (185)..(185): a, c, t, g, unknown or other
  misc_feature (185)..(185): n is a, c, g, or t
  modified_base (220)..(222): a, c, t, g, unknown or other
  misc_feature (220)..(222): n is a, c, g, or t
  modified_base (224)..(224): a, c, t, g, unknown or other
  misc_feature (224)..(224): n is a, c, g, or t
  modified_base (227)..(228): a, c, t, g, unknown or other
  misc_feature (227)..(228): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
  modified_base (519)..(519): a, c, t, g, unknown or other
  misc_feature (519)..(519): n is a, c, g, or t
tcagacgctcgacacacgaccggtgctcgattttagtgtgagtagttcggcgggggggcaggggaaccctggtcacggtccactcagcctccaccaagggcccatcggtcttcccctggcgcccttgctccaggagcacctcgagagcacagcggccctgggctgcctggtcaaggctacttccngtcgagcgtctgagcgggctggcaaggcgcatagnnngntcnncancacagtncactgacacagctgtactntntananacaacggttccgatggaactcgaggtcgacttccggactagttagtccggngacgtcgtacgcggtacgtacggtacgttacgacgtacgtacggtactcgtacgtacgtccgacgtcggacgacgacgtttcgaccttacgttaccgttacgggtactttaccgaccgtagaccgacgtacgtaacggttccggttaaccggtaccgtaggtccttaaccgtacgtacggaaccggtacggtacgttaacgggntaaccggtaaacacggtccgggtacggcctaggcgtacgtacgtacgtacgtacgtacgtacgtacgtacgtacgtcgtacgtacgtacgtacgtacgtacgtacgtcgtcgtacg

SEQ ID NO: 122222 - DNA, 261 bp, Homo sapiens
  misc_feature: GYAE6OF01BMVX7.2.14.B03.1.454.CMB.1.raw
  modified_base (228)..(261): a, c, t, g, unknown or other
  misc_feature (228)..(261): n is a, c, g, or t
tcagacgctcgacacacgaccggtgctcgatttagtgtgagtagttccggcgggggggccgagggaaccctggtcaccgtcacctcagcctccaccaagggcccatcggtcttccccctggcgccctgctccaggagcaccctccgagagcacagcggccctgggctggccctggtcaaggactacttcctgtcgagcgtctgagcgggctgggccaaggcgcatagnnnnnnnnnnnnnnnnnnnnnnnnnnnnnnnnnn

SEQ ID NO: 122223 - DNA, 224 bp, Homo sapiens
  misc_feature: GYAE6OF01DH31Y.2.14.B03.1.454.CMB.1.raw
  modified_base (221)..(224): a, c, t, g, unknown or other
  misc_feature (221)..(224): n is a, c, g, or t
tcagacgctcgacacacgaccggtgctcgatttagtgtgagtagttccggcgggggggccagggaaccctggtcaccgtcacctcagcctccaccaagggcccatcggtcttccccctggcgccctgctccaggagcacctccgagagcacagcggccctgggctgcctggtcaaggctacttcctgtcgagcgtctgagcgggctggcaaggcgcatagnnnn

SEQ ID NO: 122224 - DNA, 226 bp, Homo sapiens
  misc_feature: GYAE6OF01E10LC.2.14.B03.1.454.CMB.1.raw
  modified_base (221)..(226): a, c, t, g, unknown or other
  misc_feature (221)..(226): n is a, c, g, or t
tcagacgctcgacacacgaccggtgctcgatttagtgtgagtagttccgcgggggggccagggaaccctggtcaccgtcacctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnn

SEQ ID NO: 122225 - DNA, 226 bp, Homo sapiens; identical to SEQ ID NO: 122224
  misc_feature: GYAE6OF01CDDHR.2.14.B03.1.454.CMB.1.raw
  modified_base (221)..(226): a, c, t, g, unknown or other
  misc_feature (221)..(226): n is a, c, g, or t

SEQ ID NO: 122226 - DNA, 178 bp, Homo sapiens
  misc_feature: GYAE6OF01BM341.2.14.B03.1.454.CMB.1.raw
  modified_base (159)..(178): a, c, t, g, unknown or other
  misc_feature (159)..(178): n is a, c, g, or t
tcagacgctcgacacacgaccggtgctcgatttagtgtgagtagttccgcggggatttagtgtgagtagttccgcgggctggcaaggcgcataggctatgcgcctggtcaaggacttacttcctgtcgagcgtctgagcgggctggcaaggcgcatagnnnnnnnnnnnnnnnnnnnn

SEQ ID NO: 122227 - DNA, 227 bp, Homo sapiens
  misc_feature: GYAE6OF01EGURB.2.14.B03.1.454.CMB.1.raw
  modified_base (219)..(227): a, c, t, g, unknown or other
  misc_feature (219)..(227): n is a, c, g, or t
tcagacgctcgacacacgaccggtgctcgatttagtgtgagtagttccgcgggggggccagggaaccctggtcaccgtcacctcagcctccaccaagggcccatcggtcttccccctggcgccctgctccaggagcacctccgagagcacagcggcctgggctgcctggtcaaggctacttcctgtcgagcgtctgagcgggctggcaaggcgcatagnnnnnnnnn

SEQ ID NO: 122228 - DNA, 162 bp, Homo sapiens
  misc_feature: GYAE6OF01CK7NP.2.14.B03.1.454.CMB.1.raw
  modified_base (158)..(162): a, c, t, g, unknown or other
  misc_feature (158)..(162): n is a, c, g, or t
tcagacgctcgacacacgaccggtgctcgatttagtgtgagtagttccgcggggatttagtgtgagtagttccgcgggctggcaaggcgcataggctatgcgcctggtcaaggactacttcctgtcgagcgtctgagcgggctggcaaggcgcatagnnnnn

SEQ ID NO: 122229 - DNA, 227 bp, Homo sapiens
  misc_feature: GYAE6OF01ERRGD.2.14.B03.1.454.CMB.1.raw
  modified_base (221)..(227): a, c, t, g, unknown or other
  misc_feature (221)..(227): n is a, c, g, or t
tcagacgctcgacacacgaccggtgctcgatttagtgtgagtagttccgcgggggggccagggaaccctggtcaccgtcacctcagcctccaccaagggcccatcggtcttcccctggcgccctgctccaggagcacctccgagagcacagcggccctgggctgcctggtcaaaggactacttcctgtcgagcgtctgagcgggctggcaaggcgcatagnnnnnnn

SEQ ID NO: 122230 - DNA, 246 bp, Homo sapiens
  misc_feature: GYAE6OF01CQBJU.2.14.B03.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (226)..(229): a, c, t, g, unknown or other
  misc_feature (226)..(229): n is a, c, g, or t
  modified_base (231)..(246): a, c, t, g, unknown or other
  misc_feature (231)..(246): n is a, c, g, or t
tcagacgctcgacacacgaccggtgctcgatttagtgtgagtagttccggcgggggggccagggaaccctggtcaccgtcacctcagcctccaccaagggcccatcggtccttccccctggccgccctgctccaggagccacctccgagagcacaggccggccctgggctgcctggtcaaaggctacttctgtcgagcgtnggagcgggctggcaggcanagtagnnnntnnnnnnnnnnnnnnnn

SEQ ID NO: 122231 - DNA, 221 bp, Homo sapiens
  misc_feature: GYAE6OF02GED72.2.14.B03.1.454.CMB.1.raw
  modified_base (218)..(221): a, c, t, g, unknown or other
  misc_feature (218)..(221): n is a, c, g, or t
tcagacgctcgacacacgaccggtgctcgatttagtgtgagtagttccgcgggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnn

SEQ ID NO: 122232 - DNA, 217 bp, Homo sapiens
  misc_feature: GYAE6OF02I67ZU.2.14.B03.1.454.CMB.1.raw
  modified_base (217)..(217): a, c, t, g, unknown or other
  misc_feature (217)..(217): n is a, c, g, or t
tcagacgctcgacacacgaccggtgctcgatttagtgtgagtagttccgcggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagn

SEQ ID NO: 122233 - DNA, 162 bp, Homo sapiens; identical to SEQ ID NO: 122228
  misc_feature: GYAE6OF02F4D7Q.2.14.B03.1.454.CMB.1.raw
  modified_base (158)..(162): a, c, t, g, unknown or other
  misc_feature (158)..(162): n is a, c, g, or t

SEQ ID NO: 122234 - DNA, 298 bp, Homo sapiens
  misc_feature: GYAE6OF02JV0PC.2.14.B03.1.454.CMB.1.raw
  modified_base (241)..(247): a, c, t, g, unknown or other
  misc_feature (241)..(247): n is a, c, g, or t
  modified_base (249)..(298): a, c, t, g, unknown or other
  misc_feature (249)..(298): n is a, c, g, or t
tcagacgctcgacacacgaccggtgctcgatttagtgtgagtagttccggcgggggtccgacgggaaccctggtcaccgtcacctcagcctccacccaagggcccatcggtcgttcccccgtggcgcccgtgcctccaggagtcacctccggaagagcacagcggccctgggactgcctggtcaaggactacgttcctgtcgaagccgtctagaccgacgggctggcaaggcgacaatagnnnnnnngnnnnnnnnnnnnnnnnnnnnnnnnnnnnnnnnnnnnnnnnnnnnnnnnnn

SEQ ID NO: 122235 - DNA, 150 bp, Homo sapiens
  misc_feature: GYAE6OF02GN85P.2.14.B03.1.454.CMB.1.raw
  modified_base (128)..(150): a, c, t, g, unknown or other
  misc_feature (128)..(150): n is a, c, g, or t
tcagacgctcgacacacgaccggtgctcgatttagtgtgagtagttccgcgggctggcaaggcgcatagctgcctggtcaaggactacttcctgtcgagcgtctgagcgggctggcaaggcgcatagnnnnnnnnnnnnnnnnnnnnnnn

SEQ ID NO: 122236 - DNA, 219 bp, Homo sapiens
  misc_feature: GYAE6OF02H5WX5.2.14.B03.1.454.CMB.1.raw
  modified_base (217)..(219): a, c, t, g, unknown or other
  misc_feature (217)..(219): n is a, c, g, or t
tcagacgctcgacacacgaccggtgctcgatttagtgtgagtagttccgcggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnn

SEQ ID NO: 122237 - DNA, 222 bp, Homo sapiens
  misc_feature: GYAE6OF02F458K.2.14.B03.1.454.CMB.1.raw
  modified_base (219)..(222): a, c, t, g, unknown or other
  misc_feature (219)..(222): n is a, c, g, or t
tcagacgctcgacacacgaccggtgctcgatttagtgtgagtagttccgcggggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnnn

SEQ ID NO: 122238 - DNA, 136 bp, Homo sapiens
  misc_feature: GYAE6OF02GFX49.2.14.B03.1.454.CMB.1.raw
  modified_base (134)..(136): a, c, t, g, unknown or other
  misc_feature (134)..(136): n is a, c, g, or t
tcagacgctcgacacacgaccggtgctcgatttagtgtgagtagttccgcgggcgtggcaaggcgcataggctatgcgcctggtcaaggactacttcctgtcgagcgtctgagcgggctggcaaggcgcatagnnn

SEQ ID NO: 122239 - DNA, 220 bp, Homo sapiens
  misc_feature: GYAE6OF02FNBKS.2.14.B03.1.454.CMB.1.raw
  modified_base (218)..(220): a, c, t, g, unknown or other
  misc_feature (218)..(220): n is a, c, g, or t
tcagacgctcgacacacgaccggtgctcgatttagtgtgagtagttccgcgggggccagggaaccctggtcaccgtcacctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnnn

SEQ ID NO: 122240 - DNA, 188 bp, Homo sapiens
  misc_feature: GYAE6OF02HEEP5.2.14.B03.1.454.CMB.1.raw
  modified_base (164)..(167): a, c, t, g, unknown or other
  misc_feature (164)..(167): n is a, c, g, or t
  modified_base (169)..(188): a, c, t, g, unknown or other
  misc_feature (169)..(188): n is a, c, g, or t
tcagacgctcgacacacgaccggtgctcgatttagtgtgagtagttccgcgggctggcaaggcgcatagggctggcaaggcgcatagggctggcaaggcgcatagctgcctggtcaaggactacttcctgtcgagcgtctgagcgggctggcaaggcgcatagnnnngnnnnnnnnnnnnnnnnnnnn

SEQ ID NO: 122241 - DNA, 221 bp, Homo sapiens; identical to SEQ ID NO: 122216
  misc_feature: GYAE6OF02JBHYP.2.14.B03.1.454.CMB.1.raw
  modified_base (219)..(221): a, c, t, g, unknown or other
  misc_feature (219)..(221): n is a, c, g, or t

SEQ ID NO: 122242 - DNA, 290 bp, Homo sapiens
  misc_feature: GYAE6OF02HETLQ.2.14.B03.1.454.CMB.1.raw
  modified_base (233)..(233): a, c, t, g, unknown or other
  misc_feature (233)..(233): n is a, c, g, or t
  modified_base (235)..(237): a, c, t, g, unknown or other
  misc_feature (235)..(237): n is a, c, g, or t
  modified_base (239)..(290): a, c, t, g, unknown or other
  misc_feature (239)..(290): n is a, c, g, or t
tcagacgctcgacacacgaccggtgctcgatttagtgtgagtagttccgcgggggggccagggaacccgtcggtcacccgtcgacctccagcctcctaccaagggcccatcggtcttccccctggcgccctgctccaggagcacctccgagagcacagcggccctgggctggtcctggtcaaggacttaacgttcctgtcgagcgtctgagcgggctggcaaggcgcgatagncnnngnnnnnnnnnnnnnnnnnnnnnnnnnnnnnnnnnnnnnnnnnnnnnnnnnnnn

SEQ ID NO: 122243 - DNA, 241 bp, Homo sapiens
  misc_feature: GYAE6OF02JJBNT.2.14.B03.1.454.CMB.1.raw
  modified_base (221)..(241): a, c, t, g, unknown or other
  misc_feature (221)..(241): n is a, c, g, or t
tcagacgctcgacacacgaccggtgctcgatttagtgtgagtagttccgcgggggggccagggaaccctggtcaccgtcacctcagcctccaccaagggcccatcggtcttccccctggcgccctgctccaggagcacctccgagagcacagcggccctgggctgcctggtcaaggactacttcctgtcgagcgtctgagcgggctggcaaggcgcatagnnnnnnnnnnnnnnnnnnnnn

SEQ ID NO: 122244 - DNA, 612 bp, Homo sapiens
  misc_feature: GYAE6OF02HCDIZ.2.14.B03.1.454.CMB.1.raw
  modified_base (178)..(178): a, c, t, g, unknown or other
  misc_feature (178)..(178): n is a, c, g, or t
  modified_base (431)..(431): a, c, t, g, unknown or other
  misc_feature (431)..(431): n is a, c, g, or t
  modified_base (606)..(606): a, c, t, g, unknown or other
  misc_feature (606)..(606): n is a, c, g, or t
tcagacgctcgacacacgaccggtgctcgatttagtgtgagtagtttgggtttagggggcaggagtcagacccagtcaggacgacagcatggacatgaggtcccgctcagctcctgggctcctgctgctctggttcccaggttccaggatgcgacatccagctgacccagtctccttnttcgtgtctgcgtctgtcgagagacagacttactatcacttggcggtcgacgtcgaggatagttagtacctaacttagccttaggtactcacgcagaacgccgtgggacgaacgacccctaaacgtcctagtactactagtggtcgactagtcgaacgttctagtacgtaaacggttcggggtaccctagttccggtaaggttcgaagtacggtaccgaggtggactcgtaggggaccagtatttcacttccncgacactcgacgtcggaccgtgccgagtcccgtagaacgttagttcgtacgtacctaactttccgtattcgtacgtagtacgtttcgtagtactttcgttcccgtctacgtacgttccggacgtaggtaccgaaggttacgtagacgtacgaaacgtacgtggtacgcctcgacncctacg

SEQ ID NO: 122245 - DNA, 652 bp, Homo sapiens
  misc_feature: GYAE6OF02F3U40.2.14.B03.1.454.CMB.1.raw
tcagacgctcgacacacgaccggtgctcgatttagtgtgagtagtttcgggtttgggggcaggaggtcagacccagtcaggacacagcatggacatgagggtcccgctcagctcctggggctcctgctgctctggttcccaggttccagatgcgacatccagctgacccagtctccttctttcgtgtctgcgtctgtgagagacagacttacgtatcacttgtcgggcgagtcaggatattagtaccaattagcctggtatcagtcagaacgccgtgggcgacgaccccgtaaactccctgactctagtggtcgctaagtcaacgttctacgactaaaggtcggggtacccagtcggtagttcaaggacggcaggtgactcggtagggactagtagtttccacgttctaccacctatccgacgtcgcctgaccgacgcctaggaaactacttcgagtccttaaactttacgtacgttcgtaacgtagttaccgtttacgttacgttacgttttcccgtttacccgcgttacccgttacgggtttccggaccggtaacggggtacccgtaaagggggttactaaacgggtaacgttaaccgtaaaaccgggttacttacgggttaccggaccttaccgtaccgtaaccttacg

SEQ ID NO: 122246 - DNA, 175 bp, Homo sapiens
  misc_feature: GYAE6OF02JJK11.2.14.B03.1.454.CMB.1.raw
  modified_base (156)..(158): a, c, t, g, unknown or other
  misc_feature (156)..(158): n is a, c, g, or t
  modified_base (160)..(175): a, c, t, g, unknown or other
  misc_feature (160)..(175): n is a, c, g, or t
tcagacgctcgacacacgaccggtgctcgatttagtgtgagtagttccgcgggatttagtgtgagtagttcgcgggctggcaaggcgcataggctatgcgcctggtcaaggactacttcctgtcgagcgtctgagcggctaggcaaggcgcatagnnntnnnnnnnnnnnnnnnn

SEQ ID NO: 122247 - DNA, 298 bp, Homo sapiens
  misc_feature: GYAE6OF02GO5WC.2.14.B03.1.454.CMB.1.raw
  modified_base (129)..(129): a, c, t, g, unknown or other
  misc_feature (129)..(129): n is a, c, g, or t
  modified_base (139)..(139): a, c, t, g, unknown or other
  misc_feature (139)..(139): n is a, c, g, or t
  modified_base (143)..(143): a, c, t, g, unknown or other
  misc_feature (143)..(143): n is a, c, g, or t
  modified_base (177)..(177): a, c, t, g, unknown or other
  misc_feature (177)..(177): n is a, c, g, or t
  modified_base (212)..(212): a, c, t, g, unknown or other
  misc_feature (212)..(212): n is a, c, g, or t
  modified_base (222)..(225): a, c, t, g, unknown or other
  misc_feature (222)..(225): n is a, c, g, or t
  modified_base (227)..(298): a, c, t, g, unknown or other
  misc_feature (227)..(298): n is a, c, g, or t
tcagacgctcgacacacgaccggtgctcgatttagtgtgagtagttccgcgggggggccagggaaccctggtcacgtcactcagctccacaagggccatcggtcttcccctggcgccctgctccaggancacctccgangcangcgccctgggctagcctggtcaaggctacttccngtcgtagcgtcgtgagtcggactggctaagggccnctagtacggnnnnannnnnnnnnnnnnnnnnnnnnnnnnnnnnnnnnnnnnnnnnnnnnnnnnnnnnnnnnnnnnnnnnnnnnnnn

SEQ ID NO: 122248 - DNA, 248 bp, Homo sapiens
  misc_feature: GYAE6OF01DO9UI.16.87.H10.1.454.CMB.1.raw
  modified_base (247)..(248): a, c, t, g, unknown or other
  misc_feature (247)..(248): n is a, c, g, or t
tcagtgtactactccacgaccggtgctcgatttagcagtactgcgttgggagtgggttttcgttactacgggatggacgtctgggccgagggaccgcggtcaccgtctcctcagcctccaccaagggcccatcggtcttcccctggcaccctcctccaagagcacctctggggcacagcggccctgggctgcctggtcaaggactacttccgagtagtacactgagcgggctggcaaggcgcatagnn

SEQ ID NO: 122249 - DNA, 174 bp, Homo sapiens
  misc_feature: GYAE6OF01CSXKI.16.87.H10.1.454.CMB.1.raw
  modified_base (173)..(174): a, c, t, g, unknown or other
  misc_feature (173)..(174): n is a, c, g, or t
tcagtgtactactccacgaccggtgctcgatttagcagtactgcgttgggtttgggggaagaggaagactgacggtcccccaggagttcaggtgctgggcacagcggccctgggctgcctggtcaaggactacttccgagtagtacactgagcgggctggcaaggcgcatagnn

SEQ ID NO: 122250 - DNA, 259 bp, Homo sapiens
  misc_feature: GYAE6OF01ATKH6.16.87.H10.1.454.CMB.1.raw
  modified_base (256)..(259): a, c, t, g, unknown or other
  misc_feature (256)..(259): n is a, c, g, or t
tcagtgtactactccacgaccggtgctcgatttagcagtactgcgttgggggagttgggttttttttcgttactacgggatggacgtctggggccgagggaccgcggtcaccgtctcctcagcctccaccaagggcccatcggtcttccccctggcaccctcctccaagagcacctctggggcacagcggccctgggctgcctggtcaaggactacttccgagtagtacactgagcgggctggcaaggcgcatagnnnn

SEQ ID NO: 122251 - DNA, 588 bp, Homo sapiens
  misc_feature: GYAE6OF01BXYB4.16.87.H10.1.454.CMB.1.raw
  modified_base (496)..(496): a, c, t, g, unknown or other
  misc_feature (496)..(496): n is a, c, g, or t
tcagtgtactactccacgaccggtgctcgatttagcagtactgcgttgggtttgggcccagccctgggattcccagctgtttctgcttgctgatcaggactgcacacagagaactcaccatggagtttgggctgatctgggtcttccttgttgcttttttaaaaggtgtccagtgtgaggagcagctggtggagtccggggaggcttagtcagcctgggaagtccctgagactctcctgtgcagcctctggattcaccttcagctaattacctgggcctgccacgtggggtccccaccaagcctccgaaggggaggggctgggtgtgggtctcgactatattaatctgatggggataatttagcctacgcggactccggtacaagggccctattccacccgtctccgaagacgaacaaccaaccaagaacacaactataatctgacagattgactagtctgaacgacccgaggaccgacggtctgttgtaattacngtcgacgaaggctaggttcgaggaaacgtaggttagttggggttagggggttagttttggggttttttacgttaggttacgggtgtacgggg

SEQ ID NO: 122252 - DNA, 262 bp, Homo sapiens
  misc_feature: GYAE6OF01AYT4L.16.87.H10.1.454.CMB.1.raw
  modified_base (257)..(262): a, c, t, g, unknown or other
  misc_feature (257)..(262): n is a, c, g, or t
tcagtgtactactccacgaccggtgctcgatttagcagtactgcgttgggggagttgggtttttttttcgttactacgggatggacgtctggggccgagggaccgcggtcaccgtctcctcagcctccaccaagggcccatcggtcttcccctggcaccctcctccaagagcacatctgggggcacagcggccctgggctgcctggtcaaggactacttccgagtagtacactgagcgggctggcaaggcgcatagnnnnnn

SEQ ID NO: 122253 - DNA, 716 bp, Homo sapiens
  misc_feature: GYAE6OF01B2LSO.16.87.H10.1.454.CMB.1.raw
  modified_base (292)..(292): a, c, t, g, unknown or other
  misc_feature (292)..(292): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattctggctgcctacgtgggtccnccaagcctccgaggggagggctgggtggtgggtctcgactattattaactctacggtagtggggaattaagtttagcccgtacggccggtactccggtacgaacggggcccgtaattccgacccggttctacccgagaacgaaccaaaccgtaacccaaacggaaaccaacctaaacctaacttaactccgttacgaccgtaagtacttagtacgtaacgttcgtacggaaccggaacccggaacgggaaccgacgggtccgtaggttacgttagttacgtacggttacgaccgtaagggaccgttacggttacggttaagggtaaacggtacgggtttaaggttgggggtttagggggggtttacggtttttacgggggtttttttttacggttacgggtttaaggggttacggttacggggg

SEQ ID NO: 122254 - DNA, 972 bp, Homo sapiens
  misc_feature: GYAE6OF01EJDCB.16.87.H10.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtcttttttaaaaggtgtccagtgtgaggagcagctgggtggaggtccgggggagcttagttcagcctgggaatccctggacnctctcgtgtcgcncgcctgtgtactcctaccttanacgaacttaattcggtcgtacgtcgaccgtacggttccgggtacccgaccgaacgtcccgtaccggggaaggggggaacggggtcgtggggttgggttcgggtcctacgtactaattaattaactcgtacgtaggtagggttaatttaacgttacgacccgtaccgggccgtaccgttacccggtaacggacggtcgtagtaaccgtacctacccgtactacgaagaacgaacccaaaccaaccgtaaaacgaacccaaacttaaccgtaattaccgtacgtacggtaacgtaacgttaagtacggtaaaccgtacggttaccggtaaaccgggtaaccccgggtaaacccgggtaccgggtaaacccgggtacccgggttacggtttaacgggtttaacccggttttaaacgttttaacccggggttggtttaaaccggaacccggggttaaaacggggttaaccccggggttttaaacgggtttttaacccggggggtaaaaaaccgggttaaaacggtttttaaacgggggttttttaaaccgggggggggtttttaagggggggggggttttttaacgggggggggtttttttaaacggggtttttttttttttaacccggggggggttttttttttttttaaacccgggttaaaaccccgggggggtttaacggggggtttttaaaacccgggggg

SEQ ID NO: 122255 - DNA, 683 bp, Homo sapiens
  misc_feature: GYAE6OF01C3ISN.16.87.H10.1.454.CMB.1.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
  modified_base (501)..(501): a, c, t, g, unknown or other
  misc_feature (501)..(501): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtacttttttaaaaggtgtccagtgtgaggagcagctggtggaggtccgggggagtcttagttcagccgtagggaagtccctgagacctctccgtgtgcacgcctctggacttcaccttcagctaatttacgnggcctncgacgttcgggccacaacgccgtaccgaggggagggtctggtggtagggtctacacgtaattattaagtcctgaagtacggggtaattaaagtttacgccgtacgccggtaactccggtaagaacggggtcctacgtttcgaacccggttnacccgaagacgaacaaaccaaccaaacgaacacaactaagtanctgacagtaacgttnaccgtatacgtacgaacgaacccggaggaccgtacggcgttagtacgttaacttaggtcgtagacgaaacgggtctaacgggtttaccggaaggtaaaaccgttgggtttaaggttcgggggtttaagggggttacgttttttacggggttttttagtacggttacgggtaggtttacgggg

SEQ ID NO: 122256 - DNA, 736 bp, Homo sapiens
  misc_feature: GYAE6OF01AR82R.16.87.H10.1.454.CMB.1.raw
  modified_base (172)..(172): a, c, t, g, unknown or other
  misc_feature (172)..(172): n is a, c, g, or t
  modified_base (214)..(214): a, c, t, g, unknown or other
  misc_feature (214)..(214): n is a, c, g, or t
  modified_base (308)..(308): a, c, t, g, unknown or other
  misc_feature (308)..(308): n is a, c, g, or t
tcagtgtactactccacgaccggtgctcgatttagcagtactgcgttgggtttggggcccagccctgggattcccagctgtttctgcttgctgatcaggactgcacacagagaacctcaccatggagtttgggctgatctgggttcttccttgttgttacgtttttaaaggngtccagtgtgaggagcagcgtgggtcggacgggtccgggggngtcgttacgtcgacggtccgtagggaactcccgtaggacgtccttccttcccgtgtgaccgccgtcccgtcggtcgtacttccgtaccttcganacttaactgtcggctcgaccgtacggtccgggtcccacgaacggtccggacggaggggacggtcggttgggtggtacggtctcgaagtaattactacgtcgtacggtagttaggggtaatttaacgttacgacccgtacgtacccggtaccgtcccggtagaaccggggtctacgtcccgtaccggtccctacgaacgaacgtaacccgaaactaaccaacgtaaccaacgtaaccttagtaactcacggtacgtaagtccgtaacgtacgtactcggaacggaacccggaccgaacggaacggaccgttgttacgtgtttaaccgtggcgtagaccgtgtacgtaggttcgaagtacggttagggtagggtttgggttacggggttttggttttacgggttttagtcgggtaaggttcgggtacggg

SEQ ID NO: 122257 - DNA, 566 bp, Homo sapiens
  misc_feature: GYAE6OF02ICMZ3.16.87.H10.1.454.CMB.1.raw
tcagtgtactactccacgaccggtgctcgatttagcagtactgcgttgggtttgggctgatctgggtcttccttgttgcttttttaaaaggtgtccagtgtgaggagcagctggtggagtctgggggaggcttggtacagcctgggggtccctgagactctcctgtgcagcctctggattcatctttagcagctatgtcatgacctgggtccgccaggctccagggaaggggctggagtgggtctcagttattggtggtagtggttataccacatactacgcagactcgtgaagggccgttcaccatctccagagacaattccaagaacacactatatctgcaaatgaacagcctgagagccgaaggacacggcctatattactgtgacgaaaggccagggtatagcagtggctggtaccaacgtgggccagggaacccgtggtccaccgtctcctcgacgcctccaccaacgggcccacgtccggtccttccccgtcggccaccccgtccctacccaacgacgaccacccgtcgtcggggcctaccgacgccggccccgtcgggg

SEQ ID NO: 122258 - DNA, 630 bp, Homo sapiens
  misc_feature: GYAE6OF02IR6JP.16.87.H10.1.454.CMB.1.raw
tcagtgtactactccacgaccggtgctcgatttagcagtactgcgttgggtttgggctgatctgggtcttccttgttgctttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggagggctggtgtgggtctcacatattaatctcgatgggagtaatttagcctacgcggactccgtcaagggccgattcaccgtctccagagacaacaccaagaacacactatatctgacagattgacagtctgagacccgaggacacggctgtgtattactgtgacaaggctagttcgtaggaaactaggttagtggggttgggggtagttttgggttttttttacgtacgttacgggtagttgggtacgtcgtggggccggtagggacccggtcgggtaccaccgttcgtccgtcgacgtccctcccgaccgaacgggtcccctaacgttcccggtccgtttccccccgtggaccctacccccgttacccgtacccgaacggtccgtacccgtaccctccggg

SEQ ID NO: 122259 - DNA, 551 bp, Homo sapiens
  misc_feature: GYAE6OF02FQZ23.16.87.H10.1.454.CMB.1.raw
  modified_base (289)..(289): a, c, t, g, unknown or other
  misc_feature (289)..(289): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggagcttagttcagcctgggaagtccctgagactctcctgtgcagcctctggattcaccttcagcaattactggctgcactgggtccncaagctccgagggagggctggtgtgggtctcacatattaatctcgatgggataattagcctacgcggactccgtacaagggccattcaccgtctccagacgacaacaccaaagaacacactatatctgcagattgacagtctgacgacccgaggacacggctgtgtattactgtagacgaggcaggttcgtaggaaactagtttagtgggttagggggtaggttttggggtttttttacgtacggttacgggtagttacggg

SEQ ID NO: 122260 - DNA, 623 bp, Homo sapiens
  misc_feature: GYAE6OF02HH9FQ.16.87.H10.1.454.CMB.1.raw
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtcttttttaaaaggtgtccagtgtgaggagcagctggtggagtccgggggagcttagttcagcctgggaagtccctgagactctcctgtgcagcctntggattcaccttcagcaattacgtggctgcacgtgggtccncaagctccgagggagggctggtgtgggtctcacgtatattaatctcgagtggaattattacgctacgcggactccgcgaaggcctattcgaccgtctcagacgacaacacaagacacactatatctgcatagttagactagtctacgacgtacccggaggaccgacgcgttagtagttaacttacgtagtacgacgtacggtacgttacggtttacggtaacggtaaacgttaacggtttaggttagggggttttacggggggttacgggtttttttaccggggtttttttttaccggttaacgggtttacggggtacgtttaaccggggg

SEQ ID NO: 122261 - DNA, 650 bp, Homo sapiens
  misc_feature: GYAE6OF02IPPTE.16.87.H10.1.454.CMB.1.raw
  modified_base (255)..(255): a, c, t, g, unknown or other
  misc_feature (255)..(255): n is a, c, g, or t
  modified_base (299)..(299): a, c, t, g, unknown or other
  misc_feature (299)..(299): n is a, c, g, or t
  modified_base (453)..(453): a, c, t, g, unknown or other
  misc_feature (453)..(453): n is a, c, g, or t
  modified_base (489)..(489): a, c, t, g, unknown or other
  misc_feature (489)..(489): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtcttttttaaaaggtgtcctaagtgtgaggagcagctggtggagtccggggagtcttagttcagcctgggaagtccctgacgactctcctgtcgcagcctntggtacttcaccttcagtcaattactggctgcacgtcgggtccncaagctaccgagggaaggggctggtgtcgggtctcgacactattaatctacgtagtgggaattaacttacgcctaacggccggtacctcccggtacgaacggggtcctacgttcccgacccgttcctccaaggtacgaaccaaaccaaccaaanaaaccaacaactaactactactcgactagtaattanaaccgtacgtcgtagacgaacccgacggaccgaccggacgttgtacgttacgttactgtagacgaggtcgtaggttacggtaggtaaacgtagttaacggttgggtttcgggggttaggttttcgggtttttttacggtacggtttacgggtagttacggg

SEQ ID NO: 122262 - DNA, 560 bp, Homo sapiens
  misc_feature: GYAE6OF02GK3O9.16.87.H10.1.454.CMB.1.raw
  modified_base (287)..(287): a, c, t, g, unknown or other
  misc_feature (287)..(287): n is a, c, g, or t
  modified_base (330)..(330): a, c, t, g, unknown or other
  misc_feature (330)..(330): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgcttttttaaaaggtgtccagtgtgaggagcagctggtggagtccggggagcttagttcagcctgggaatccctgagactctcctgtgcagcctctggattcaccttcagcaattactggctgcactgggtccncaagctccgaggggaagggctggtgtgggtctcacatattaanctcgagtggggataatttagccttacgcggtactccggtacaagggcctattccaccgtctccagagacaacaccaagaacacactatatctgacagattgacagtctagacgaccgaggacacggctgtgtattacgtgtcgcgaggctaggttcggtagtaaacgtagttagttagggttgggggtaggttttcgggtttttttacgtacggttacgggtagtacggg

SEQ ID NO: 122263 - DNA, 591 bp, Homo sapiens
  misc_feature: GYAE6OF02HE089.16.87.H10.1.454.CMB.1.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (439)..(439): a, c, t, g, unknown or other
  misc_feature (439)..(439): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtcttttttaaaaggtgtccagtgtgaggagcagctggtggagtccgggggagcttagtcagcctgggaatccctgagactctcctgtgcagcctctggattcaccttcagcaattacnggctgcacgtgggtccnccaagctccgagggagggctgggtgtgggtctcacattattaatctacgagtggggaattaattacgcctacggcggtactccggtacgaagggtcccattccgaaccgttctccgagagacaaacaaccaagaacacactatactactnactagattgactagtctgacgaccggagacgacggctgtacgtattactgtgacgaggcgtaggttacgtaggtaaacgtaggttaggttggggtttagggggttaggtttttcggggtttttttacgttacggttacgggttagttacggg

SEQ ID NO: 122264 - DNA, 679 bp, Homo sapiens
  misc_feature: GYAE6OF02G6DMV.16.87.H10.1.454.CMB.1.raw
  modified_base (168)..(168): a, c, t, g, unknown or other
  misc_feature (168)..(168): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgcttttttaaaaggngtccagtgtgaggagcagctggtggagtccggggagcttagttcagcctgggaactccctgagactctcctgtgcagcctctggattccaccttcagtcaattacgtggtctgccacgtggggtcccgaccgaagcctaccgaggggtaacgggtctgggtcgtagggtcctacgaactattaattaatcgtacggtaagtaggggtaagtttaacgttttacggcccttaacggccggtaaccttccggtacgaacggggcctattccgacccgttctacccgagacgaacctaaccaaccaaacgaaccaactaactactactactagacagtattacgacgtacgtcgtagacgaccggaaggaccgacggtcttcgttagttaacttacgttgtacgtacgtaggtaccgtaggttacggtaaggtaaacgtaggtttaggttaggggttaggggggtttacgtttttcggggtttttttacggtacggttacggggtagttacggg

SEQ ID NO: 122265 - DNA, 844 bp, Homo sapiens
  misc_feature: GYAE6OF02F2FXC.16.87.H10.1.454.CMB.1.raw
tcagtgtactactccacgaccggtgctcgatttagcagtactgcgttgggtttggggcccgagccctgggattcccagctgtttctgcttgctgatcaggactgcacacagagaactcaccatggagtttgggctgatctgggtcttccttgttgtcttttttaaaaggtgttaccagtgtgaggagcagctggtggagtccggggagcgttagttcagcctggggaactcccgtagtacgacttcctctgtagcacgcctcgtaggactttcgaccttcacgtactaaagtttacgcggtcttaggccgtacgtcggggttccccgacccgaagtcccgtaacccggaggggaaacgggggccgttggggtcggttacggttccgtaacaaccgttagttaaactttagtccgttaacggagttacgggggtaattaaacgtttcggaacccttacggtaacggtaccgttccggttaaccggaaggggtacccgtacgtttaccctaaccggttcctaacccggaaggtacgaaccctaaacgaacccgaaaaaccgaactaacccaacctttaaaacgtaacgttccgaacgtactaagtaacgtttagggaaaccttacgttcgtaacgtaaccgtaacccggaaccggaaccgttaccggaccgtttacggtagttaaaccgttttacctgggttaccgacggtaacggtaccttaacggtttacggtaaacgggttaaaccgtaaggttttaaggttaaccggggggtttggggggttcggttttttttaaaggggtttttttcccgggtaaaggtttccgggggttaattaccgggg

SEQ ID NO: 122266 - DNA, 677 bp, Homo sapiens
  misc_feature: GYAE6OF02JKR93.16.87.H10.1.454.CMB.1.raw
  modified_base (168)..(168): a, c, t, g, unknown or other
  misc_feature (168)..(168): n is a, c, g, or t
  modified_base (297)..(297): a, c, t, g, unknown or other
  misc_feature (297)..(297): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttcttgttgtcttttttaaaaggngtccagtgtgaggagcagctggtggagtcgggggagcttagttcagcctgggagtccctgagacctctcctgtgcagcctcgtggacttcaccttcagctaattactggctcgcgtacgtcgggtaccnccaagccgtaccgaggggacgggtctgggtgtcgggtcctgactatagttaatcgtacgtagtgggtaacttacgttacgtaccgtacggaccgtacgtacccggtagaaccgggtccgtaacgttccgacccggttctaaccgaggtaacgaactaaaccaaccgaaacgaacaacctaacgtactactactacggctacgtattacgacgtagtactacgaacgaccgacgacgcgtacgtagttacgttacgtactggtacgacgtacggtagtacgttacgggtaacgtaacgttaaggttacgggttagggttagggggtttacgggtttttacgggttttttacggttacgggttacgggttacggttacgggg

SEQ ID NO: 122267 - DNA, 787 bp, Homo sapiens
  misc_feature: GYAE6OF02HTBS1.16.87.H10.1.454.CMB.1.raw
  modified_base (169)..(169): a, c, t, g, unknown or other
  misc_feature (169)..(169): n is a, c, g, or t
tcagtgtactactccacgaccggtgctcgatttagcagtactgcgttggggtttggggcccagccctgggattcccagctgtttctgcttgctgatcaggactgcacacagagaactcaccatggagtttgggctgatctgggtcttccttgttgtactttttaaaggngtccagtgtgaggagcagctgggtagggaggtccggggggagtcgtttagttcacggccgtagggaactcccgtgagtaccttctcctggtcgcgtacgcccttcgtggtacttcctaccgtttcagtactaattacgtggctcgactacgtcggggtcccgaccgtaaaggccgtaccggaagggggtacgggggtccgtgggggtggtcggggttccttacgaacgtatttaactttaacgtcgttacggaggtacggggttaactttaaaccgttacggcccgtaacggtcccgggtaaccgttccggtacggtaaacggggtaccctagtttaccccgacccgtcccgtaccgaacggaacgtaacccaaaccaaaccgtaaaacgaaactaaccgtaacttaacgtacttaccgtacgacgtagtacttaggaccgtaagtcgtacggacgacccggaaggccgacggtcgttagtagttaacgtacgtagtcgacgacggtcgtagggttaaccggaaggttaaacggtacgggtttaggtacggggggttttaggggttacggttttttacggggttttttacggtaacggttacggggttagttacgggg

SEQ ID NO: 122268 - DNA, 760 bp, Homo sapiens
  misc_feature: GYAE6OF02HPJ73.16.87.H10.1.454.CMB.1.raw
  modified_base (170)..(170): a, c, t, g, unknown or other
  misc_feature (170)..(170): n is a, c, g, or t
  modified_base (185)..(185): a, c, t, g, unknown or other
  misc_feature (185)..(185): n is a, c, g, or t
  modified_base (281)..(281): a, c, t, g, unknown or other
  misc_feature (281)..(281): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtacttttttaaaaggngtccagtgtgaggancagctggcggagtccgggggagcttagtcagcctgggaatcctgagactctcctgtcgcagcctcgtggtacttccaccttgagtacaatttacgnggtactgctacggtcgggtacccacctaagcctaccgggaaggggacgggggtctggggttcgtgggtacctacgactaattagttaactcgtacgagttaggtaagttaaactttacggccctaacggccggtaaccgttacccggtaacgaacggggtccctaacgtttccggaacccggttaccttacccgaacggtaacggaaaccctaaacccgaaaccccgtaaaacgaaaacctaaaccgtaaccttaacgttactaccgtacggaccgtaaggttaacgttacgaaccgttacgtacgtaacggaacggaacccgggtaacggaccgtaacggcgttagtacgttaacgttacgtagtgtacgaagtccgtaaggttacgtacggtaaacgttacggttagggttggggtttagggggtttacgtttttaccggggttttttacggtaacggttacgggtaggttaccggg

SEQ ID NO: 122269 - DNA, 728 bp, Homo sapiens
  misc_feature: GYAE6OF02IZRDM.16.87.H10.1.454.CMB.1.raw
  modified_base (255)..(255): a, c, t, g, unknown or other
  misc_feature (255)..(255): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtctttttaaaaggtgtccagtgtgaggagcagctggtggagtccggggagtcttagttcagccgtgggaactccctgacgactcgtcctgtgcagcctcgnggtacttccaccttcagtacaatttaccgtggcttcgctacgtcggggtcccacccgtaagcctaccggaaggggtaacggggcgttaggggtgtcggggtctcaacgtattagttaactcgtcgaggtggtaagttaacttacgtacctaccggtcggtaccttaccggtacgaacggggtccctaactttcccgacccgttcctacccgaaggacgaacccaaacctaaccgaaacgaaacccactaaactacttaacgtcctagaccgtagtacgttcgaacgtcgttactacggaaccggacccggaacggtaccgtaccggtcttaggtacttaacgttacgtgtacggacgtacgggtcgttacgggttacggtaacggtaacgtaggttacggtttagggggttcgggggtttacggtttttcggggttttttacgtaagggtttaccggggtatttacccggggg

SEQ ID NO: 122270 - DNA, 1044 bp, Homo sapiens
  misc_feature: GYAE6OF02HPJDJ.16.87.H10.1.454.CMB.1.raw
  modified_base (133)..(133): a, c, t, g, unknown or other
  misc_feature (133)..(133): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggntgatcgtggtcttccttgttgtactttttaaaggtgtccagtgtgaggagcagcgtgggtgggaggtccgggggagtctttagtcacgtcggtaggtacgtccgtagacgtaccttcctcgtgtcgacgtaccgtccgttcgtacggtaccttcccttaccttacgacgtaaccttaacgttaccggtcggtcgtacgtacgtaccgggttcccgggtacccgaacccggtaacggtaccccggtaacgggggtaacggggggaccggggtttcgggttcggggttcgggttaccgggttacccgttaaccgtaacgtttaaacgtttaaacgttttaaccggttaccgttaacgggttaacggggttaaagggtttaaacggttttaaaccggttttacccggtaccccgggtttaaccggggtaccccgggtttaaccccggtttaacccggggtaaacccgggtaacccgggggttaaccccgtttaacccgtttaacccccgggttaccccggttaacccgttaacccgggaaacggtaaaccccgtaaaacccgtaaaaccccgaaaaacgggtaaaaccctaaaacccgtaaaaccctttaaacgttaaaccttaccggttacgtaacgtaaccgtaagttaacgtacgtaacgtacgttacggacccgggtaaacccggaccggtaaccggtaccggtaccggtaggttaacgtttacgtttaccgttacggtaacgtacggtacgttaacgggtacgtttaacgggtaaacggttaaacggtaacgggtttaaggggttttacgggggggtttagggggtttttaacggggttttttcggggttttttttaaccgggtttttaacgggtaaaggggtttccggggttaaagggttcccggggg

SEQ ID NO: 122271 - DNA, 771 bp, Homo sapiens
  misc_feature: GYAE6OF02I40RQ.16.87.H10.1.454.CMB.1.raw
tcagtgtactactccacgaccggtgctcgatttagcagtactgcgttgggtttggggcccagccctgggattcccagctgtttctgcttgctgatcaggactgcacacagagaactcaccatggagtttggctgatctgggtcttcttgttgtctttttaaaggtgtccagtgtgaggagcagcgtgggtgggagggtccgggggagtcgtttagttcaggccgtaggggaacgttcccgtaggagaccttcctccgtggtcgacacgtcctcgtggtacttccaccttcgagcctaagttacgtcggtctcgaccgacggttcgggtcccgacctaacggcccgtaccggggaaggggtacgggggtcctggggttgggttacgggttcctacgtaacgtaatttaacttagtaccgtcggtaggtaggggttaaatttaacgtttacggacccgtaccggcggtacccttccgggtacggaacggggtaccttacttacccgacccgtccgtaccgaacgacgaaccaaaccgaacaaacgaacctaacctaactacttatccgtacgacgtaagtacttagaccttaggtactacggaccgaccggaggaccgtacgtcgtcgtacgttcgttacgttagagtaccggagtcgtacggtacggtaacggttaaacggtacggtttagggttacgggggttttagggggtttacggtttttttcggggttttttaacggttaccgggtttacgggtacggttacggggg

SEQ ID NO: 122272 - DNA, 891 bp, Homo sapiens
  misc_feature: GYAE6OF02JBE9N.16.87.H10.1.454.CMB.1.raw
  modified_base (181)..(181): a, c, t, g, unknown or other
  misc_feature (181)..(181): n is a, c, g, or t
tcagtgtactactccacgaccggtgctcgatttagcagtactgcgttgggtttggggcccagccctgggattcccagctgtttctgcttgctgatcaggactgcacacagacgaactcaccatggagttggctgatcgtggtcttccttgttgtactttttaaacggtgtcctagtgtcgnggagcaggtctgggtggacggtcccggggggtaggccgttttagttaccgacggtcccgtaggggaaccgttcccgtggacgtacctcgttccctggtcgacacgtcccttgtacggtacttccgtacctttccggaataccctaaacgttacgtcggtcgtacgacccgttaccggtccgggttcccgacccgtaacggcccgttaccgggaacggggggtaccggggttccggttggggtttcggtacgggtttacctacttaaccggtaattttaacgtttaacttaccggttacgggttacggttagggggtttaaaacctttagttttaccgggtaaccccggttacggacccggtaacccgtccgggtttaccgggaacgggtacccgtacttccccgaaccggttccctacccggattacgggaaaccctaaacgaacccgaacggaaacctcaaaccgtttatacgttacaccgggtactagtaccgttcgtaaacgtcgttccggtaaccgaacggggttcccaagggtaccgaccgtcgttacggttacgtttaacttcgtcgggttacaacgtacgggtactcgggtttaacgtaacgggtaaccttagggttagggttttaccgggggttacgggttttttacggttttttacgggttttttaacccgggtggttttaaccgggtacggttccggggg

SEQ ID NO: 122273 - DNA, 755 bp, Homo sapiens
  misc_feature: GYAE6OF02FQ5C1.16.87.H10.1.454.CMB.1.raw
  modified_base (170)..(170): a, c, t, g, unknown or other
  misc_feature (170)..(170): n is a, c, g, or t
  modified_base (185)..(185): a, c, t, g, unknown or other
  misc_feature (185)..(185): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgtacttttttaaaaggntcctagtgtgaggancagctgggtggaggtccgggggagtcttagtcagccgtaggggaatccctgacgtactctccgtagcgtacacgtccttacgtggtacttcaaccttcaagtctaaacttcgtggctgcctacggtcgggtaccccaccgaacgtccgtaccgggaagggggtacgggtcgttaggggtcggtcgggtcctacgacgttattaaattacgttcgtcgtaagttacgggtaagtttaacgtttacaccgttacggccggtaccgttcggaaccgtaacggggacctattccggacccggttactccgtaacggacgtaaacaaaccgaaaccaaaacgaaacctaaccgtaacgttaactaactaccgtacgacgttaagtacgttacgtagtacgtagtaccggaacgtaacccggaggaccgtaccggtctaggttcgtaattacgtagtacgaggtacgtcggtacgggttacggtaacgtaaacggttaaggttacgggtttaggggtttacgggggttcggtttttacggggttttttaccgtgggttaaccgggttggttacggg

SEQ ID NO: 122274 - DNA, 897 bp, Homo sapiens
  misc_feature: GYAE6OF02GH82V.16.87.H10.1.454.CMB.1.raw
  modified_base (195)..(195): a, c, t, g, unknown or other
  misc_feature (195)..(195): n is a, c, g, or t
tcagtgtactactccacgaccggtgctcgatttagcagtactgcgttgggtttggggcccagccctgggattcccagctgtttctgcttgctgatcaggactgcacacagagaactcaccatggagtttgggctgatcgtggtcttccttgttgtacgtttttaaaggtgtcctagtgtgaggagtcagcgtggngggacggtccgggggagtcttaggttcaggcctagggactcccgtagagacctctctgtgcagtcctcgtgtacttctaccttagacgtactaacttacgtcgtctacgactaccggtcgggtaccgaaccgacgtccgtaccgggaacggggtagggtcggtacgggtcggtcgggtacctacgactacgttaattaacgtcgtacgaggttaagggtaactttaaacgttacggaccttaccgggtacccggttacccgtaaccgggttaccggaacggggtacccgttaaccgtttcccgtaacccggtccctaacgggtactaaccggaaaccctaaacccggtaaaccgtaaccggaaaaccccgtaacgttaaccgttaaaacttaaccgttacccggttacggtaaaccgttaaccgttacggttaacccggtaaaccgtaacggtttaccgtaaaccgggaaccggtaacccgggaaaccggggaccggtaaccgggtttacgtacggtttaacggttaacctttaacgggtcgtacgtaaccgggtaacggttcccggtaagggtttaacccggtaagggttaaacggtttacggggttaagggttttacggggggtttagggggttttaccgggttttttaccggggttttttaacgggtaacggtttacggggttacgggttaacccgggg

SEQ ID NO: 122275 - DNA, 403 bp, Homo sapiens
  misc_feature: GYAE6OF01CA6K1.14.77.G11.1.454.CMB.1.raw
  modified_base (396)..(403): a, c, t, g, unknown or other
  misc_feature (396)..(403): n is a, c, g, or t
tcagcgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttgggccagggaaccctggtcaccgtctcctcagcctccaccaagggcccatcggtcttccccctggcaccctcctccaagagcacctctggggcacagcggccctgggctgcctggtcaaggctacttccgtactagacgctgagcggctggcaaggcgcatagnnnnnnnn

SEQ ID NO: 122276 - DNA, 468 bp, Homo sapiens
  misc_feature: GYAE6OF01DC6C8.14.77.G11.1.454.CMB.1.raw
  modified_base (456)..(468): a, c, t, g, unknown or other
  misc_feature (456)..(468): n is a, c, g, or t
tcagcgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagattgttctcggttgggccagggaaccctggtcaccgtctcctcacgcctccaccgaacgggcccactccggtccttcccccgtggcccacccctcctccaacgacgccacccgtcggtcggggcctacgacggccggccccgtggggcctcgcccgtggtaccgaaacgggtacctaccgttccgtaactacggacgtcgtcggacggtcgggctgggacaagggccgacagtagnnnnnnnnnnnnn

SEQ ID NO: 122277 - DNA, 404 bp, Homo sapiens
  misc_feature: GYAE6OF02GINBF.14.77.G11.1.454.CMB.1.raw
  modified_base (398)..(404): a, c, t, g, unknown or other
  misc_feature (398)..(404): n is a, c, g, or t
tcagcgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaaccctggtcaccgtctcctcagcctccaccaagggcccatcggtcttccccctggcaccctcctccaagagcacctctggggcacagcgccctgggctgcctggtcaaggactacttccgtactagacgctgagcgggctggcaaggcgcatagnnnnnnn

SEQ ID NO: 122278 - DNA, 402 bp, Homo sapiens
  misc_feature: GYAE6OF02HIDNP.14.77.G11.1.454.CMB.1.raw
  modified_base (400)..(402): a, c, t, g, unknown or other
  misc_feature (400)..(402): n is a, c, g, or t
tcagcgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaccctggtcaccgtctcctcagcctccaccaagggcccatcggtcttccccctggcacccctcctccaagagcacctctgggggcacagcggccctgggctgcctggtcaaggactacttccgtactagacgctgagcgggctggcaaggcgcatagnnn

SEQ ID NO: 122279 - DNA, 410 bp, Homo sapiens
  misc_feature: GYAE6OF02I5Z84.14.77.G11.1.454.CMB.1.raw
  modified_base (397)..(402): a, c, t, g, unknown or other
  misc_feature (397)..(402): n is a, c, g, or t
  modified_base (404)..(410): a, c, t, g, unknown or other
  misc_feature (404)..(410): n is a, c, g, or t
tcagcgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaaccctggtcaccgtctcctcagcctccaccaaggcccatcggtctccccctggcaccctcctccaagagcacctcgtggggcacagcggcctgggctgcctggtcaaggctacttccgtactagacgctgagcgggctgggcaaggcgcatagnnnnnngnnnnnnn

SEQ ID NO: 122280 - DNA, 499 bp, Homo sapiens
  misc_feature: GYAE6OF01EPEKZ.53.5.A05.1.454.CMB.1.raw
  modified_base (348)..(348): a, c, t, g, unknown or other
  misc_feature (348)..(348): n is a, c, g, or t
  modified_base (493)..(493): a, c, t, g, unknown or other
  misc_feature (493)..(493): n is a, c, g, or t
tcagcgcgtatacacacgaccggtgctcgatttagatagatagacaggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctgagggatccctgagcgattctctggctcaactcaggacaacngtcacgttgaccatcggtggagtccaggcagaagacgaggctgactattactgtcaatcagcaggcagcagtgacgtgtgtcgtttcggcggaggacaagcgtagaccgtcgtacgtcgacgcccaacggctcgccccgtcgtcncgtccg

SEQ ID NO: 122281 - DNA, 527 bp, Homo sapiens
  misc_feature: GYAE6OF01B5SBI.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatggattgccaaagcactatggttactggtaccaacagaagccaggccaggccccctctattggtaatgtaataaagacaatgagaggccctcagggatcccgtgagcgattctctggctccaactcaggacaacagtcacgttgaccagtcggtggagtccgaggcagaagacgaggctgactattactgtacaatcagcaggcagcgagtaggaactgtgtcgtttcgggcggtagggaccaagccgtacggaccgtccgtacgtcgacgcccgaacggcctccgcccccgtcgtcctccgtcccg

SEQ ID NO: 122282 - DNA, 518 bp, Homo sapiens
  misc_feature: GYAE6OF01CJ71O.53.5.A05.1.454.CMB.1.raw
  modified_base (276)..(276): a, c, t, g, unknown or other
  misc_feature (276)..(276): n is a, c, g, or t
  modified_base (510)..(510): a, c, t, g, unknown or other
  misc_feature (510)..(510): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaaagccaggccaggcccctntattggtaatgtataaagacaatgagaggcctcagggatccctgagcgattctctggctccaactcagggacaacagtcacgttgaccatcggtgagtcaggcagaagacgaggctagactattactgtcaatcagcagcagcagtaggtaactgtgtcgtttcggcggacgggacgaagtcgtacgaccgtacctacgtcgacgacccgaacggcctaccgcccctccggtcncgttcccg

SEQ ID NO: 122283 - DNA, 631 bp, Homo sapiens
  misc_feature: GYAE6OF01CLFI5.53.5.A05.1.454.CMB.1.raw
  modified_base (280)..(280): a, c, t, g, unknown or other
  misc_feature (280)..(280): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatggattgaccaaagcactatggttactggtaccaacagaagccaggccacggcccctntagttggtaatgtaataaagacaatgagacggccctagagggtactccgtggacgcgtattcctcgtggccttaccgaaactcgaagggaaccaacgtacgtaccacggtttcgaaccgtagtcgggtaggacgtccgaggacgaaggaaggacggaggtactacgaattaacgttctagtacaactacgacgacgagggacaggacctaggtaacggtaacgtggttacgttccggtttacgggacgggaacgggacccgaaaggtccgtacggtacccgttccgtacggtccgaccggtacccgaacggtcccacccggtacccccgtcgggtacctccgtttccccgg

SEQ ID NO: 122284 - DNA, 631 bp, Homo sapiens
  misc_feature: GYAE6OF01D2DBW.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtaataaagacaatgagaggccctcagggatccctgagcgattctctgctccaactcgagggacaacagtcacgttgaaccagttcgggtaggacgtccgaggaccgaaggaacggacggacggtacgtagaacttaattactagtactaatcgaacgcgaggacaggactaggtaggtaaccgttaggttcgttaccgttttacggggaccgggtaacgggacccgtaaaggtccgttaccgggtaaccccggttacccgtaaccggttaccgaaccggtaccccgtaaacgggtcccgttacccggacccccccgttccgggttaccctaacccgtttccccgg

SEQ ID NO: 122285 - DNA, 641 bp, Homo sapiens
  misc_feature: GYAE6OF01BCKPC.53.5.A05.1.454.CMB.1.raw
  modified_base (257)..(257): a, c, t, g, unknown or other
  misc_feature (257)..(257): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatggattgaccaaagcactagtggttactggtaccaanagaagccaggccacggcccctactattggtaatgtaataaagacaatgagaggccctgagggactccctgacgcgtattcctcgtggctaccgaactcgaacgggaacaacaggtaccacggtttacgaacccagttccgggtaggacggtccgaaggacgaaggaaacggacggaaggcgtagaaccttattaaccgtgtacaatcgaagcgaacggtcacgactaggtacggtaaccgttggtcgttaccggtttacggggcgggaaacgggtaacccaaaggtccgttaccggaccgttacccgtaacggtcccaccggtaccccgaacgggtcccgtaccccgggtaccccccgtttaccggtccgtaacccgttccccg

SEQ ID NO: 122286 - DNA, 557 bp, Homo sapiens
  misc_feature: GYAE6OF01BY1KV.53.5.A05.1.454.CMB.1.raw
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatggattgaccaaagcactatggttactggtaaccaacagaagccaggccaggcccctntattggtaatgtaataaaagacaatgagtacggccctagagggactcccgtagacgtcgattcncgtggctacaactcgaaggaccaacagtacacgttcgaccagtcggaggacgtcgaggacaggaagacggaggactacgactattactagtacagtacagacagcagacaggtagtacgtgttcgtcgtttcggacggtacggaccgaacgcgtacgtacccgtactacggtcacgacccgaacggccgtccgaccccgtcgtccgtcgtcccg

SEQ ID NO: 122287 - DNA, 698 bp, Homo sapiens
  misc_feature: GYAE6OF01AKLH5.53.5.A05.1.454.CMB.1.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgaccaaagcactatggttactggtaccaacagaanccaggccacggcccctntattaggtaatgtaataaagacaatgagacggccctagagggactcccgtgacgcgtattccgtcgtcggcctaccaacgtccgaagggtaaccaacgtacgtacctaacggtttacgaacccgtaggttccgggtaggtacgtaccggaacgggacgaaggaaacgggaacggtacgggaccttacggtaacttacgttaacgtcggtaacctaacgtacgacgacgtaccgggactaacggtacgaacgggttacggtaaccgttggttacgggttaccggttttcgggaacggggtaccggtaaaccgtacggtaccggtacccggtacccgttacccgttaccggtaccgacccggaccccgaacgggtccccgtaccccggtaccccccggtccggttcctccccgtttaccccgg

SEQ ID NO: 122288 - DNA, 742 bp, Homo sapiens
  misc_feature: GYAE6OF01A5286.53.5.A05.1.454.CMB.1.raw
  modified_base (320)..(320): a, c, t, g, unknown or other
  misc_feature (320)..(320): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtacaacagaagccaggccaggcccctctattggtaatgtataaagacaatgagaggccctagagggactccgngacgcgtacttcgtcgtcggacctaccaactcggaacgggaacaacgtacgtaccgtaacggtttacgaaccctaggttcgggtacgggtacgtaccgacggtacgaaggaaacggaacggacggacgtacggtaacttaacgttaaccgttacggtaacctaacgtaccgtaacggacgaacgggtccgaacggtacgtaacgggttacgggtaaccgttacggtttacggtttaccgggttttaccgggggaccggggtaaaccggggtaacccgaaacgggtacccggttaccggtaacccccggttacccggttaaccggtacccggtaaacccgggtaacccccgtaacggggtaccccgttaccccgggtacccccccggtttaccgggttaccccgttacccgtttaccccccgg

SEQ ID NO: 122289 - DNA, 303 bp, Homo sapiens
  misc_feature: GYAE6OF01EE4C5.53.5.A05.1.454.CMB.1.raw
  modified_base (301)..(303): a, c, t, g, unknown or other
  misc_feature (301)..(303): n is a, c, g, or t
tcagcgcgtatacacacgaccggtgctcgatttagatagatagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcactctgttcccgccctcctctcgtactgcgctgagcgggctggcaaggcgcatagnnn

SEQ ID NO: 122290 - DNA, 666 bp, Homo sapiens
  misc_feature: GYAE6OF01A74AA.53.5.A05.1.454.CMB.1.raw
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatggattgaccaaagcactatggttactggtaaccaanagagccgaggccacggcccctntagttggtaatgtaataaagacaagtgagacggccctcgagggacttcccgtaggacgtacgtacttccgtcgtacggaccttacccgaaaccttacggaacgggaacctaacgtacgtaccgtacgttacggaaccctaggtcgggtacgggtacgtacccgaggacgaaggaacggacggacggctagtaacgttattacgtcgtacaactcgaagacgagcgagacgaggtacggtaacgttcggtacgttcggtttccgggacgggacgggtaaccgtaacggtccgttaccggtacccgtacccgttacggtaccgaccggtaccccgaaacggtcccttacccggtaccccccggttcggtacccgtccgttaccccgg

SEQ ID NO: 122291 - DNA, 677 bp, Homo sapiens
  misc_feature: GYAE6OF01AHGRO.53.5.A05.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (554)..(554): a, c, t, g, unknown or other
  misc_feature (554)..(554): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccgagacncacgtnctcgtggagagtgtatcgaaccaagctactagttacggttacgtacggtaaccaacgaagaccgaccgaccggaccgacccggtccccttacgttaggtttaacggtaagttagtaaacgttaaacgaactaagtaggacggacccggtacccgtacgggaacggtaccttcccggtagacggtacttacgtttcctcggtcgtaccctaacccacgtacggaacggaacaacgtacgtaccgtacgtaccgacgtcgggtcgggtacggacgtaccgaggacgaacggaaggacggtaggtcgtaactattacgtacgtacgtaactacacgagcgagacngacggtaggtagtacgttgttacgttcggtaccgggacgggaacgaccgacgtccgtaccgtcccgtagtaccgacgaccgtaccgacgtcccctcccgaccccgttcgacctccgttccccg

SEQ ID NO: 122292 - DNA, 737 bp, Homo sapiens
  misc_feature: GYAE6OF01DNAPJ.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatggattgccaaagcactagtgttactggtaccaacagaacgccaggccacggccccctatattggtaatgtaataaagcaaatgagacggccctagagggactcccgtgacgtcgtattctcgtgtacctaccaaaccgtgaacggggacccaaacgtacgtaccgtaaccggttaggaacccctaaggttaccggggttacgggaacggttaacccgaacgggaccgaaagggaaacgggaaccggtaagggtacctacgggtaacctttaacgtttaaccgtacggttaacgaacttaccgaacggacacgggaccggaagaccgtacggtagggtaaccttagggttacgtaccgggtttttacgggaacgggtaacgggtacccgaacggtacccgttacggtaacccccgttacccggttaaccggttacccgaacccggaccccgtaaaccggggttccgtacccccggttacccccggttcccggttaccccgtaacccgtttcccccggg

SEQ ID NO: 122293 - DNA, 666 bp, Homo sapiens
  misc_feature: GYAE6OF01BAOH3.53.5.A05.1.454.CMB.1.raw
  modified_base (278)..(278): a, c, t, g, unknown or other
  misc_feature (278)..(278): n is a, c, g, or t
  modified_base (337)..(337): a, c, t, g, unknown or other
  misc_feature (337)..(337): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatggattgaccaaagcactatggttactggtaaccaacagaagccaggccaggcccctntattaggtaatgtaataaagacaatgagacggcctacagggactccgtgagcgtattcnctgctaccaacgtcgacgggaacaacgagtacctacgttacgaccgtagtcgggtaggtacgtaccgaagggcgaaggaaacgacggtaggctagtacttacgttaacgtagtactaacgtcaaggtacgacgggacaacgtacgtacgggtacggtaacgttggttcggttaccggttttacggggaccggggtaacggggtaaccctaacgggtaccgttaccgggtaccccgttacccggttaacggtacccgaaccggaccccggtaaacggtccccgttacccggtaccccccggtttacccggtcccgtaacccgtttccccg

SEQ ID NO: 122294 - DNA, 835 bp, Homo sapiens
  misc_feature: GYAE6OF01CNJ4L.53.5.A05.1.454.CMB.1.raw
tcagcgcgtatacacacgaccggtgctcgatttagatagatagacagggggctgtgggtccaggaggcagaactctgggtgtctcaccatggcctggatccctctacttcctcccctcctcactctctgcacaggctctgacggcctcctatgagctgacacacgcccacccgtcggtgtcagtcgtccccgaggaccaggaccggccaggactccacctgctcgtaggagagtaggattcgaccaaagccaacttagtcggttaacgtacggtaaccaacgaaggaacgccgacggaccgaccggtcccccttacgttagttacgggtaattacgtaaagtaaaacgacgtaagtacggaacggtaccggtacccgtacggacgggtacctcccgtaggacgtacggtactttccgtacgtacggtacctaacccgtaacgtaccggaacggtaacaacgtacgtaccgtaacggttcgaaccgtaggtaccgggtacggaccgttaccgaacgggtacgaaaggaacgggaacggtaggtaccgttaaggtaacctttaacgtttaaccggtactaaccgtaacgttaccggaacggaccggtaacggacgtaaaggaccggttaaagggtaccgggttacgttacggggttaaccgggttttcccggggtttaacgggggaacccggggtaacggtaacccggtaaacgggtacccggttacccggtaaccccggttaccggtaacccggttaccgaacccgggtaccccggtaacggtccccgttaccccgggttacccccgttacgggttccctaccccggtttccccgg

SEQ ID NO: 122295 - DNA, 651 bp, Homo sapiens
  misc_feature: GYAE6OF01C0BUY.53.5.A05.1.454.CMB.1.raw
  modified_base (164)..(164): a, c, t, g, unknown or other
  misc_feature (164)..(164): n is a, c, g, or t
  modified_base (228)..(228): a, c, t, g, unknown or other
  misc_feature (228)..(228): n is a, c, g, or t
tcagcgcgtatacacacgaccggtgctcgatttagatagatagacagggggctgtgggtccaggaggcagaactctgggtgtctcaccatggcctggatccctctacttctcccccctcctcactctctgcacaggctctggaggcctcctatgagctgacacngcccacccgtggtgtcagtcgtccccaggacacggacggccaggactccacctgctcgtggagntggattcgaaccaagcacgtagtgttactggaaccaacgacgacgccgacggccaccgtccccttattagttaggtaatagtaaataaacgactaagtacggaggaccggtacccgtacggaacgggtcctacccgtaggacgtcggtacttccgttcgtacggtccctaacccgaacgttcggaaacggtaccaacgtacgaccgttacgtacgaccgtagtccgggtaggaccgtacgaggaacgagaaacggacgacggtactaagtacttataacgtatacgaacgtcgacggtacaggtcaacgtggtaacggttagtacgtggttacgttcggttacggacgggaacgacgacgtcgaccgtaccgtcttacggcgaccgacccacggtcctacccggccctcggtcctccgttccg

SEQ ID NO: 122296 - DNA, 620 bp, Homo sapiens
  misc_feature: GYAE6OF01E31GR.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctctatgagctgacacacgccaccctcggtgtcagtcgtccccaggacaggaccggccaggatccacctgcctctggagatggattgaccaaagcactagtggttactggtaccaacagaagccaggccaggcccctatattgtaactgtaataaagacaatgagacggcctcgaggtctacccgtgaagcgtattcgtacgtggctaccaactcgacgggacaacgtagtacctacgttcgacctacgttcgggtacggtacgtccgtaaggccgtaaggaaaggaaccgaggtctagtaacttattacgtgtacaatacgaacgcgtacgggacagaccgaggttacgacgttagttcgtccggttttacgggacgggtacgggaacctaccggtagtacccggtaccgttccgaacggtaccaccgaccgtaacggcccgtacccggtaccccttcggccgtacccttacccg

SEQ ID NO: 122297 - DNA, 721 bp, Homo sapiens
  misc_feature: GYAE6OF01BF4T6.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccacccgtcggtgtcagtgtccccaggacagacggccaggatcactgctctggagatggattgaccaaagcactatggttactggtaaccaacagaacgccaaggccacggtccccttctaagtttacggtaagtgtaagtaaagtacaaagttcgaggacggcccttacgagggtactccccgtggacgtcgtaatttccgcgttacggcctacccaaaccgtcgaacggggaaccaaacgaggttaccaacggtttcgaacccctaaggttccgggttacggacgttaccgaacgggtacgaaggaacggacggaaggctaacggtacttacgttaacgtcgttacgtaactcgaacggtacgaacgggacacgggacgtaagggtacggtaaagtttcgggttcgttacgggttttcgggaccggggttaaccgggaccgtaaaggtcccggttacgggtaaccccgttaccggttaccggccgttaaacccggcccggtaaaggtccctacccggtaccccccgttaccgggttccccttaacggttcccccgg

SEQ ID NO: 122298 - DNA, 841 bp, Homo sapiens
  misc_feature: GYAE6OF01BG2Q0.53.5.A05.1.454.CMB.1.raw
tcagcgcgtatacacacgaccggtgctcgatttagatagatagacgagggggctggtgggtccagggaggcagaactcgtgggtgtctcaccatggcctggactccctctaccttcctcccctcctcactctctcgcacgaggcctcgtaggacggtccttactagtggacgtcgtacgaaccaacgacgacccgtacccgttcgggttcgtccgtacggttccgtaccccgaaggaaccgaacgggaccgggaccgaacgggtacctacctaccgtcgtccgttacggtagggtacgtaggtacggtaacttacggaaccgaaacgtactaacgttaggttacggttaacgtacggtaaaccaacgaacggaaccgaccggaacggacccgtaccggttaccccgttaacgtttaaggttaacggttaagttaacggtaaaacgtaaaacggaacgtaaggtacgggaacggtaccggtacccggtacgggtaacgggtacctaccggtagtaccgtacgttacgttccgttacggtccggtacctaaccgtaacgtacggaacggaacgtaacgtacggtaccgtacgttacggaaccgttacggtacgggtacgggaccgtacggacggaacgaagggtaacgggaacggtacggtacgttacgttaaaccttacgttaacgtacgtaaactaacggacgacgacggacgacgtaacggacgtaggtacgtacgttcggttcggttacgggtacggacgggaacgacgtacgacgtaccgtaccgtacgacgtccgaccgaccgaccggtccgtcccgtacccgtcgtcctcgtaccc

SEQ ID NO: 122299 - DNA, 541 bp, Homo sapiens
  misc_feature: GYAE6OF01AWNDV.53.5.A05.1.454.CMB.1.raw
  modified_base (451)..(451): a, c, t, g, unknown or other
  misc_feature (451)..(451): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgaccaaaagcactagtggttactggtaaccaacgagaagccaggccacggcccctctattggtaatgtaataaagacaatggagacggccctagagggactcccgagagcgtattctctcggctccaactgacggacaacgagtacacgttcgaccagtcgggtggagtccgaggacgagaagacgaggcgtagactaattacgtagtactaatcagcgaggcagngagtggaatcggtgtcgtttcggacggaggaccacgcgtcgaccgtaccgtacgtcacgaccgacgcctccgcccgtcgtccgtcgtccg

SEQ ID NO: 122300 - DNA, 826 bp, Homo sapiens
  misc_feature: GYAE6OF01BSTCX.53.5.A05.1.454.CMB.1.raw
  modified_base (687)..(687): a, c, t, g, unknown or other
  misc_feature (687)..(687): n is a, c, g, or t
  modified_base (700)..(700): a, c, t, g, unknown or other
  misc_feature (700)..(700): n is a, c, g, or t
tcagcgcgtatacacacgaccggtgctcgatttagatagatagacgagggggctgtgggtccaggaggcagaactctgggtgtctcaccatggcctggactccctctacttcctcccctcctcactctctcgcacaggctcgtggacggcccttacctatgacgcgtacgacaccacgcccgtaccccgtcggttcgtccgtaggtccgtaccccgaggaccgacggaccggaccgagggtactccaccgtcgtccttcggtaggagtaggtggtatacggaaccgaaacgtcgtaacttaggttacggtttaaccgtaacggtaaaccgaaacgaacggaaccggaccggaccgggaccccggtaaccggttcccccttaacgtttaaggtttaacggttaaacgttaaggttaaacgtaaaaggtaaccgtaaaggtacgggtaacggtaccggtacccggtaacgggtaacgggtacccttacccggtacggtacggtacgttacgttccgttacggtccggtacctaaccccgtaacgtaccgggaaaccgtaaacgtaaccggtaaccgttacgtaaccggttaaccgtaccgtaacgggttcgggtacggtaaccggtacggtaacgggaacgtaagggaacggacgtacgggactaacgtacgttatacgtacaacgtanggacgtagacggnacggaacgtgtaacgtcgtcgtcgtcgtagggaccgtacgggtaccagggtaccctggacccgttacgacggtaccgacgtacccgacccggtccgtaccccgtggtcccctcgtcccttaccggg

SEQ ID NO: 122301 - DNA, 723 bp, Homo sapiens
  misc_feature: GYAE6OF01A8243.53.5.A05.1.454.CMB.1.raw
  modified_base (182)..(182): a, c, t, g, unknown or other
  misc_feature (182)..(182): n is a, c, g, or t
  modified_base (580)..(580): a, c, t, g, unknown or other
  misc_feature (580)..(580): n is a, c, g, or t
tcagcgcgtatacacacgaccggtgctcgatttagatagatagacagggggctgtgggtccaggaggcagaactctgggtgtctcaccatggcctggatccctctacttcctccccctcctcactctctgcacgaggctcgtggacggcctctatgagctgacacacgccctacccgtggtntcagtccgtacccgaggaccaggaccggcaggtactccactgctcgtaggatagtggtacttcgaaccaaagctaacgttgttacggttactacggtaaccaacgaagaacgccgacggccaccggtccctagttacgttagtaatagtaaagaaacgacaagtcggacggtaccgaccgtaggacgggtacctccggtagacgtctacttcgtacgtcgtaccctaacgtacgtaggaacggtaactaacgtacgttaccgtaacggtaccgaaccgtagggttcgggtacgtaaccggtacgacggtaacggaaggtaaacggaccggtaacggtacgttacgtaactttaacgtttacgtacggtaacttaacgaccgtaacgaccggtagaacncggtaacgtacggtaacggttcgttcgttaacgggttccggtacgggaaccgggacggtaccaggtaccgtaacggttcccgtataccggcgaccgtccgtaacgtcccgttcccgtaacccgttcgtacctccggttccccg

SEQ ID NO: 122302 - DNA, 817 bp, Homo sapiens
  misc_feature: GYAE6OF01CXYZ8.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctcccccctcctcactctctgcacaggctctgaggcctcctatcgagctgacacacgcccaccctcggtgtcacgtcgtcccccgaggacagaccggccaggactccaccgtgcctcgtaggacgtagtggtacttcgaacccgaaaggtcctaacgttacggttacgggttttaccgttaccggtaaacccaaacgaacggtaaaccgcccgaacgggtcccgtaccggtaccccccttagttacgtttaggtaactttaggtaaactaaaacgtaaccgtaagttacgggaacggtacccggtacccgtacggaacggggttacccttaccccggtaagggtaccggtaccgttaacgtttccgttaccgttaccgggtacccttaaacccgaaccgttacggaacgggtaaccaaacgttacgtaccgttacggttacgaaccgtacggttacgggtacggtaccggttacccgaacgggtaccgaaagggaaccggttaacggacggttaccgtaagttaccttaacgttacggttacgtacctaacgtcgtacgaccgacggacgacgtacgtaggtacgtacgttcgtcggttaccgttcgggacggtacggaccgtacgtccgtaccggtacccgtacgttaccgccggacccgacgtaccgtccgtaccccgtaccccggtccgtactcccgttaccccg

SEQ ID NO: 122303 - DNA, 917 bp, Homo sapiens
  misc_feature: GYAE6OF01AHFVT.53.5.A05.1.454.CMB.1.raw
tcagcgcgtatacacacgaccggtgctcgatttagatagatagacagggggctgtgggtccaggaggcagaactctgggtgtctcaccatggcctggatccctctacttcctccccctctcactctctgcacgacggtctcgtggacgtcctccgtagtcgacgtcgtagaaccacgaccgcccgtacccgttcggtactcgacggttccgtaccccggaaggaccgaacgggacccggcgtaaggaccttacccgacccgttcggacccttaggtaggggtagtacggttacggtacgtttaccggaaacccgaaagtccttaaccggtttaggttacccggtttaacggtaaccggtaaacccaacgaacggaaccggtaccgacccgggaccggttacccggtacccttaggtttaacggtttagtaacgtttaacgtaaacgtaaaacgactaaggtacggaccgaccggtaccgtacggtaacgggtcctccggtaggtaaccgtcgtttaaccttccggtaccggtacgtacccggtaaaccggtaccgggtaacgggaaccttaacggtaccggtttacccgaccggttacggacccgttaacggggttcgggaacggtaccggtacggaacggacggtaacgggaacggtaacgggtacgtacggttaaccgttaacgtttacgtacttacgtaacgtacgtacggaccgacggacgacgtacggacgtaacggggttacgttcggttacggtaccggttttcggggtaaccgggtacgggtacgggaccgtacggtaaccggtacccgtacccggttcgtaacccggaccggtaacccggtaccggtacccgtccccggtacccggttacccgtacccgttccggttccccgttaccgttcccccggg

SEQ ID NO: 122304 - DNA, 757 bp, Homo sapiens
  misc_feature: GYAE6OF01BBHVR.53.5.A05.1.454.CMB.1.raw
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
tcagcgcgtatacacacgaccggtgctcgatttagatagatagacagggggctgtgggtccaggaggcagaactctgggtgtctcaccatggcctggatccctctacttcctcccctcctcactctctgcacaggctctgacggcctcctatgagctgacacagccaccctcggtgtcagtcgtccccgaggacagtaccggcaggtntccacctgcctcgtggagagtggtattgaccaagctatagtggttactagtaaccaanagacncgtacgaccgacgtccctagttagttaaggtaatacgtaagtaaacgacaagacggacggacggtaccgtacgacggtctaccgtaggacgacgttcttacgtcgtcgacccttaaccaaccggcggtaacggaaacaaacccgtacggttaccgaacgggtttacccaccgggttacgttccggggtaacgggtaccgtaaccgggacgggaaggtaaaccggggaaaggtacccgggtaacggttacccggttaacgttaaacggtttacccgtttaaccggtaagttacctaacggtaccggaacggtacgaagggtaaccgagtacggacggttaggttaccggttgttacggttacccgggttagggacccggtaaggaccgtaccggcgttaccccgacggtttcccacgggtaccgaacccgggtaccgtaacccgggtccctcccccggtaacccgtcgttccccgtactttccccgg

SEQ ID NO: 122305 - DNA, 514 bp, Homo sapiens
  misc_feature: GYAE6OF02F7WYY.53.5.A05.1.454.CMB.1.raw
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggccccctntattggtaatgtataaagacaatgagaggccctnagggatccctgagcgattctctggctccaactcagggacaacagtcacgttgaccatcggtggagtccaggcagaagacgaggctgactattactgtcaatcagcaggcagcagtgaactgtgtctttcggcggagggaccagctacggtaccgtcctacgtccacgacccgaaggcctccgcccccgtcggtccaccttcccg

SEQ ID NO: 122306 - DNA, 524 bp, Homo sapiens
  misc_feature: GYAE6OF02HXFV1.53.5.A05.1.454.CMB.1.raw
  modified_base (280)..(280): a, c, t, g, unknown or other
  misc_feature (280)..(280): n is a, c, g, or t
  modified_base (362)..(362): a, c, t, g, unknown or other
  misc_feature (362)..(362): n is a, c, g, or t
  modified_base (461)..(461): a, c, t, g, unknown or other
  misc_feature (461)..(461): n is a, c, g, or t
tcagcgcgtatacacacgaccggtgctcgatttagatagatagacagggggctgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctcgtggagatggattgaccaaagcactatggtttactggtaccaacagaagccaggccaggccccctntattggtaatgtaataaagacaatgagacgcctgagggactcccgtgagcgattctcgtggctccaactcgaagggacaacncgtacacgttgaccagtcggtaggagtccgagcgagaagacgagcgtagactattacgtgtacaatcagcgagcgagacagtgaactgtgtcgttcggnggagacgagctgacctccgtacgtcgacgcccgtaggccgtccgcccgtaccgtccacttccg

SEQ ID NO: 122307 - DNA, 506 bp, Homo sapiens
  misc_feature: GYAE6OF02ITWE9.53.5.A05.1.454.CMB.1.raw
  modified_base (309)..(309): a, c, t, g, unknown or other
  misc_feature (309)..(309): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctnagggatccctgagcgattctctggctccaactcagggacaacagtcacgttgaccatcggtggagtccaggcagaagacgaggctgactattactgtcaatcagcaggcagcagtgaactgtgtcgtttcggcggagggaccgagcgtgaccgtcctacgtcgacgcccgaacggctcgccccgtcggtccactccg

SEQ ID NO: 122308 - DNA, 537 bp, Homo sapiens
  misc_feature: GYAE6OF02F0F23.53.5.A05.1.454.CMB.1.raw
  modified_base (430)..(430): a, c, t, g, unknown or other
  misc_feature (430)..(430): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcgagggatcccgtgacgcgattctctggctccaactcgaggacaacagtacacgttagacctagtcggtaggacgtcgaggcagaagacgaggctgactattactgtacaatcagcagcagnagtagacgtgtcgtcgtttcggcgggtacggaccgagccgtacggtacccgtccgtacgtccgacgcccgaaggccgtaccggcccccgtcggtacctccgttcccg

SEQ ID NO: 122309 - DNA, 554 bp, Homo sapiens
  misc_feature: GYAE6OF02FLH8H.53.5.A05.1.454.CMB.1.raw
  modified_base (275)..(275): a, c, t, g, unknown or other
  misc_feature (275)..(275): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctntattggtaatgtataaagacaatgagaggccctcgagggactcccgtgagcgattctctggctccaactcgagggacaacagtcacgttcgaccagtcggtggacgtcgacggacagaacggacgaggcgtagtactattacgtgtacaatacgagtacgacggcagcgtagtaggaacgtgtcgttcgtttacgggcggaacgggaccgagcgtacggtaccgtaccgtacgtcgacgacccgaacggccgtaccgccccgtcggtcctaccgtcccg

SEQ ID NO: 122310 - DNA, 606 bp, Homo sapiens
  misc_feature: GYAE6OF02G2E6Y.53.5.A05.1.454.CMB.1.raw
  modified_base (285)..(285): a, c, t, g, unknown or other
  misc_feature (285)..(285): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgcctcgtggagatggattcgaccaaaagcactagtggttactggtaaccaacagaacgccaggccacggcccctntattggtaatgtaataaagacaatgagacggtccctgagggactcccgtgacgcgtattcctcgtcggcctaccaacgtcgaacgggacaacgtagtacctacgttacgacctagttcgggtcggacgtccgaggacaaggaacggacggaggctagtactattacgtgtacaatcagacgacggacgacgacgtaggtagtaacgttggttacgttcgtttacgggacgggtacggaacgacggtcgtaccggtacccggtccgtaaccgtccgacgacccgtacggtccgtcccgaccccggtcgtcctaccgttcccg

SEQ ID NO: 122311 - DNA, 520 bp, Homo sapiens
  misc_feature: GYAE6OF02GZ8F1.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtgagtcaggcagaagacgaggctgactattactgtacatcagcaggcagcagtgaacgtgtcgtcgttttcggcggtacgggaccaggcgtcgcccgttaccgtacggtccacggcccgaacggcgtcgcccccgtcggtccacgttcccg

SEQ ID NO: 122312 - DNA, 629 bp, Homo sapiens
  misc_feature: GYAE6OF02HOOID.53.5.A05.1.454.CMB.1.raw
  modified_base (221)..(221): a, c, t, g, unknown or other
  misc_feature (221)..(221): n is a, c, g, or t
tcagcgcgtatacacacgaccggtgctcgatttagatagatagacagggggctgtgggtccaggaggcagaactctgggtgtctcaccatggcctggatcccctctacttctccccctcctcactctctgcacaggctctgaggcctcctaatgagctgacacagcccaccctcggtgtcagtgtccccaggacagacggccaggatcacctgctctgganatggattgaccaaagcactatggttaactggtaccaacagaagccaggccaaggccccctgtacttaggtaatgtaataaaaggacaagtgaagacggacccttagaagggactcccgtagagacgtattactcgcggtacctaccaactcgaaacgggacaaacgtacgtacaacgtttgaaccaagttcgggtaggacgtaccgaacggacgtaaggaaacgacggaacggacgtcggtaactattaacgtagttacgaagttacacgactagacgagacgaggtagacgtgtagtcgtttacggacgggtacggacgacgtacgtacgtaccggtaccgtacgtaccgacgacccgtaacggtcccgtaccggttcccccgtaccggtaccgtacccgttacccg

SEQ ID NO: 122313 - DNA, 600 bp, Homo sapiens
  misc_feature: GYAE6OF02GKE7R.53.5.A05.1.454.CMB.1.raw
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattcgaccaaagcactagtggttactcggtaaccaagagaacgccaggccacggcccctntagttagtaatgtaataaagacaatgagacgccctagaggactccgngagcgtattcctcgtcgcctaccgaactcgaacgggaacaaacgacgtactacggttacgaccctagtccgggtaggacgtccgacggacgaacggaaagacggagacgtagaacttagttactcgtaacatacagacgaggcagacaggtacgagtgttgtcgtttacggacggtaacggacgtacgcgtaccggacccgttacctaccggtaccgaaccggtacccgacggtcctacccggtccccgtacggtacccgtacgttccccg

SEQ ID NO: 122314 - DNA, 632 bp, Homo sapiens
  misc_feature: GYAE6OF02G9K4M.53.5.A05.1.454.CMB.1.raw
  modified_base (623)..(623): a, c, t, g, unknown or other
  misc_feature (623)..(623): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggcaggatcacctgctcgtggagatggattcgacaaagcactagtggttactcggtaaccaacagaacgccgaggccacggcccctactagttggtaatcgtaataaagacaagtggaagacggcccctagaacgggtctcccgtaggacgacgtacttcgtacgtcggcctaccaacgtcgaacgggaaccaaacgtacgtacgtacgttacgacctaggtcgggtaggacgtcgaggacgaaggaagacgagacgtagactagttactgtacaagtacgagactaggacgagacgtaggtacgtaacgttcggttcgttaccggtttcggggacgggtaacgggaccgtaacggtccgtaaccggtcccgtaccgttaccgtacgaccggtacccgacggtcccgtccgtccccgtcggtaccnccgttcccg

SEQ ID NO: 122315 - DNA, 547 bp, Homo sapiens
  misc_feature: GYAE6OF02G9IX5.53.5.A05.1.454.CMB.1.raw
  modified_base (255)..(255): a, c, t, g, unknown or other
  misc_feature (255)..(255): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatggattgaccaaagcactatggttactggtaccaanagaagccaggccacggcccctctattggtaatgtaataaagacaatgagaacggccctgaagggactccgtgacgcgattctcgtggctccaactcgagggacaacagtctacgtnaccagtcggnggagtccgagcagaagacgagctagactatactgtacaatcaagtgagcagctaggtacggaatgtcggtcgtttcggacgggaggtaccgacgtcgtacggaccggttaccgtacgtccgtacgacccgaacggtcctccgtccccgtcggtcctaccgttcccg

SEQ ID NO: 122316 - DNA, 611 bp, Homo sapiens
  misc_feature: GYAE6OF02G50SL.53.5.A05.1.454.CMB.1.raw
  modified_base (257)..(257): a, c, t, g, unknown or other
  misc_feature (257)..(257): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatggattgaccaaagcactatggttactggtaccaanagaacgccaggccaggcccctatattggtaatgtaataaagactaatggaagaggcccctgagggactcccgtagacgacgtattcctcgtcggactccgaactgacgggaacaactacgtcacgttgacctagtcgggtggacgtaccgacggacgaaggaacgacggaggactaggtactattaacgtgtactaacgtacgtagacaaggcacggacgtacgtaggacgttggttacggttcggttttacgggacggggtaacgggaccgaggtaccgacggtaccggtaccgtaccggtcaaccgtaccgacggtccgtacccggtccccgtaccggtacctacctcccgg

SEQ ID NO: 122317 - DNA, 815 bp, Homo sapiens
  misc_feature: GYAE6OF02GA7EB.53.5.A05.1.454.CMB.1.raw
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
tcagcgcgtatacacacgaccggtgctcgatttagatagatagacagggggctgtgggtccaggaggcagaactctgggtgtctcaccatggcctggatccctctacttctccccctctcactctctgcacaggctctgaggcctctatgagctgacacagccacccgtcggtgtcagtcgtccccaggacagacggccaggactcacctgctcgtggagntggattcgaccaaaagccaacttagtggttactggtaaccaanagaagccaggccgaacggcccctactagtttggtaatgtaataaagacaagtggagacggtcccctagagggactcccgtaggacgtcgtaatttcctacgttacgggtccctacccgaaaccgttcggaaacggggtaaccaaaaccgtaacggttacccgtaaacgggttttacggaaacccgtaagggtttacccggggttaggggaaaccgggtttcccggaaacggggtacctaaaacgggaaaaccgggaaccgggtaacgggttacccggttaacgggtaaaccttttaacgtttaacccgttaggtaacccgtaaacgttaccgaacgggaccgtaacgggacctaaacggaccggttaaggtacggtaacgttcggtttaccgttaccggttttccggggaccggggtaaccggggtaaccgtaacggtaccggttacgggtaacccccgttaccgttaaccggttaccgaacccggtaacccgaacgggttccccggtaccccgggtacccccgttcggttacccgtacccgtttcccggg

SEQ ID NO: 122318 - DNA, 631 bp, Homo sapiens
  misc_feature: GYAE6OF02GS1TR.53.5.A05.1.454.CMB.1.raw
tcagcgcgtatacacacgaccggtgctcgatttagatagatagacagggggctgtgggtccaggaggcagaactctgggtgtctcaccatggcctggatccctctacttctccccctcctcactctctgcacaggctctgacggcctcctatgagctgacacagcccacccgtcggtgtcagtcgtcccaggacagacggccaggactcacctgctcgtggagtatggattcgaccaaagcactagtggttactcggtaaccaacgagaacgccgaggcccgacggtccccctatagttacggtaatagtaataaagacaagtggagacggtaccctagaggacttccgagacgtacgtacttctcgtggtcctaccgaactcggacggaactaacgtctaccgtacgttacgaccgtagtcgggtacggtacgtaccgtaggacctaaggaacggacggacgcgtagaacttattacgtatacaatcgagtcgagtacgagacgtacggtacgacgttggtcgttacgggtttcggaccgggtaagaccgagtccgtacggtaacccgtacgtaccgaccgtacgacccgtacggtcccgtccgtaccccggtagtcctaccgttccccg

SEQ ID NO: 122319 - DNA, 721 bp, Homo sapiens
  misc_feature: GYAE6OF02HNY8I.53.5.A05.1.454.CMB.1.raw
  modified_base (186)..(186): a, c, t, g, unknown or other
  misc_feature (186)..(186): n is a, c, g, or t
tcagcgcgtatacacacgaccggtgctcgatttagatagatagacagggggctgtgggtccaggaggcagaactctgggtgtctcaccatggcctggatccctctacttctcccccctcctcactctctgcacaggctctaggacggcctcctagtgagctgacacacgccctacccgtggtgtcngttccgtccccaaggaccaggaccggaccaaggtactccaccgtgccgttctagggatagttaggtattacgaacctaaaggcctactttaggttacggtttaccgtacggttaaccaaacgaacggaacgccgaacggtacccaccggtcccccttagtttacgttaaggttaataaggttaaagtaaaacgactaaaggtacggaacgtaccggaccctaggtacgggtacctccggtgaacgtctactttcgtacgcggtacctacaacgtcgaaacggacctaacgtgtacgtacgtacgaactggtcggtaggacgtacgacggacgaaggaacggacggacgtacgtacgtaacttgttaacttacggtacaatacgagtacgacgacaggacgtagtacggtacgttcgttcggtttccggtacggaacggggacgtacgtacgtcgtaccggttacccgtaccgtaccggtaccgaccggaaccttaccggcctacccggtccccgtacgtacccgtaccgttcccg

SEQ ID NO: 122320 - DNA, 536 bp, Homo sapiens
  misc_feature: GYAE6OF02HAO88.53.5.A05.1.454.CMB.1.raw
  modified_base (387)..(387): a, c, t, g, unknown or other
  misc_feature (387)..(387): n is a, c, g, or t
  modified_base (448)..(448): a, c, t, g, unknown or other
  misc_feature (448)..(448): n is a, c, g, or t
tcagcgcgtatacacacgaccggtgctcgatttagatagatagacagggggctgtgggtccaggaggcagaactctgggtgtctcaccatggcctggatccctctacttctccccctctcactctctgcacaggctctgagcctcctatgagctgacacagcccaccctcggtgtcagtcgtcccccaggacaggacggccaggatcacctgctcgtggagatggattgaccaaagcactatggttaactggtaccaacagaagccaggccaggccccctatacttggtaatgtaataaaacgacaatgaagacggaccctcaagggactccctagagtcgattctactggactaccaactcgaaggaacaacgagtacaacggttnaaccagtacggtggacgtccaggcgaagaagacgagcagtactattacgtgtacaatcagnagcagatagtagaactgtgtcgtttcggacgaggaccagctacgcgtacctacgcacgaccgacggctccgcccctcgtactactccg

SEQ ID NO: 122321 - DNA, 734 bp, Homo sapiens
  misc_feature: GYAE6OF02FNVEQ.53.5.A05.1.454.CMB.1.raw
  modified_base (262)..(262): a, c, t, g, unknown or other
  misc_feature (262)..(262): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggatcacctgctcgtggagatggattgaccaaagcaactatggttactaggtaccaanagaacgccaggccacggcccctatattggtaatgtaataaagacaagtgaagacggaccctacgaagggtactcccgtggacgtcgtacttccgtacgtggtcctacccgtaaacgttcgaacggggtaaccaaacgaacgtaccgtaacggttacgaaccctagttcgggtaggtacggtacccgacgggtacaacggaaacggtacgggtaaggaccgttagaaccgttaacgttaacgttacgtacgtaaacgtccgaagtcgtaacgggcgtaagacgtaaggttacggtaaccttgggttacggttaccgtttttacggggaccgggtaacggggtaaccgtaacgggtccgttaaccgggtaaccccggttaaccgttaacccggtaccgtaaccggtaaccccgtaaccgggtcccgttaccccggtacccccggttacccggttacccgtaccgtttaccccgg

SEQ ID NO: 122322 - DNA, 754 bp, Homo sapiens
  misc_feature: GYAE6OF02JOI3X.53.5.A05.1.454.CMB.1.raw
  modified_base (128)..(128): a, c, t, g, unknown or other
  misc_feature (128)..(128): n is a, c, g, or t
  modified_base (133)..(133): a, c, t, g, unknown or other
  misc_feature (133)..(133): n is a, c, g, or t
  modified_base (176)..(176): a, c, t, g, unknown or other
  misc_feature (176)..(176): n is a, c, g, or t
  modified_base (231)..(231): a, c, t, g, unknown or other
  misc_feature (231)..(231): n is a, c, g, or t
  modified_base (592)..(592): a, c, t, g, unknown or other
  misc_feature (592)..(592): n is a, c, g, or t
tcagcgcgtatacacacgaccggtgctcgatttagatagatagacagggggctgtgggtccaggaggcagaactctgggtgtctcaccatggcctggatccctctacttcctcccctcctcactctcngcacngctctgagcctcctatgagctgactacgcgtccaccctcggtntccaggtcgtcccgaggaccacggtacgcaaggactcgacctcgctcgtaggganacgtaggtacttcgaaccgtaaacgtccaattacggttcggttaaccgtacggtaacccaaacgagtaaccgacccggtacggacccgtaccggtaccccttagttacgttacgtaagttacggtaaacgtaaacgaaccgtaagtaggtacgaccggtacctacggaaccgggtactcccgtagtacggcttactccgtcgtacggtccttaaccgacgtgaacgacaacgtcgtacgaacgttgaccgttaggtcggtacgggaacgtacggacgtacgaaacggtaagacggtagccgttaaggtacctaataccgtacgtcaaacggttaccacggacggtaacgcgtacgggtacngggtaccgttaagtcgttcggttaccggttccgggaacggtaccggtaccgtaccggtcctccggtaaacccggttcgttaaaccgtaccgtccggttaaccccgacgggtttacccgaccccgggtttacccggttaccggtaccttacccgggttcccgg

SEQ ID NO: 122323 - DNA, 828 bp, Homo sapiens
  misc_feature: GYAE6OF02IJC46.53.5.A05.1.454.CMB.1.raw
  modified_base (81)..(81): a, c, t, g, unknown or other
  misc_feature (81)..(81): n is a, c, g, or t
  modified_base (178)..(178): a, c, t, g, unknown or other
  misc_feature (178)..(178): n is a, c, g, or t
  modified_base (224)..(224): a, c, t, g, unknown or other
  misc_feature (224)..(224): n is a, c, g, or t
  modified_base (403)..(403): a, c, t, g, unknown or other
  misc_feature (403)..(403): n is a, c, g, or t
tcagcgcgtatacacacgaccggtgctcgatttagatagatagacagggggctgtgggtccaggaggcagaactctgggtntctcaccatggccctggatccctctacttctccccctcctcactctctgcacaggctctggaggcctcctatgagctgacacacgcctaccctggtntcagtcgtacccaggacagacgccagtactcacctgctcgtggaangttaggacttacgacccaaagtctaacgtagttacgggttaccttacgggtaaccaaacgaacggaacgtaccgacggaccctacggtaccccttagttattacgggttaaacttagtaaactaaaacgtactaagtacggaacgtaccggtaccctacggaacgggtaccttacccgnggaactcgtaacttcgtacggtcggacctacccgtaacctacggaacggtaacaaacgtacttaccggtaaacgttacgaaccgttacggtaccggtagggtaaccgaccgtaaaggaacgaacggaaacgtccggtaacggacgttaacgtaaccctttaagtttaaccgtacgtaacgttaaactccggaacgtacaaacgggtaccgacgttaacggtacggtttaacggaactttcgggttaaacttttccggggttaccgggaaacccgggaacggtaacccgtagttccccggtaaacggggtttaaccccttaacccggttaaaccgggttacccgaaaccggttaacccgggtaacggttccccgttaaccccgggttacccccgtacgggtttacccctaacccgtttccccccgg

SEQ ID NO: 122324 - DNA, 599 bp, Homo sapiens
  misc_feature: GYAE6OF02IZXO3.53.5.A05.1.454.CMB.1.raw
  modified_base (230)..(230): a, c, t, g, unknown or other
  misc_feature (230)..(230): n is a, c, g, or t
  modified_base (472)..(472): a, c, t, g, unknown or other
  misc_feature (472)..(472): n is a, c, g, or t
tcagcgcgtatacacacgaccggtgctcgatttagatagatagacagggggctgtgggtccaggaggcagaactctgggtgtctcaccatggcctggatccctctacttcctcccccctcctcacctctctgcacaggcctctgacgcctcctatgagctgacacacgcccacccgtggtcgtcagtcgtccccgaggacagacggccgaggatccacctgctgtagganatggacttcgacaagctactagtggttactaggtaaccagagaacgccgaggcccacggccctatacgttagtaatagtaagtaagacaagtggagtacggaccctacgacgggactccgagacgtacgtattccgtcgtcggacctaccgacgtacgaagacacacgtcgtacgtcacgtagtcggagtacgcgaggcgaagacggagcggactagtactagttacacgtactaacgtacncgacgaggcgaagacgtaggtacgtaacgtgtacgttcgttcgggacggtacgaccgagtccgtacgtaccgtctaccggtacgaccgtaccgacgtccgcccgtaccggtcgtccgaccgttcccg

SEQ ID NO: 122325 - DNA, 578 bp, Homo sapiens
  misc_feature: GYAE6OF02GQW2N.53.5.A05.1.454.CMB.1.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (443)..(443): a, c, t, g, unknown or other
  misc_feature (443)..(443): n is a, c, g, or t
tcagcgcgtatacacacgaccggtgctcgatttagatagatagacagggggctgtgggtccaggaggcagaactctgggtgtctcaccatggcctggatccctctacttctcccccctcctcactctctgcacaggctctgaggcctcctatgagctgacacagcccaccctcggtgtccagtcgtccccaggacagacggccaggatcacctgctcgtggagatggattcgaccaaagcactatggttactgaccaanagagccagccacggccctntattggtaatgtaataaagacaatgagacggcctcgaggactccgtagagcgtattctcgtcgctaccacgtcgagggacaaacagtactacggttcgaaccagtcgggtaggacgtccgagacgagaaggagagctacgacttattacgtcgtacatacagacngcgagacgagtaggtaactgttagtcggtttcgggaacggacgggtaaccgacgtacgtacggtaacccgtaccgtaccggtaccgaccgacccgtacggccgtacccggtccccgttcggtcctaccgttcccg

SEQ ID NO: 122326 - DNA, 834 bp, Homo sapiens
  misc_feature: GYAE6OF02F2TF2.53.5.A05.1.454.CMB.1.raw
  modified_base (154)..(154): a, c, t, g, unknown or other
  misc_feature (154)..(154): n is a, c, g, or t
  modified_base (226)..(226): a, c, t, g, unknown or other
  misc_feature (226)..(226): n is a, c, g, or t
tcagcgcgtatacacacgaccggtgctcgatttagatagatagacagggggctgtgggtccaggaggcagaactctgggtgtctcaccatggcctggatccctctacttctccccctcctcactctctgacacaggctctgacgcctctatganctgaccacacgcccacccgtggtgtcagtccgtccccgaggacaggaccggccaggactccacctgcctcgngggatagtggattacgaccaaagcctaacttaggttcggttacgtacggtaaccaaacgacgaacgaccgtacggaccccgtccggtaccccgttagttaacgtttaggtaacttaaggttaaacgtaaaacgtaacctaagtaggaacggacccggtacccttacgggtaacgggtaacttaccccgtaggtacgacgttacgtttcgtaccgttacggacccttaccgacctacgggaacgggaaacctaaacgtacgttaaccgtaccggttaccgtaccggtacgttacggggtaccggtaccgttacccggaaggtaacggaaacggaaccggtacgggtacggtaccgtaacgttaaccgttaacgtttaccgtacggtacctaaacgtacgaacggtaccgacgggtaccgacggtagttacgggtaacgttaacgggttggttaccggtttaccgggtttaccgggacgggtaacccggacgttacggtcccggttaacgttcccggttaaccggtcccgtaaccgtaccccggggtacctaaccgggtcccgttccccgggtacccgttacccggtaccggtttccctttacccccggg

SEQ ID NO: 122327 - DNA, 574 bp, Homo sapiens
  misc_feature: GYAE6OF01BW005.52.81.H04.1.454.CMB.1.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcgttttctagtggctattttaaaaggtgtccagtgtgagtgcagctgctgcagtcgggggagcttggtacagccgtggggggtccctgagctctcctgtgcagcctntggattcacctttcgcgtctatgacatgagctgggtccnccgaggcctccaggaatggggctggagtgggtctgaggtattaatggtggtaggaagtacatattaacgcaagacgtccgtaggaacgggccgtcttcaaccatcctaccagagacaaattccaaagaacacacctagtactctgaacaaatgaaacctagacctgaaagcgaccgaggacctaacgggcccaaccttagtttaccgtgtaaaccgaaaagtaaactaccaacaacgtacgaccgtaggaaccggaagggacgaaaaccccgg

SEQ ID NO: 122328 - DNA, 533 bp, Homo sapiens
  misc_feature: GYAE6OF01DL6RI.52.81.H04.1.454.CMB.1.raw
  modified_base (155)..(155): a, c, t, g, unknown or other
  misc_feature (155)..(155): n is a, c, g, or t
  modified_base (179)..(179): a, c, t, g, unknown or other
  misc_feature (179)..(179): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgngtttctaggtggctatttaaaggngtcagtgtgaggtgcagctgctgcagtcgggggagcttggtacagcctggggggtccctgagactctcctgtgcagcctctggattcacctttcgcgtctatgacatgagctgggtccgccgaggctccaggaatggggctggagtgggtctgaggtattaatagtggtgaagtacatatacgcagactcgtgaagggccgnttcaccatctccagagacaattcccaagaacacgactgtactntnacaatagaacagccngagagacgacgacgaccgaccgacctacttacttacgtaacgaaacggaaataaccaacaacgacgacgtaggaacggaggaggaaacccgg

SEQ ID NO: 122329 - DNA, 519 bp, Homo sapiens
  misc_feature: GYAE6OF01D4K05.52.81.H04.1.454.CMB.1.raw
  modified_base (308)..(308): a, c, t, g, unknown or other
  misc_feature (308)..(308): n is a, c, g, or t
  modified_base (393)..(393): a, c, t, g, unknown or other
  misc_feature (393)..(393): n is a, c, g, or t
  modified_base (512)..(512): a, c, t, g, unknown or other
  misc_feature (512)..(512): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctggagcgtggtcgttttcttggtggctaattttaaaaggtgtccagtgtgaggtgcagctgctgcaggtcggggggagcttggtacagccgtggggggtccctgagactctcctgtgcagcctctggattcacctttcgcgtctatgacatgagctgggtccnccaggctccaggaatggggctgggagtgggtctcgaggtattaatagtggtggaagtcatattacgcagactccgtgaagggccncttcaccatctcagagacaattccaagaacacactgtatctgacaaatgaacagcctgagagccgaggacacggccacctatttcgtagtaagaaagatacacacagctaggacgaggngaacccg

SEQ ID NO: 122330 - DNA, 523 bp, Homo sapiens
  misc_feature: GYAE6OF01BRGUP.52.81.H04.1.454.CMB.1.raw
  modified_base (348)..(348): a, c, t, g, unknown or other
  misc_feature (348)..(348): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtcttgacgcagccgcctcagtgtctgcggccccaggacagaaggtcaccatctcctgctctggaagcagctccaacattggcaataattttgtgtcctggtaccagcaactcccaggcacagccccaaatcctcatttatgacaatgataagcgaccctcgaggatacctgaccattcnctggctcaagtctgcacgtcacgcccacccgtgggccagtccaccggactccagaccgtggggacaggcccgaatttacgtacgtgacggtaacagtgggaatgcagcctgagtgatggccgaggggttgttccggggacgggtacgggacccaaggccgtcggacccgttccgg

SEQ ID NO: 122331 - DNA, 550 bp, Homo sapiens
  misc_feature: GYAE6OF01CPQRO.52.81.H04.1.454.CMB.1.raw
  modified_base (263)..(263): a, c, t, g, unknown or other
  misc_feature (263)..(263): n is a, c, g, or t
  modified_base (365)..(365): a, c, t, g, unknown or other
  misc_feature (365)..(365): n is a, c, g, or t
tcagcgcagtacgacacgaccggtgctcgatttagtagtgtagattcgcggggagctctgagagaggagcccagccctgggatttcaggtgttttcatttggtgatcaggactgaacagagagaactcaccatggagtttgggctgagcgtgcgttttctaggtggctattttaaaaggtgtcagtgtgaggtgcagctgctgcaggtcggggggagcttgggtacagccgtggggggtccctgagactctctgtgcagcctntggattcacctttcgcgtctatgacatgagctgggtccgccaggctccgaggaatggggctgggagtgggtctgaggtattaaagtggtggtaggaactaanatatacgcagtacgtcgaggacggccgtctacacctatcacagacaactaactaccgaacaacactactatactctagaacaataacgaacacgtacgtagacgacgacgacgaccgaccgacctacctacttacgtacgtaagaaacgtaactaacaacacacgacgaggacggaggacgaacg

SEQ ID NO: 122332 - DNA, 561 bp, Homo sapiens
  misc_feature: GYAE6OF01E12SD.52.81.H04.1.454.CMB.1.raw
  modified_base (324)..(324): a, c, t, g, unknown or other
  misc_feature (324)..(324): n is a, c, g, or t
  modified_base (350)..(350): a, c, t, g, unknown or other
  misc_feature (350)..(350): n is a, c, g, or t
tcagcgcagtacgacacgaccggtgctcgatttagtagtgtagattcgcgggcacgaccggtgctcgatttagtagtgtagattcgcggggggaggcttggtacagcctgggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaaatgaacagcctganagccgaggacacggccacctatttcngtaacgaaagaatacacacagctggacgaggagaccaaacggcgactacttctttgactactggggccagggaaccctggtccaccgtctcctcacgcctccacccaacgggcccagtccggtccttccccctggcccaccctcctccaacgacgccaccctcgtcgggggccaccgacggccggcccgtgggcctcggccctgggtaccg

SEQ ID NO: 122333 - DNA, 567 bp, Homo sapiens
  misc_feature: GYAE6OF01A0RLG.52.81.H04.1.454.CMB.1.raw
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
tcagcgcagtacgacacgaccggtgctcgatttagtagtgtagattcgcgggagctctgagagaggagcccagccctgggattttcaggtgttttcatttggtgatcaggactgaacagagagaactcaccatggagtttgggctgagcggtcgtgtttctaggcggctatttaaaggntcagtntngtgcagctgctgcagtgggagctgacngcctggggcctgagctctcctgtgcagcctctggacttcncctttgctctatganatgngcgtcggtccgcgacgcgtcgagagtggngtggngtggtcgtcgtagtagtagtagtaggtagtagtactatagtacgacgacgacgtcgtacggacggtccgtctacctacctactcctaccgacgaacgtaactaactaaccgaacgaacaactactacgtactacgtacactaataacgaacgtacgtacgtacgacgacgacgacggaccgaccgaccgtaccgttacgttacgtacgtaacgtaacgtaaactaacgaacacgacgacgtagacggacggacggaaccg

SEQ ID NO: 122334 - DNA, 638 bp, Homo sapiens
  misc_feature: GYAE6OF01B970I.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcgttttctagtggctaattttaaaaggtgtccagtgtgaggtgcagctgctgcagtcggggggaggcttggtacaggccgtggggggtccctgagactctcctgtgcagcctctggattcaccttttcgcgttctatgactatgagcgtgggtcccgccgaggcctccgaggaagtggggctgggaggtgggtctcgaggtattaagtaggtggtggaagtcatattacgcagactccgtgaacgggccgacttcgacctagtcctacccagtaacgaactaaacttacccgaaagaaccaactaccgtagtactcctagaccaaagtgaacagccctaggaaggacgcccgggaacggaaccgacccgggaccctaaacccgtttacgtttaccgtacggttaaaccggaaaacggttaaactaaaccgaaaccaaccgtacggacgttacggggaaacgtaacggggaacgaaaccccggg

SEQ ID NO: 122335 - DNA, 567 bp, Homo sapiens
  misc_feature: GYAE6OF01AR1EQ.52.81.H04.1.454.CMB.1.raw
  modified_base (180)..(180): a, c, t, g, unknown or other
  misc_feature (180)..(180): n is a, c, g, or t
  modified_base (351)..(351): a, c, t, g, unknown or other
  misc_feature (351)..(351): n is a, c, g, or t
tcagcgcagtacgacacgaccggtgctcgatttagtagtgtagattcgcgggcacgaccggtgctcgatttagtagtgtagattcgcggggggaggcttggtacagcctggggggtccctgagactctcctgtgcagcctctggattcacctttcgcgtctatgacatgagctgggtccnccaggctccaggaatgggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttcngtaacgaaagatacacacagctggacgaggagaccaacggcgaactacttctttgactacgtgggaccagggaaccctggtcaccgtctcctcacgccctacgacccgaacgggccccacgtccggtccttcccccgtcggcctaccctcctcccgaacgacgaccgacctcgtcggggccacgacgccggcccgtgggcctcggccgtggtaccg

SEQ ID NO: 122336 - DNA, 552 bp, Homo sapiens
  misc_feature: GYAE6OF01EQQ8I.52.81.H04.1.454.CMB.1.raw
  modified_base (183)..(183): a, c, t, g, unknown or other
  misc_feature (183)..(183): n is a, c, g, or t
  modified_base (332)..(332): a, c, t, g, unknown or other
  misc_feature (332)..(332): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatgggagttttgggctgagcggtgtgtttctaggtggctaatttaaaaggntcagtgtgaggtgcagctgctgcagtcggggggagcttggtacagccgtggggggtcccctgagactctcctgtgcagccctctggattcacctttcgctctatgacattgagcttgggccgccaggctccagggaatggggcgtgggnggtggtcgtcgagtataagtagtggtaggaagtatatatacgacgagactcgtagacggcgtctcacactctcanagacaactacaanaacaacactatatactanacaanaagaacacgacgtagagacgacggacgacgaccgaccgtaccttacttacgtacgtaacgaaacgaaactaacaacaacgacgacgaggaacggaacggaacggaaccg

SEQ ID NO: 122337 - DNA, 246 bp, Homo sapiens
  misc_feature: GYAE6OF01CRS8T.52.81.H04.1.454.CMB.1.raw
  modified_base (179)..(179): a, c, t, g, unknown or other
  misc_feature (179)..(179): n is a, c, g, or t
  modified_base (181)..(182): a, c, t, g, unknown or other
  misc_feature (181)..(182): n is a, c, g, or t
  modified_base (184)..(186): a, c, t, g, unknown or other
  misc_feature (184)..(186): n is a, c, g, or t
  modified_base (189)..(191): a, c, t, g, unknown or other
  misc_feature (189)..(191): n is a, c, g, or t
  modified_base (193)..(246): a, c, t, g, unknown or other
  misc_feature (193)..(246): n is a, c, g, or t
tcagcgcagtacgacacgaccggtgctcgatttagtagtgtagattcgcgggggagctctgagagaggagccccagcccgtagggattttcgaacggtgttttcatttggtgtatcaggactgaacagagagaactccacatggagtttaggctgaagcgggctggcaaggcgcatagncnntnnngannncnnnnnnnnnnnnnnnnnnnnnnnnnnnnnnnnnnnnnnnnnnnnnnnnnnnnnn

SEQ ID NO: 122338 - DNA, 567 bp, Homo sapiens
  misc_feature: GYAE6OF01ACSVU.52.81.H04.1.454.CMB.1.raw
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgacaaatgaacagcctgagagccgaggacacggccacctattcngtaacgaaagaatacanacagctggacgaggagaccgaacggcgactacttcttgactacgtgggccgagggaaccctggtccaccgtctcctcacgccctccaccgaacggcccacgtccggtccttccccgtcggcccaccctcctccaacgacgccgaccgtcggtcggggccaccgacggccggtcccgtcgggcctcggccgtgggtaccg

SEQ ID NO: 122339 - DNA, 818 bp, Homo sapiens
  misc_feature: GYAE6OF01BD4RO.52.81.H04.1.454.CMB.1.raw
tcagcgcagtacgacacgaccggtgctcgatttagtagtgtagattcgcggggggagtcagacccagtcaggacacagcatggacatgagggtccccgctcagctcctgggggactcctcgctcgtcgtccttggcgtcccctaccggtaggtccaaactaagttggacaactccacgagtgtacccgacgtcttcccttccctacccctcgtctcgcatctgtaggagacagagtcaccactcacttcgtccgggcccgactcgacgaataattaattaaagtggttcggtccgtcggtagtacagacacgataccaacgggaaaggacccctaaacctacctcgatacttactaaggtcggtcttagtttaaggtaaaacggtacggggttcccgtttacctaagggttaccgtacggaccgggccgaggttggggtaagttacgttacgggggtaacgaacgtaaagtttacctacctaccttacctaacccaaacttaccaaacccaaacggtccccgttacggtaccaccggtacccgttcggtaattacggtttaatttttacggtaccgtaaaccttttaaactttaccgtcgtaacccgaaacctaaacctttattaaacttacctacttttaaatttcccgtacccccgggttacccgttaaccctttttaccggggtcccccgttaccggggaaaccgaaaccgtaccgttacggtaacgttaacgttaccggggtaccgggtaaaccgttcgggttcgggtccctaccggtcgaaccccctaagtttccgttccggttcctttaccc

SEQ ID NO: 122340 - DNA, 690 bp, Homo sapiens
  misc_feature: GYAE6OF01BTKT2.52.81.H04.1.454.CMB.1.raw
  modified_base (307)..(307): a, c, t, g, unknown or other
  misc_feature (307)..(307): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcgttttctagtggctaattttaaaaggtgtccagtgtgaggtgcagctgctgcaggtcggggggagcttggtacaggccgtggggggtccctgagctctcctgtgcagcctctggattcacctttcgcgtctatgacatgagcgtgggtccnccaggcctccgaggaatggggctgggagtgggtctcgagttattaagtagtgggtagaagtacaattagtacgcagtactccggtaggaacgggcccgtcgttaccacccgtattacctaccgaggaaacgtaacctaaactttacccgaaagtaaaccaccgtaaccgttaggttacttaccgttaaggacctaaaagttacgaaaccgtacggtcccgttaagggaacggaccggaccggaaccgggaaccgaacccgggtacccctaaccgttaacgttttccgtaaacggttaaaccggaaaaacgtaaacgttaaccaaccgaaaccgaaggtacccgttaaggggaaacccggaaagggaaccggaaaacccccggg

SEQ ID NO: 122341 - DNA, 592 bp, Homo sapiens
  misc_feature: GYAE6OF01B313L.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcaggtcggggggagcttggtacaggccggtggggggtccctggacgactctccgtgtgcaggcctcgtggacttcacctttcgcgtctatgacatgagcgtgggtcccgcacggtctaccgaggagtcggggactgggagtgggtctgaggttaattaagtagtgggtagtaagtacatattacgcagtacgttccggtaggaaccgggtccgtacttaccgacctactcctaccgaagacgaacctaaacttaccaaagaacactacttgtaactctagacaaagtcgaaacagtacctgaacgacgaccgaggaccacggacctacttagttcgtagtaacgaaagtactacacgacacggtacaggacgaaggcgaaacccgg

SEQ ID NO: 122342 - DNA, 561 bp, Homo sapiens
  misc_feature: GYAE6OF01AWJ71.52.81.H04.1.454.CMB.1.raw
  modified_base (306)..(306): a, c, t, g, unknown or other
  misc_feature (306)..(306): n is a, c, g, or t
  modified_base (461)..(461): a, c, t, g, unknown or other
  misc_feature (461)..(461): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtcgtttctaggtggctattttaaaaggtgtcagtgtgaggtgcagctgctgcaggtcgggggaggcttggtacagccgtggggggtccctgacgactctcctgtgcagcctctggattcacctttcgcgtctatgacatgagcgtgggtccnccgaggcctccgaggaagtggggctgggagtgggtctcgaggtattaaagtggtggtagggaatacgatattaacgcaagactcgtagaacgggccgtcttcaccatcctccagagactaattaccaagaacacactgtatctgacaaatcgaanacgctagagacgccgagaccgacggacctacttaacttcgtacgtaacgaaagaaactacgaataaccacgaccgtaggaaccggtaggacgaaacccgg

SEQ ID NO: 122343 - DNA, 601 bp, Homo sapiens
  misc_feature: GYAE6OF01C5W3X.52.81.H04.1.454.CMB.1.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtcgtttctaggtcggctaatttaaaggtgtcagtgtgagtgcagctgctgcaggtcggggganttggcagccgtgggggcccngagctntccgtgtcgcaagtccctgttggaactttccaaccgttttcgccgtntaatggaacntgagtcgtcggtccgccgnggcgtccgaggaagtggggnggtggnggtggtcgtgtagtagtagtaggtaggtagtaagtaatatactacgacgacgacgtacgtacggacggtccgtacctacctacctactacctacgagaacgaactaactaacaacgaacaactactacgtatacgtacaactaacgtaacgacacgacgtagagacgacgacgaccgaccgtaccgtactacgttacgtacgtaacgtaacgtaactaacaacgacgtacgacgtaggacggaacggacggaaccg

SEQ ID NO: 122344 - DNA, 570 bp, Homo sapiens
  misc_feature: GYAE6OF01B1UFH.52.81.H04.1.454.CMB.1.raw
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (362)..(362): a, c, t, g, unknown or other
  misc_feature (362)..(362): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtcggctatttaaaggngtcagtgtgaggtgcagctgctgcaggtcggggggagtcgttggtaacnggtcccgtggggggtccctgagactctcctgtgcagcctgttggattcncctttcgctctatagcatgagtcgtcggtccgcaggctcaggagtgggctggngtggctcgtagtataagtgtggtagacgtanatatacgcagacttcgagacgggcctctcactcgtctccgagacgaacacgttaccaacgaactactacgtgtacttcgagacgtaaactcgaactagacccgtaaggacgtaacggacccggaggtaacccgaccgggaccttacctaatttcccggtaagaacggaaataacacgaactacgacacgtagacgacggtacaaccgg

SEQ ID NO: 122345 - DNA, 635 bp, Homo sapiens
  misc_feature: GYAE6OF01C5B5R.52.81.H04.1.454.CMB.1.raw
  modified_base (180)..(180): a, c, t, g, unknown or other
  misc_feature (180)..(180): n is a, c, g, or t
  modified_base (267)..(267): a, c, t, g, unknown or other
  misc_feature (267)..(267): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtggctaatttaaaggngtccagtgtgaggtgcagctgctgcagtgggggagcttgggtacaggtcctggggggtcccctagagactctcctgtgcacgccctntggacttcaccttttcgcgtctatgacatgagtcgtcgggtaccgcccagggcctccgaagggaagttgggggtaccggtagggtacggtcgggtcgtacggtaacggtttaagtttaaagttagggtaggtaaggtaacgttactaataagttacgacgtacgaccgtcggtaggacggtccgtacttaccactactcgacgaagacaactaactaccaacgaacaactactacgtactactacaactaataacgaacgacgcgtacgacgacgacgacgacgaccgaccgtaccgttacgttacgtacgtaacgtaaacgtaaactaacgaacgaacgtacgacgaggacggacggaacggaaccg

SEQ ID NO: 122346 - DNA, 569 bp, Homo sapiens
  misc_feature: GYAE6OF01BLFMP.52.81.H04.1.454.CMB.1.raw
  modified_base (305)..(305): a, c, t, g, unknown or other
  misc_feature (305)..(305): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagctggctttttcttgtggctattttaaaaggtgtccagtgtgaggtgcagctgctgcagtcggggggagcgttggtacaggccgtggggggtccctggagactctcctgtgcagcctctggacttcacctttcgcgtctatgacatgagctgggtccnccgaggctccgaggaagtgggctgggagtgggtctcgaggtattagtaggtggtaggaagtacgatagttacgctaaggactccgtgaacgggtccgacttcacatcctaccagacactaaattacccgaagaaccacacgtagtatactagaacctaaagtcgaacacgcctagacgacgaccggaggaccgacggacctaccgttatttccgtaagtaacgaaagtaacaccaacacagctagggaaccgaggacgaacccg

SEQ ID NO: 122347 - DNA, 637 bp, Homo sapiens
  misc_feature: GYAE6OF01C35UD.52.81.H04.1.454.CMB.1.raw
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
  modified_base (419)..(419): a, c, t, g, unknown or other
  misc_feature (419)..(419): n is a, c, g, or t
  modified_base (502)..(502): a, c, t, g, unknown or other
  misc_feature (502)..(502): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagcgtggtcttttctgtggcttaattttaaaggtgtccagtgtgaggtgcagctgctgcaggtcgggggagcttggtacaggccgtcgggggtccctggagactctccgtgtgcagcctctggattcctaccgtttcgcgtctatgacatgagcgtggtccncaggcctcgaggagtgggctgggagtgggttctcgaaggttaatttaacgtaggttcgggtaggtaaacgtanaacgttattacgctaagaccgtcgtaggaacgggtccncttcaaccatcctaccgaagacgaactaacttacccgaaagaacctacgtactacgttataccgttagaactaaatcgaaacncgtcctaaggacgaacggcgacggacaaaccggtcccaaacgtttattccggtaaacggtaaacggaaaactaaccttaacgaacccgacgtaaccggtacgtagggaaaccgaacgggaccgtaaaaccccggg

SEQ ID NO: 122348 - DNA, 581 bp, Homo sapiens
  misc_feature: GYAE6OF01CNK4N.52.81.H04.1.454.CMB.1.raw
  modified_base (479)..(479): a, c, t, g, unknown or other
  misc_feature (479)..(479): n is a, c, g, or t
  modified_base (528)..(528): a, c, t, g, unknown or other
  misc_feature (528)..(528): n is a, c, g, or t
tcagcgcagtacgacacgaccggtgctcgatttagtagtgtagattcgcggggagctctgagacgaggagcccagccctgggattttcaggtgttttcatttggtgatcaggactgaacagagagaactcaccatggagtttgggctgagctggtcttttcttgtggctatttaaaaggtgtccagtgtgaggtgcagctgctgcaggtcgggggagcttgggtacagccgtggggggtcccctggagtactcctccgtgtgcagtccctctggattcaccttttcgcgtctatgacatgagctgggtccgacgaggctccaggaatggggctggagtgggtctgaggttattaagtagtggtagaagtacaatattacgcagacgtccgtggaacgggcacttaccaccagtcaccctaagacgaactaaacttccaaagaaccaactactacgtaactctagaccaaattcgaaacncgtacccgtgaacgcgacccggaggacccacggccaaccttatttacgngtaaaccgaaaggtactaacgacagacgacgtaggaaccgaggacgaaacccg

SEQ ID NO: 122349 - DNA, 726 bp, Homo sapiens
  misc_feature: GYAE6OF01BFJ79.52.81.H04.1.454.CMB.1.raw
  modified_base (308)..(308): a, c, t, g, unknown or other
  misc_feature (308)..(308): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctgcaggtcggggggagcttggtacaggccgtggggggtccctgagactctcctgtgcagcctctggattcctacctttcgcgtctatgacatgagtcgtcgggtccnccgaggcctccgagggaagtggggctgggagtgggtctcgtaaggtattaagtaggttgggtaggaaagtactaattaacgttaccgactaaggtaccgtaccggtaggaacggggccctacgtttccgaaccgtaattcccgtaacccgaaggtaaaccggaacctaaacgttaccccgaaaagtaaaccctaaccgtaacttacggtaaacttcctaaggaaccctaaaaagttccggaaaactaccggtacccgttaaagggaaccggaacggtaacccgggaaggaaccccgtaaccgggtacccctaaaccgtttaacgtttaccgtaacggttaaaaccgaaaacggtaaactacccgaaacaaccgtaacggtaccgtaagggaaccggaacgggtaccgaaaaccccggg

SEQ ID NO: 122350 - DNA, 597 bp, Homo sapiens
  misc_feature: GYAE6OF01DPAMA.52.81.H04.1.454.CMB.1.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (483)..(483): a, c, t, g, unknown or other
  misc_feature (483)..(483): n is a, c, g, or t
tcagcgcagtacgacacgaccggtgctcgatttagtagtgtagattcgcggggagctctgagagaggagcccagccctgggattttcaggtgttttcattttggtgatcaggactgaacagagagaactcaccatggagtttggctgagcggtgtcgtttctaggtcggctaattttaaaaggtgtcagtgtgagtgcagctgctgcaggtcggggagcgttgacnggccgtgggggtcctgagctcnccgtgtgcgacgcccttctaggtactttccgtaccttttcggccgttactaattgaacctagttgagcttacggggtcccaacgcggtcctacccggaaggaacggttcgggagtggtaggtgggtccgtcgtagttaagttaagtagtggtagaaggtatattatacgtacgtagtacgcgtacgacggccgtcttcacactctaccagagacacttacaacaacacatatatntacgaacatacaacacgacgtacgacgacgacgacgaccgaccgacctacgttacgttacgtacgtaagtaaactaacaacgaacgacgacgtacgaacgacgacgaacgaacg

SEQ ID NO: 122351 - DNA, 563 bp, Homo sapiens
  misc_feature: GYAE6OF01A7895.52.81.H04.1.454.CMB.1.raw
  modified_base (358)..(358): a, c, t, g, unknown or other
  misc_feature (358)..(358): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcaccttttcgcgtctatgacatgagctgggtccgccaggctccaggaatgggggctgggagtgggtctcaggtattaatagtggtggaagtacatattacgcagactccggtgaagggccgcttccaccatctccagagacaattccaaagaacacactgtatctgcaaaatgaacagcctgagagccgaggacacggccacctatttcngtaacgaaagaatacacacagctggacgaggagaccaaacggcgactacttcttgactacgtgggccgacgggaaccctggtcaccgtctcctcacgcctccaccgaacggcccacgtccgtccttccccctcgccaccctcctaccaacgacgccaccgtcgtcggggcacgacgccggcccgtgggcctcgccgtgggtaccg

SEQ ID NO: 122352 - DNA, 576 bp, Homo sapiens
  misc_feature: GYAE6OF01CEKNZ.52.81.H04.1.454.CMB.1.raw
  modified_base (167)..(167): a, c, t, g, unknown or other
  misc_feature (167)..(167): n is a, c, g, or t
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (443)..(443): a, c, t, g, unknown or other
  misc_feature (443)..(443): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (542)..(542): a, c, t, g, unknown or other
  misc_feature (542)..(542): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
tcagcgcagtacgacacgaccggtgctcgatttagtagtgtagattcgcggggagctctgagagaggagcccagcccctgggattttcaggtgttttcatttggtgatcaggactgaacagagagaactcaccatggagtttgggctgagcggtgtcgtttctaggngctatttaaaggngtcngtgngagtgcagctgctgcagtgggggagcgttgtacngccgtgggggtccctgcgctctcctgtgcagcctntggacttcaccctttcgcgttactatgaatgtggcgcgttgggtcccgccgaggcctaccgaggagttggggctgggtagtcggggttcacgtaagggtatttaaagtagggtggtaggtaacgtacagtacttaacgcgtacgtacgttccggagaacgggcctcttaccactatccctacgaanaacggtactaattccaaagaccaactacgtctntactgaactaagngaaccngcctagaancggacacggacctacgccacttntttcgngtaacgaanactacganacgancgtaggacgagtgaaacccgg

SEQ ID NO: 122353 - DNA, 721 bp, Homo sapiens
  misc_feature: GYAE6OF01DKLDG.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttcttgtggcttaattttaaaaggtgtccagtgtgaggtgcagctgctgcgaggtcggggggagcttggtacagccgtggggggtccctggagactctcctgtgcagcctcgtggacttccaccttttcgcgttctatgacatgagcgtgggtcccgcgaggcctccgaaggaagtggggactgggagtgggtcctagaggttattaagtaggtggtaggtaagtacaattacttacgctaacgtacgtcggtaggaacgggtccgtcttaccgacctagtcctaccgaagacgaacctaacttacccaaacgtaaccaaccctaacgttggttaacttccgtagaacctaaagtacgaaaccgacggtaccctaggaagtaccggacccgggaaggtaaccccgaacccgggtacccctaaaccgtttacgttttacccggttaaacggtaaaccggtaaaaacgtaaaacccgttaaccgaaacccgttaaacggaaccggttaacccggttaccgggggaaaaccggtaacgggggaaccggtaaaaacccccccgggg

SEQ ID NO: 122354 - DNA, 794 bp, Homo sapiens
  misc_feature: GYAE6OF01DB27Z.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctgcaggtcggggggaggcttggtacagcctggggggtccctgagactctcctgtgcagcctctggattcacctttcgcgtctatgacatgagctgggtccgcaggcctccgaggaagtggggctgggagtgggtctcgaggttattaagtaggtagggtaggtaaagtacaagttaagtttaaccggcgtaacggaccgttcccgggttaggaaacggggtcccgtacctttaccgaacccgtaattcccgtacccgaaggtaacggaaaccctaaaactttaccccgaaaaggaaaccctaaccgtaaaccgttaggttaacgtttaccgtacggtaaccctaaaaagttaccggaaaacctacggtaccccgttagggaacgggaaccgaccccgggtaacgggaacccgtaaaccccggggtacccctaaaccccgttttaagttttacccccgttaaacgggttaaaacccgggtaaaaaacggtaaaaccgttaaaccccgaaacccgtaaaccggtaaaccgggtaacccgggttaacggggaaaacccggggtaacgggggtaaacccggaaaaccccccgggg

SEQ ID NO: 122355 - DNA, 565 bp, Homo sapiens
  misc_feature: GYAE6OF01CE1ST.52.81.H04.1.454.CMB.1.raw
  modified_base (483)..(483): a, c, t, g, unknown or other
  misc_feature (483)..(483): n is a, c, g, or t
  modified_base (529)..(529): a, c, t, g, unknown or other
  misc_feature (529)..(529): n is a, c, g, or t
tcagcgcagtacgacacgaccggtgctcgatttagtagtgtagattcgcggggagctctgagagaggagcccagccctgggatttcaggtgtttcatttggtgatcaggactgaacagagagaactcaccatggagtttgggctgagctggtctttttcttgtggtcttaattttaaaaggtgtccagtgtgaggtgcagctgctgcaggtcggggggagcttggtacaggccgtggggggtccctgagactctcctgtgcagcctctggtacttccacctttcgacgtctaatgacagtgagcgtcgggtcccgccgaggcctccgaagggagtggggctgggtagtgggtctgaaggttattaagtaggtggtaggaagtacattatacgctaagactccggagaacgggcctcttcacctatacctacgagacaactaactaccgaaagaacactacgtagtactcagacaaatcgaacncgacctgagacgcgagaccaccgcctacctattcgagtaacgaaanacacacacgtacgacgtaggaacgaggacgaacccg

SEQ ID NO: 122356 - DNA, 627 bp, Homo sapiens
  misc_feature: GYAE6OF01BKTFI.52.81.H04.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtcttttcttggtggctaattttaaaaggtgtccagtgtgaggtgcagctgctgcaggtcggggggagcttggtacagccgtggggggtccctgagactctcctggtgcagcctctggattcacctttcgctctatgacatgagctgggtccnccaggctcaggaatggggcngggagtgggtctcgaggtattaagtaggtggtaggaagtacatagttacgactagaacgtccgtaggaacgggtccgtcttacaaccattcccgtaccacgaagtaaccaaacgtttacccaaagaactaaccaagttacggtatcttacgaacctaaagttacgaaacacggaccctaggaacgacggaccggaacgaccgacccgggtacccaacctttacgttacgttaacggtaaacggaaataaccaaacgtaacccaacgtacgaccgtagggaaccggaaggacggaaaccccgg

SEQ ID NO: 122357 - DNA, 697 bp, Homo sapiens
  misc_feature: GYAE6OF01CRXT0.52.81.H04.1.454.CMB.1.raw
tcagcgcagtacgacacgaccggtgctcgatttagtagtgtagattcgcggggagctctgagagaggagcccagccctgggattttcaggttgttttcatttggtgatcaggactgaacagagagaactcacatggagtttgggctgagcgtggtctttttctgtggtcttattttaaaagtgtcagtgtgaggtgcagctgctgcgaggtcggggggagcgttgggtacacggccgtcgggggggtccctggacgtacctcgtccgtgtcgcacgtcctcgtggattcacctttcgcgtctatcgatagtgacgcgttcgggccgccgaggcctaccgagggtaagtcggggtctgggtagtcgggtctgtaaggttaattaagtaggtggtaggaacgtaactagtaagttacgactaacgaaccgtcggtaagggaacgggtcccggtacctttacgaacctataccgtaccaagtacgaactaaacttaccgaaagaacactactacgtatactacgaactaaatacgaaccagtacccgtagaacggtacgaccggaacggaccgtaacccgacccgttaaaccgttaactttaccggtaacgtaaaacccgggtaaaagtaaacgttaacccgaaactaaccgaaccggttacggaccgggtaaaccggaagggtaacccgaaaacccggg

SEQ ID NO: 122358 - DNA, 733 bp, Homo sapiens
  misc_feature: GYAE6OF01CUKPM.52.81.H04.1.454.CMB.1.raw
  modified_base (248)..(248): a, c, t, g, unknown or other
  misc_feature (248)..(248): n is a, c, g, or t
tcagcgcagtacgacacgaccggtgctcgatttagtagtgtagattcgcggggagctctgcttcagctgtgagcgcagaaggcaggactcgggacaatcttcatcatgacctgcctcccctctcctcctccacccttctcattcactgcacgagggtcctgggcccagtctgtgttgacgcacgcccgccctcagtgtcgtcgccggccccaggacaggaacgtcaccatcctcctgctcgaggaacncacgcctacccaatagttcggaacttaaagtttaacgtttttggtcgttcccgttagggtaacccacggtacctaaaccctccccgaaggccaaaccgacccgtaaccccctaaactccctactaattttacacgaaactaatcgtaaataacggaccgtaccctacggaacggtacctaaccgtcgaaccgtatttccgtacgtcggtacctaccgaagttccgtacggacctaccggtacaccggacccgtaccccggtgggaccctacgtacccggaacccgggtacctacccggaacggtaccgggtacggggaccggaacggtaccgttaacgtttacgttaaccggtcggaaccggtaacgtacggtacgggtaactacggaccgtacgtccgaggtaggtacgacgtcggtaccggtaggggttcggtacggggaccggtaacggaacgtacggtacgtccgggtacccgttaacggg

SEQ ID NO: 122359 - DNA, 574 bp, Homo sapiens
  misc_feature: GYAE6OF01AF8CG.52.81.H04.1.454.CMB.1.raw
  modified_base (265)..(265): a, c, t, g, unknown or other
  misc_feature (265)..(265): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccncttcaccatctccagagacaattccaagaaccacactgtatctgcaaatgaacagcctgagagccgaggacacggccactatttctgtacgaaagaatacactacagctggaccgaggacgaccgaacggcgactacttctttgactacgtgggccagggaccctggtccaccgtctcctcacgccctccaccgaacgggcccacgttccggtcccttcccccgcggcccaccccgtccgtacccgaacggacgcccgacccgtcgtcggggccaccgcggccgtcccgtggcctcgcccgtggtaccg

SEQ ID NO: 122360 - DNA, 624 bp, Homo sapiens
  misc_feature: GYAE6OF01AX398.52.81.H04.1.454.CMB.1.raw
  modified_base (608)..(608): a, c, t, g, unknown or other
  misc_feature (608)..(608): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggcttttctgtggctattttaaaaggtgtccagtgtgaggtgcagctgctgcaggtcgggggagcttggtacagccgtgggggccctgagactctcctgtgcagcctctggacttcacctttcgcgtctatgacatgagcgtgggtccgccaggctccgaggaatggggctggagtgggtctcgaggtataagtagtggtagtagtacatattacgacagtacgtcgtaggaacgggtccgccgttacacctaatccgtacccgagaacgtaacctaacttaccaaacgtaacctaaccgaacttaggtactcgtacgtaacaaattagaaacctacgcccgtaaggacggtaacgaccggaacgggaccgaaccgggaccctaaccgttaacgtttaccgtacgtaaaccggaaaagaacttaaccgaaactaaccgacgtacgtaggaaacggngggaacgaaacccggg

SEQ ID NO: 122361 - DNA, 629 bp, Homo sapiens
  misc_feature: GYAE6OF01CAQ2M.52.81.H04.1.454.CMB.1.raw
  modified_base (190)..(190): a, c, t, g, unknown or other
  misc_feature (190)..(190): n is a, c, g, or t
  modified_base (335)..(335): a, c, t, g, unknown or other
  misc_feature (335)..(335): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctccctcctcacccttctcattcactgcacagggtcctgggcccagtctgtgttgacgcagcccgccctnagtgtctgccggccccaggacagaacggtcaccatcctcctgctcgtggaagcagctaccaacattcggactaaattaattttgtagttcctggtaccagccaactcccaggccaccacgaccccccaaatccctactaatttanacgaacaatgaactaacgccgtaccctcgacggtactacccgtgacccgtattcctcgtcggtcctaccgaagttcctggacctacgtccacgcccgtacccgtgggacctacgtcccgacccgggtacctcccgacggtaccggtcggggaaccgtacgggtacccgtaatttacgttaccgtacggaccgggtaacgtagtagggactacggacgacgtccgtagagtagtacgtcgacggtagggtcggttacgggcgggtacggaccgaggtccgtggtacccgtaccgg

SEQ ID NO: 122362 - DNA, 727 bp, Homo sapiens
  misc_feature: GYAE6OF01DRBSF.52.81.H04.1.454.CMB.1.raw
  modified_base (229)..(229): a, c, t, g, unknown or other
  misc_feature (229)..(229): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctgcaggtcgggggagcttggtacnggccgtgggggtccctgagactctccgtgtgcacggcctcgtggactttcctaccctttcgcgttctatgacagtgacgtcgtcggggtccgccgaggcctccgaaggtaacgtggggctggacggtgggtctagtaggtaattaagtagtggtaggtaagtactaattacgttacgacaacggtaccgtaccggtagggaaccgggtccgtaccttaccaaccgtacgttccttacccgaagtaaacgtaaccgtaaactttaacccaaaaggtaaaccctaacgtaaaccttacggttaacttaccgtacgtaaacctaaaagttacgaaaaccctaggaccccgttaaggaacggacggaccggaacggaacccggtacccggacctaaacccgttaagttttaccgtaaacggttaaaaccgaaacgttaaactaaccgaaacctaaccgtaacggaccgtaagggaacccgggaaaggacccgaaaacccggg

SEQ ID NO: 122363 - DNA, 648 bp, Homo sapiens
  misc_feature: GYAE6OF01BMEGB.52.81.H04.1.454.CMB.1.raw
  modified_base (269)..(269): a, c, t, g, unknown or other
  misc_feature (269)..(269): n is a, c, g, or t
tcagcgcagtacgacacgaccggtgctcgatttagtagtgtagattcgcgggcacgaccggtgctcgatttagtagtgtagattcgcggggggaggcttggtacagcctggggggtccctgagactctcctgtgcagcctctggattcacctttcgcgtctatgacatgagctgggtccgccaggctccaggaagtggggctgggagtgggtctcgaggtattaatagtggtaggaagtacatattacgcagactccgtgaacgggccncttcaccatctacagacgactaatccaaagaacacactgtatctgacaaatgaaacacgcctagaagacggacccggaaggaaccgaccggaccctaaccgttatttaccgtagtaaaccgaaaagtaactaacacaacgagcgtaggaacgaggacgaaccgaacggcgacttacttcgttacgactacgtcgggaccgacgggacctcggtacctaccgtcctccgtacacgccctaccgaccgaacggtccctacgtccgttcccttccccgtcggacccctacccgtaccctaccgaaacgtccgtaccctaccgttcggaccggggccaccgacggcccggtcccgtcgggtacctcggtccgtcggtaacccg

SEQ ID NO: 122364 - DNA, 540 bp, Homo sapiens
  misc_feature: GYAE6OF01DGTJ8.52.81.H04.1.454.CMB.1.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (375)..(375): a, c, t, g, unknown or other
  misc_feature (375)..(375): n is a, c, g, or t
  modified_base (408)..(408): a, c, t, g, unknown or other
  misc_feature (408)..(408): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagcgtgtcgttttctagtggctatttaaaggtgtccagtgtgaggtgcagctgctgcaggtcggggggagcttggtacaggccgtggggggtccctgagactctcctgtgcagcctntggattcacctttcgctctatgacntgagctgggccgccaggctcgaggagtgggctggagtgggtctgaggtattaagtgtggtggaagtacatattacgcagacttccgnggaacggccgtcttacaccaatctaccaagganaactaatccaaagacacgactgtaatctagaacaatcgaactagcctagacgacgccgagacaagtcggacctactagtttacgtagtaaacaaagtaactacgaactacgacgtgtacggaagaggaaccg

SEQ ID NO: 122365 - DNA, 618 bp, Homo sapiens
  misc_feature: GYAE6OF01CRP63.52.81.H04.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (407)..(407): a, c, t, g, unknown or other
  misc_feature (407)..(407): n is a, c, g, or t
  modified_base (471)..(471): a, c, t, g, unknown or other
  misc_feature (471)..(471): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtggctaatttaaaggngtcagtntgaggtgcagctgctgcgaggtcgggggagcttgggacaggccgtggggggtccctggagtcctctcctgtgcagtccctgtaggtnttccnccttttcgcgttctatgacatgagctcggccnccaggcncgaggagtgggntggagtgggtctataggtaattagtaggtggtaggatactatattaacgctaagcgtcgtaggacgggccacttacnctaatccgaccaaggtacaactaatcccgaaagaacctacaaaccgttatactactagaacaanaacgaacgtacgtacgtacggacgaacggaaccggaacggaaccgaccgtaacccgtaccgtttacgttaacgttaacggtaaacgtaaacggtaaacaaccaaccaacgtacggtacggtacggaacgggaacggaacggaaacgg

SEQ ID NO: 122366 - DNA, 524 bp, Homo sapiens
  misc_feature: GYAE6OF01CBW9U.52.81.H04.1.454.CMB.1.raw
tcagcgcagtacgacacgaccggtgctcgatttagtagtgtagattcgcgggggagctctgagagaggagcccagccctgggattttcaggtgttttcatttggtgatcaggactgaacagagagaactcaccatggagttgggctgagctggcttttcttgtggctatttaaaaggtgtccagtgtgaggtgcagctgctgcaggtcgggggaggcttggtacagccgtgggggtccctgagactctccgtgtgcagcctctggtatcacctttcgcgtctatgacatgagcgtgggtccgccaggctccgaggaagtgggctggagtgggtctcgaggtattagtagtggtagaagtacatattacgctagactcgtagaacgggccgtcttcacatctcagaacgacaattccaacgaacacactgtactctgacaatgaacacgccgtagacgacgaccgaggaccacggcctactacttctagtacgaaagatacacacagacaggacgaggcgaaccg

SEQ ID NO: 122367 - DNA, 560 bp, Homo sapiens
  misc_feature: GYAE6OF01BLXB4.52.81.H04.1.454.CMB.1.raw
  modified_base (179)..(179): a, c, t, g, unknown or other
  misc_feature (179)..(179): n is a, c, g, or t
  modified_base (252)..(252): a, c, t, g, unknown or other
  misc_feature (252)..(252): n is a, c, g, or t
  modified_base (464)..(464): a, c, t, g, unknown or other
  misc_feature (464)..(464): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtggctatttaaaggngtcagtgtgagtgcagctgctgcgagtcggggggagcttggacagcctggggggtcctgagctctcctgtgcncgctctgtcttctaccttcgtcgtctatgacatgacgtcgtcgggtccggccgacggtcgtacgacggaggtcgggtcggtgggtacggtcggtcgtacgtagtagttaagtagtaggtaggtaagtatatatacgacgacgacgtcgtacggacggcgtactctactactcacacgacgacaactacaacgaacacactatatctacacanacacacgacgtagacgacgacgacgacgacgacctactacttacgtacgtaacgtaagtaactaacacaacgtacgacgaggacgacggacgaacg

SEQ ID NO: 122368 - DNA, 690 bp, Homo sapiens
  misc_feature: GYAE6OF01EBZB6.52.81.H04.1.454.CMB.1.raw
  modified_base (152)..(152): a, c, t, g, unknown or other
  misc_feature (152)..(152): n is a, c, g, or t
  modified_base (175)..(175): a, c, t, g, unknown or other
  misc_feature (175)..(175): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgngtgttctaggcgctatttaaggngtcagtgtgagtgcagctgctgcaggtcggggagcttggaccagccgtgggggtccctggagactctcctgtgcgagcctnggtatctcccgtttggcctntagtgaccatggacncgttcgggcccgaccgaggtccctacgaggaacgttcggggcctggggtacgttgggtcctacggtaagttaattagtagtggtacggaatagtacgttaatccgagtaacgtacgtccggttaggaacgggttcccgtacttaccgacctactacccgtaccgtagaacggtaacctaaacgttacccgaaaaggtaccctaacggtaaacttcggtaattacccggttacgaaacctaaacggttacggtaaacacggtaccgttaaccgggaagacccggaccggtaaccgggaacctaacggccctaacgttaacgttaccggaagtaaaccggtaaactagttaaccgaccgtaacgacgtacggtacgaaacgggtgggaacccgaaaccggg

SEQ ID NO: 122369 - DNA, 589 bp, Homo sapiens
  misc_feature: GYAE6OF01DUI6C.52.81.H04.1.454.CMB.1.raw
  modified_base (267)..(267): a, c, t, g, unknown or other
  misc_feature (267)..(267): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggctaattttaaaaggtgtccagtgtgaggtgcagctgctgcaggtcggggggagcttggtacaggccgtggggggtccctgagactctcctgtgcagcctntggattcacctttcgcgtctatgacatgagcgtgggtccgccgaggctccgaggaagtggggctgggagtcgggtctcgaggttattaagtaggtggtaggaagtacaatattacggcagtacctccggtaggaacgggcctacttaccacccattcctaccagacgaactaagttacccaagaaccactactgtactctagacaaagtcgaacacgcctaggacgacgaccggaggaccaccggccctaacttactttacgtaacgtaaacgaaagtaactaaaccacaacgtagacgtggaacggtaggacgaaacccgg

SEQ ID NO: 122370 - DNA, 648 bp, Homo sapiens
  misc_feature: GYAE6OF01B819C.52.81.H04.1.454.CMB.1.raw
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagctggtctttttcttgtggtcttattttaaaaggtgtccagtgtgaggtgcagctgctgcgaggtcggggggaggtcgttaggtacaggccgtcggggggtccctggagactctccgtgtcgcacgtcctctggtattccacctttcgcgtctatgacagtgagtcgtcgggtccgccaggctccgaggagtggggctgggagtggtcctgaaggtattaagaggtggtaggaagtacatattacgcaggtactccggagaacgggccncttcacncttcnccagacgaacaacttacaagaaccacgaactagtactacgtagaactaaagtcgaaacacggtaccgtaggaacgacggaccggaacggaacccgaccgggtaccctaaacccgtttacgtttaaccgtaacggtaaacccgaaaaggtaaaccttaaacccgaaaccaaccgaacggtacgtaaggggaaaccgtaaggggaacccgtaaaaccccggg

SEQ ID NO: 122371 - DNA, 579 bp, Homo sapiens
  misc_feature: GYAE6OF01AWT1H.52.81.H04.1.454.CMB.1.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (484)..(484): a, c, t, g, unknown or other
  misc_feature (484)..(484): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctaggtggctaattttaaaaggtgtccagtgtgaggtgcagctgctgcagtcgggggagcttggtacngccgtgggggtccctgagctctcctgtgcagcctgtggattcncctttcgcgtctagtgacntgngcgtgggtccgcaggctacgaggagtgggctggngtggtctcgaggtattaagtagtggtagagtacatagttacgcacgtacgtaccggtaggaacgggtccgtacttaccgacctactccgttacccgaagtaacgaactaacttaccgaaacgaacctacaccgtagtactcgtagactaatcgaacncgtactgagacgaccgaggaccacggacctaccttattcgtacgtaacgaaagtaactaacaacacacgacgtaggaaccgaaggacgaacccgg

SEQ ID NO: 122372 - DNA, 764 bp, Homo sapiens
  misc_feature: GYAE6OF01EIEN3.52.81.H04.1.454.CMB.1.raw
  modified_base (266)..(266): a, c, t, g, unknown or other
  misc_feature (266)..(266): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgctgcaggtcgggggagcttggtacagccgtggggggtccctgacgactctcctgtgcagcctntggattcacctttcgctctatgacatgagcgtgggtccgccaggcctcgaggtaacgtggggctagggaggtgggtcctacgaggttattaagtaggtggtaggaagtacagttaagtacgacgacgtacgtaccggtaggaacgggtcccgtacttaccgaaccctagttccctaccgtaaagtacgaacctaaacttaacccgaaaacgtaaccgtaacctaacctttaggttaacctacgtaacggaacctaaaagtacggtaaaacctaacggtaccgttacgggaacggtaccggaaccccgggtaacggggaaacccgtaaccccggggtaaccccctttaaaccccggtttaacgttttttacccggtaaacgggttaaaacccgggtaaaaaacggtaaacccttaaacccgaaacccgaaacccgtacgggttaaaccggtacccggggggtaaaccgggaaacggggaaaccgggtaaaaccccccgg

SEQ ID NO: 122373 - DNA, 733 bp, Homo sapiens
  misc_feature: GYAE6OF01CP6PZ.52.81.H04.1.454.CMB.1.raw
tcagcgcagtacgacacgaccggtgctcgatttagtagtgtagattcgcgggggagctctgagagaggagcccagccctgggattttcaggtgttttcatttggtgatcaggactgaacagagagaactcacatggagtttgggctgagctggtctttttcttgtggacttattttaaaggtgtccagtgtgaggtgcagctgctgcgagggtcgggggaggtcgttggtacgaggccgttcggggggtccctggacgtactcgtccgtggtcgcgacgtccgttcgtggtactttcctaccgttttcgccgttctagtcgactagttggacggtcgttcgggtcccgccgaggtccgtaccgaggaacggtcggggcgtgggtacggtcgggtacctaggtaaggttaattaaggtagggttagggtaaggtaaagtaacgtagttaacgttacgacgtaacggtacccgtttacgggacggaacggggtcccgtacctttccgaacccgtattacccgtacgaacgtagaaacctaacgttaccaaacgaaccactacgtacgttactacgtagaacctaaagtcgaaacgcgtacccgtagaacggacggaccggaaggacccgtaccggtaccctacgtttaacgttcggtaaacgtaaacggaaaacgtaacctaacgaaccgacgtaacgggtacgtaacgggaacgacgggtaacgaaaccccggg

SEQ ID NO: 122374 - DNA, 797 bp, Homo sapiens
  misc_feature: GYAE6OF01D5L85.52.81.H04.1.454.CMB.1.raw
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (439)..(439): a, c, t, g, unknown or other
  misc_feature (439)..(439): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtcgtttctaggtcggctaattttaaaaggtgtcagtgtgaggtgcagctgctgcgaggtcggggggagcgttgggaccaggtccggtggggggtccctggacgacctctccgtgtgcagcctgtggnttcctacctttcggcttcctagtgacatggagtcgtcgggtccgccnggcctaccgagggagtggggntgggngtcgggtctagtaggttattagtagtggtagaagtacgattatacgacaagtcgtacggtaggaacgggccctcttaccaacctntccgttaccgaaggaataacctaacgttacccaaaaggaacctaaccggtaaacgttagttaaccgttacgttaacgaaacgtaaacgtaacgtaaaccgtaaccggtaaccggtaacggtaaacgggtaaccgggtaacccgggtaacccgggtaaacccggtaaacccggtaaaccccgttaaacccgtttaaaccgttttaaacccggtttaaaccgggttaaaacccggttaaaaaccggttaaaaccgttaaaacccgtaaaacccggtaaacccggtaaaccgggttaaaccggggtaaaccggggtaaacccggggtaaaacccggggtaaacccggggtaaaaccccggg

SEQ ID NO: 122375 - DNA, 715 bp, Homo sapiens
  misc_feature: GYAE6OF01DNAQL.52.81.H04.1.454.CMB.1.raw
  modified_base (177)..(177): a, c, t, g, unknown or other
  misc_feature (177)..(177): n is a, c, g, or t
  modified_base (322)..(322): a, c, t, g, unknown or other
  misc_feature (322)..(322): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagcgtgtcgtttctggtgctaatttaaaggngtcagtgtgaggtgcagctgctgcgaggtcgggggagtcgttggtacaggtccggtgggggtcctagacgtactcgtcgtgtgcagtcctctggtattcctacctttcgcgtctagtgacagtgacgtcggtcgggtcccgacgnggtcctaccggaggaacggtggggcgtagggtggtcggttaccgtagtaaggttaattaaggtaggttagggtacggaaagtaactagttacgttaccgctaacggtaccgttccggtaagggaaccgggtcccgtacttaccaccgttactccacgaagaacgaactaaccgtaaccgaaacgtaacctaccgtaactacggttatacccgtagtaacctaaagttacgaaccgttacggccgtaaggaacggaccggaccggtaacggaccgaaccggtacctaccgtttaacttaccggtaacggttaaaaccaaaggtaacctaaccgaaacccgaaacggtacggaacccggtagggaaaccggtacgggaacccgtaaaacccgggg

SEQ ID NO: 122376 - DNA, 720 bp, Homo sapiens
  misc_feature: GYAE6OF01EG5LR.52.81.H04.1.454.CMB.1.raw
  modified_base (177)..(177): a, c, t, g, unknown or other
  misc_feature (177)..(177): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcttttctgtgctatttaaaggtntcagtgtgaggtgcagctgctgcgaggtcgggggagcgttggtacaggccgtcggggggtccctaggacgtactcctccgtgtgtcacgcctcgtggtacttccgtaccgtttcgcgttctagtgactatggacgtcggtccgggtcccgccgtacgggtccctaccggaagggtaacgtcgggggtcctaggggtacggttgggtcctacggtaaggtttaagtttaagtaggggtagggtacggtaagttaccgtaagttaacgttacgacgtacggtacctaccggttacgggaacggccgttccttaccgaccctacgttccctacgaacgtacgtaactaacgttaacccgaaagaaacccgtaaccgtaacgttacgttacgtacgtacgtaactaaacgtacgaaacacgtaccgtaggaacgtaacggaccgaacggacccgaccggaccctaaccgttacgtttacgtaacggttaaacggaaaacgtaataaccgacaactacgaccgaagggaacggaacgaacgaacccgg

SEQ ID NO: 122377 - DNA, 832 bp, Homo sapiens
  misc_feature: GYAE6OF01CV6OH.52.81.H04.1.454.CMB.1.raw
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcaccatggagtttgggctgagcgtgtgttttctaggtcggctaattttaaaggtgtccagtgtgaggtgcagctgcgtgcgaggtcgggggagtcgttgggtacnggccgttgggggtccctggagtctctctgtgcagccctgtaggtnttccncctttccgnttcctaatgacagtgcgtcgttcgggccnccgaggactccgaaggacgttggggcttaggagtcgggtcctaggtaaggttattaacgtagggttcggtagggtaacgtactaaagtttaacgttaccggactaaccggaaccggtttccgtacggggaaacgggtccccgtaccgtttaccacccggtaaacttcccgtacccgaagtaaacggaacccttaaaacgttacccctaaaggaaacccgtaaacctaaccctttaagggttaaactttccccggaaagttaaccgaaaactttaacgtaaacccgtaggaaccccgttaggtaacggaacggttaaccccgggagggaaaccccggaaccccgggtaaccctttaaaccccgtttacggttttaaacccgttaacgggtttaaaaacccggaaacggttaaaaacctttaaaccccaaacgaaaccccgttaaccggggaaccgtttaaacccgggggaaaccggaacccggggttaacccgggtaaaaaaccccccggg

SEQ ID NO: 122378 - DNA, 741 bp, Homo sapiens
  misc_feature: GYAE6OF01EK9W4.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctgcgaggtcggggggagcgttggtacaggccgtggggggtccctggagactctcctgtgcagcctctggtacttctaccgtttcgcgtctatgactagtgagcgtcggggtcccgccgaggcctaccgaggagtggggctgggagtgggtctacgaggttaattaagtaggtggtaggaagtactatattacgacgagtaccgtcggtaggaacgggccctacttaccaaccctatcccgtaccaagaacgtaacctaaacgttacccaaacgtaaccaacctaacgttacgttaacttaccgttacgaacctaaaacgtacgaaaaccgtacggtaccccgtagggaaaccggtacggaaccccgggaaacgggtaacccgaaccccggggtaccccttaaaccccgtttaacgtttttacccggtaaacggttaaaaccgggaaaaacgtaaacgttaaaccccaaccgaaacccgtacggtacccggttaaacggggaaaccgggaaacggggtaaccgtaaaaacccccggg

SEQ ID NO: 122379 - DNA, 522 bp, Homo sapiens
  misc_feature: GYAE6OF01D4TLA.52.81.H04.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (316)..(317): a, c, t, g, unknown or other
  misc_feature (316)..(317): n is a, c, g, or t
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcacatggagtttgggctgagcgtgtcgtttcaggtcggctaatttaaaggntcagtgtgaggtgcagctgctggcagggcgggggagtcttggacncgcggttgggggacctgacgcttcgcctggcncncgctagtcgtctcgtcgttcntctangactntgngcgtcggcncngcngagngtggnngtgtcgtnagtagtatagagtcgtagatcatactcacagtacgtcgaggncgcnctacactactcacanacgacactacacacactactatntacanacaagacgacgacgacgtacgacgacgacgacgacgacgtacctacgttacgttacgtacgtaacgtaaacgaactaacacacgtacgacgacggacgaacggtaacg

SEQ ID NO: 122380 - DNA, 664 bp, Homo sapiens
  misc_feature: GYAE6OF01A000M.52.81.H04.1.454.CMB.1.raw
  modified_base (263)..(263): a, c, t, g, unknown or other
  misc_feature (263)..(263): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaagcagctccaacattggctaataattttgngtcctggtaccagcaactcccaggcacacgcccccaaactcctcatttactgacaatgataaacgccgaccctcaggtataccgtagaaccgtattcctactggctcccgaagttctggcacgtcacgcccacccgtgggacctacgtccgacccggtacctcccgaacgtaccgtacgggggaccgtacgggacccgtaatttaaccgtttaaccgtacgggaccgggtaaaccgtaacggttacggggaacttacggaccgtaaggtcccgttaggtaaacggttacggtaagttaccgggtaccggtaaacggggggtttcgggttacccgggggtaccgggaaacgggggtaacccgtaaagggtccgtttaaccggggtacccggtttaacccggg

SEQ ID NO: 122381 - DNA, 586 bp, Homo sapiens
  misc_feature: GYAE6OF01ET9FH.52.81.H04.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (525)..(525): a, c, t, g, unknown or other
  misc_feature (525)..(525): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttcttggtggtctaattttaaaaggtgtccagtgtgaggtgcagctgctgcgaggtcgggggagcttggtacaggccgtgggggtccctggagactctctgngcagcctntggacttctaccgtttcgcgtctagtcgacatgagcgtgggtcccgccgaggcctccgaggtaagtggggctagggagttcgggtctcggaggttaattaagtaggtgggtagaagtactaagtaagttacgacacgtactcggaggaacgggtccgacttacacctatcctaccgagaactaacgtaacttacccgaaagaaccactacgtgtaactctagacaaatcgaataccgctagacgacggcgacgacncgacctacttatcgtacgaagaataacacgaacacgacgcgtaaggacgaaggagaacccg

SEQ ID NO: 122382 - DNA, 608 bp, Homo sapiens
  misc_feature: GYAE6OF01AVRBO.52.81.H04.1.454.CMB.1.raw
  modified_base (269)..(269): a, c, t, g, unknown or other
  misc_feature (269)..(269): n is a, c, g, or t
  modified_base (314)..(314): a, c, t, g, unknown or other
  misc_feature (314)..(314): n is a, c, g, or t
  modified_base (405)..(405): a, c, t, g, unknown or other
  misc_feature (405)..(405): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (562)..(562): a, c, t, g, unknown or other
  misc_feature (562)..(562): n is a, c, g, or t
  modified_base (573)..(573): a, c, t, g, unknown or other
  misc_feature (573)..(573): n is a, c, g, or t
tcagcgcagtacgacacgaccggtgctcgatttagtagtgtagattcgcgggggagctctgagagaggagccccagccctgggattttcaggttgttttcatttggtgatcaggactgaacagagagaactcaccatggagtttgggctgagcggtgtgtttctaggtggctaatttaaaggtgtcagtgtgaggtgcagctgctgcgagggtcggggggaggctttaggtacaggccggtggggggtccctggagtctcgtccttggngccagccttcgtggtacttcctccgtttcgcctactatgacatgngtcgtcgggccgcaggctaccgaggtagtgggcgtggtaggtggtctgaggttacttaagtggtaggtaggtaatacgattactaccgtanaacgtcgttacggaggaacggggtccccacttccaacctctcctaccgaagaacgtactaagtaccaagaaccacctatgtactcanataacncggaacaccacgagaggacgaccggagtaccgaccgtccctacttagtttcaaggaaccgaaanacgtacccaanacgttacggagtaccgggagaaggcggaaacccgg

SEQ ID NO: 122383 - DNA, 779 bp, Homo sapiens
  misc_feature: GYAE6OF01CMBZI.52.81.H04.1.454.CMB.1.raw
  modified_base (280)..(280): a, c, t, g, unknown or other
  misc_feature (280)..(280): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcagggtcggggggaggcttggtacaggccgtggggggtccctggagacctctccgtgtcgcagtcctcgtggtnttcctacccttttcgcgttctatcgactgtggacggtccgtcggggtcccacggacggctaccgaaggtaagtcggggtctggggaggttgggtactacgtaaggttaatttaaaggtagggtttggggtaaggtaaaagttaactaagttaacgtttaccggacgtaacggtaccgttaccggtacggggaacgggtcccacctttaccgacctaccgttacctacgaacggaacgtaaccttaaacttacccgaaagaaaccctactaacgtagttaactacgtacgtaaccgtaaagtaacgaaacctacggtaacccgtaagggaccgtaaacggggaccccgggaacgggaacccgtaaaccccgggtaccctaacccggttttaacttaaccggtaacggtaaacccggaaaaagtaaaccctaaacccgaaacgttaccgaaccgggtacgtacggggaaacccgggtaaggaaaccccggtaaaccccggg

SEQ ID NO: 122384 - DNA, 866 bp, Homo sapiens
  misc_feature: GYAE6OF01DL2EF.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacatggagttggctgagctggtcttttctgtggctatttaaaggtgtccagtgtgaggtgcagctgctgcgagggtcgggggagcgttggtacacggtccggtcggggggtccctggacgtacctctccgtgtcgcacgtcctctcggtattccctaccgttttcgccttactagtagactaagtggacgtcggttcgggtcccgaccgacggtcctaccggaagggtaacggtgggggtccgtaggggacggttcgggtttaccgtaacggtaaggtttaaagtttaaagggttaagggttaggggtaacggtaaaagttacgtaaagttaacgttaccgacgtacggtaccgttaccgggtacggggaaccggtcccgtaccgttacccgaaccttaccgtaccgttacccgaaagtaaccgtaaacgttaaaccgttaaacccgaaacgtaacccgaaccttaacgttacgtttaacctaacctaaaacgttaaacgtaacgaaaaccgtaccggtacccgtaagggaaaccggaaccccggaaccggtaaccgggaaccccgttaacccgggtaacccctttaaaccgttaacgttttaccggtaaaacccgggttaaaaccggaaaaacgtaaccgttaaaacccgaaaccgtaaaccggtaacccggtaacgggttaacggggaaaccgggtaaacgggtaaacccgaaaccccgggttaaaaccccgggg

SEQ ID NO: 122385 - DNA, 640 bp, Homo sapiens
  misc_feature: GYAE6OF01DMCL6.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctgcaggtcggggggagcttggtacaggccgtggggggtccctgagactctcctgtgcagtcctctggatttccgacccttttcgcgttctatgacatgagtcgtgggtcccgccgaggcctccgaagggtaagtggggtcctgggagtcggggtctacgtaggttattaaagtggttagggtaggtaaagtaactaagtaagtttaccgcgacgtaccgtcggtaggaacgggcccgtcgttacacctatcctcgaagagaaacctaacttacccaaagaacctaaccaccttagtactctacgacaaatacgaacacgccgtagacgacgaccggacggaccgaccggtaccctaacttacgttacgtaggtaaacgaaaagaaacgtaaccaacgtaaccgaggacctaggaaaccgagggaacgaaccccgg

SEQ ID NO: 122386 - DNA, 716 bp, Homo sapiens
  misc_feature: GYAE6OF01D6CNH.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggcttatttaaaaggtgtccagtgtgaggtgcagctgctgcgagggtcggggggagtcgttggtacaggccgtggggggtccctgacgtactctccgtgtgcagccctcgtggtacttccaccgtttcgccgttctatcgacatcggacgtcgtcggggtcccgccgacggtcctacggaggaaggtcggggctgggaggttcgggtctacggtaaggttaattaagtaggtgggtaggtaaagtactaagttaacgtaaccgacgaacgtaccgtaccggtagggaaccggggtacctaccgttaccacccgtacgttcccgtaccgaaggtaaccgaactaacgttaacccaaacggaaaccctaacctaaccgttagtaaccttccgtaagaacctaaagtcgaaaccgtacgaccgtggaaacggccgtaaccgggacggaaccacccgggtaccctaccgttagttttaccgaacggtaaacgaaacgtaaaccaccgaacaccgaaggtaccgtaagggaaaccggtaggaaccggtaaaacccgg

SEQ ID NO: 122387 - DNA, 651 bp, Homo sapiens
  misc_feature: GYAE6OF01ASZB2.52.81.H04.1.454.CMB.1.raw
  modified_base (506)..(506): a, c, t, g, unknown or other
  misc_feature (506)..(506): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggagcttggtacaggccgtggggggtccctgagactctcctgtgcagccctcgtggtattcctacctttcgcgttctatgactatggacgcgtcgggtcccgccgaggctaccgaggtaagtggggctgggaggtgggtctcgtaggttatttaagtaggttgggtaggtaagtacgtattaagttacgacgaacgtaccgtccggttaggaacggggcccgtaccttccaccctactcctacccaagtaacgacctaaacttaccaacgaaccacgacttagtactcgtanacaaatcgaactacgccgtagacggacgtaccggacggacccgacggtaccctaccttattaccgtacggtaaacgaaacgtaactaacccgaaaccacgtacgggtaccgtaagggaaccggtaaggggacgaaaacccccggg

SEQ ID NO: 122388 - DNA, 794 bp, Homo sapiens
  misc_feature: GYAE6OF01B7436.52.81.H04.1.454.CMB.1.raw
tcagcgcagtacgacacgaccggtgctcgatttagtagtgtagattcgcgggggagctctgcttcagctgtgagcgcagaaggcaggactcggacaatcttcatcatgacctgctcccctctcctcctcacccttctcattcactgcacagggtcctgggcccagtctgtgttgacgcacgcccgccctcagtgtctgccggccccaggacaggaacgtcaccatctcctgctcgtggaagcacgcctaccaaacgtattcggactaaatttaacgttttcggtcgttacccgtaggtaacccaggtacccctaaaccgtcccgaacggtccaacccgtacccgacccccctaaaacttcccttaactaacgttttaacacggtaactaaacgtacgtaaacgtaaccggtcccgtaacccgtacggaacgggtaactaaccccgtacggtaacccgttaacgttccgtaccgttaccggccttaacccggtaacggtccgtacggaaccctaccggttaccaaccggtaccccgtaccccggttacgggacccaaccgttacccgaacccgggtaacctaccggacggtaccgggtacgggggaacccgacgggtacccgtaacgttaccgttacggtacggaaccggtaacgtacggttagggacgttacggccggtaaggtcccgtaagggtacggtacggtacgtcgggtaccggttcgggggttcgggtaccggggaaccgggtaacggggaacctacggtacccgggtacggtaccccggttaccggg

SEQ ID NO: 122389 - DNA, 651 bp, Homo sapiens
  misc_feature: GYAE6OF01BK051.52.81.H04.1.454.CMB.1.raw
tcagcgcagtacgacacgaccggtgctcgatttagtagtgtagattcgcggggcacgaccggtgctcgatttagtagtgtagattcgcgggggggaggcttggtacagcctggggggtccctgagactctcctgtgcagcctctggattcaccttttcgcgtctatgacatgagctgggtccgccaggctccaggaatggggctggagtgggtctcaggtattaagtagtggtggaagtacattattacgcagactccgtgaagggccacttcaccatcctccagtacgactaacttccaaagaacacactagtactctgaccaaagtgaacagcctgagacgccgaggacacggcctacgttatttcgaggtaacgaaagtaactacaactacagcgtaggaaccggaggacgaccgaaacggccgtaacttacttacgttagtaccgtacggtcgggaccgaacgggtaacccgtcggtaccacccgttcctcccgtacacgcccttaccgaaccgaacgggaccctacgttcccggttcccttccccgtcggacccctaccccgtcccgtaccgaaacggtaccgaccgtaccgtcggtacggggaccacggacggcccggtccgtcggacctcgtccgtcggtaccg

SEQ ID NO: 122390 - DNA, 799 bp, Homo sapiens
  misc_feature: GYAE6OF01A6V4I.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttcttgtggcttaattttaaaaggtgtccagtgtgaggtgcagctgctgcgagggtcggggggagtcgttggtacgaggccggtcggggggtccctggacgactctcctgtcgcacgcctcgtggtacttcctaccgtttcgcgtcttatagactagtggagtccgttcggggtcccgccgacggtcctaccggaagggtaacggtcggggcgtagggtacggttggggtctacggtaaggttaagtttaaaggtaggttagggtaggtaacggttaaactaagttaacgttaccggacgtaacgtaccgttaaccgggtacgggtaacccgggcccgttactacccgtacccgttaacgtaccccgttaccgaaaggtaccgtaaaacttaaccttaacccgaaacgtaaaacctccgtaaacgttacgtttacgtacctaaggaaacaaacttacgggaaaccaccgggtaccctaggggaaccgaacggacccggggtaacgtaacccggaccgaaccccgtttaactttacccggtttacgtaaaccggaaaaccggttaaaacaaaccgtacccgaaaccgaaccggtaacggccgaaacgggggtaaccgaaacgggaaacccgtaaaccccgg

SEQ ID NO: 122391 - DNA, 718 bp, Homo sapiens
  misc_feature: GYAE6OF01ACV87.52.81.H04.1.454.CMB.1.raw
  modified_base (227)..(227): a, c, t, g, unknown or other
  misc_feature (227)..(227): n is a, c, g, or t
tcagcgcagtacgacacgaccggtgctcgatttagtagtgtagattcgcggggagctctgagagaggagcccagtcccgttgggattttcaggttgttttcatttgggtgatcaggactgaacagagagaactcaccatggagtttgggcttgagcgtggtcttttcgtgtggtctagttttaaaggtgtccgagtgtgaggtgcagcgtgctgcgaggtcgggggngacttggtacaggccgtgggggtccctggacgactcgtccgtgtagtcgacgtcccgtcgttacgggtacttccgtaaccttttccggcgtacgttagtacggactactcggacggtccgttcgggtccgaccgaggtcccgtaccgaaggaacggtcgggtccgtggggtacggtcgggtctacgtaggttaactttaacgtaggttcggtaggaagtactaagttactacgccgagtaccgtcccggtagaaccgggccctaccgttacaccctagtccgtaccgaagtacgaacctaacgttaccgaaacgaaccacgtacgtacggtattcgtacgaacgaagttcgaaacgtcgtacgtcgaaagccgggtaaccggacggtaaccgaccgggcctaaccggttacttaccggtaaggttaaacccgaaagtaccgtaaacccgactaaaccgcgtacggaagggacgtaagggaccgaaacccgg

SEQ ID NO: 122392 - DNA, 599 bp, Homo sapiens
  misc_feature: GYAE6OF01D9TFM.52.81.H04.1.454.CMB.1.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (465)..(465): a, c, t, g, unknown or other
  misc_feature (465)..(465): n is a, c, g, or t
  modified_base (490)..(490): a, c, t, g, unknown or other
  misc_feature (490)..(490): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctaggtggctaatttaaaggtgtcagtgtgaggtgcagctgctgcgaggtcgggggagcttggtacnggccgttggggggtccctgacgactctctgtgcagtcctctggacttcacctttcgcgtatagtcanagttgagcgtcgggtccgccaggccaccgaggaagtgggctgggaggttgggtacctagaggttaattaaggtagtgggttagaagtactatacgttacgcaagtcctaccggtggaacgggtcctccgttacacctaactcgtaccaggacgaaactcttaacccgaaanaacctactacgtagtactcgacaanaataacgaacgacgacgtagacggacgacggacggaccgaccgtacctaccttacgttacgtacgtaagaaacgtaacaacaacaacacgacgacgacggagacgaccg

SEQ ID NO: 122393 - DNA, 657 bp, Homo sapiens
  misc_feature: GYAE6OF01EKOQT.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcttttctgtggctaatttaaaggtgtcagtgtgaggtgcagctgctgcaggtcgggggagcttggtacaggccgtggggggtccctgagactctcctgtgcagcctcgtggtattccacctttcgcgttctatgacatgagtcgtgggtccgcgaggcctacgagggtatggggctgggagtgggtctcgaggttattaagtggtggtaggaagtactagtattacgactagtaccgtcggtaggaacgggtcccgtacttaccaaccgtactcctaccgaagaacgtaactaagtttaacccgaaagtaaacccgtaacaaccgtttaggtaacttccgtaacggtaacctaaagtacgaaacgacgtaccgtaggaacgacggaccggtaacggaacccgtaccggtaccctaccgttaacgtttccgtaacgttaaacggaaaagtactaaaccgaacctaacgacggtacgtacgggaacggtaggaacgaaacccgg

SEQ ID NO: 122394 - DNA, 597 bp, Homo sapiens
  misc_feature: GYAE6OF01DSCEO.52.81.H04.1.454.CMB.1.raw
  modified_base (180)..(180): a, c, t, g, unknown or other
  misc_feature (180)..(180): n is a, c, g, or t
  modified_base (266)..(266): a, c, t, g, unknown or other
  misc_feature (266)..(266): n is a, c, g, or t
  modified_base (564)..(564): a, c, t, g, unknown or other
  misc_feature (564)..(564): n is a, c, g, or t
tcagcgcagtacgacacgaccggtgctcgatttagtagtgtagattcgcgggcacgaccggtgctcgatttagtagtgtagattcgcgggggggaggcttggtacagcctgggggtccctgagactctcctgtgcagcctctggattcacctttcgcgtctatgacatgagctgggtccnccaggctccaggaatggggctggagtggctcaggtattaagtagtggtggaagtacatattacgcaagactccgtagaacgggccncttcaaccatctccagagaacaattaccaaagaacacactgtatctagacaaatgaacagcctagagacgcgaaggacacggccactatttcagtaacgaaataataacacacgagcgtaggaacgacggagacccgtaaacggcgtaacttacttctttacgactacgtaggggaccacgggaaccctggtaccaccgtcctccgtcacgcctccaaccgaacgggccctagtccgtccttccccgtcgcccacccgtccctaccaacgacgccgtacctcggtcggggccaaccgnggcccggacccgtgggcctcgccgtggtaaccg

SEQ ID NO: 122395 - DNA, 549 bp, Homo sapiens
  misc_feature: GYAE6OF01EZH9E.52.81.H04.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagcgcagtacgacacgaccggtgctcgattttagtagtgtagattcgcgggggtaggctctgagagaggagcccagccctgggattttcaggttgttttcatttggtgatcaggactgaacagagagaactcaccatggagtttgggctgagcgtgtcgtttctaggtcgctatttaaaaggtgtcagtgtgaggtgcagctgctgcggagtcggggngcttggacgcgcgtgggggtccctgagtctcgtcctgtcgcngcctctgtcttctccgtttcgcttctatcgatagtgcgtcgtcggtaccgccgaggtctcgaggtagtgggcgtggagtcggtctacgagtatataggtggtagaatactaatattacgntacgtactcgtaggaacgggcctattcccaactntacctacgagtaanactaagtaccaagacactactgtctactagacaactgaacacgcgtagaacgacgtcgaacgtcacgctactattcgaataagaaanctaacganactcgtacgagtcgagccgaaccg

SEQ ID NO: 122396 - DNA, 781 bp, Homo sapiens
  misc_feature: GYAE6OF01ACVH1.52.81.H04.1.454.CMB.1.raw
tcagcgcagtacgacacgaccggtgctcgatttagtagtgtagattcgcggggagctctgagagaggagcccagccctgggattttcaggtgtttcatttggtgatcaggactgaacagagagaactcaccatggagttggctgagctggtcttttctgtggtctattttaaaaggtgtccagtgtgaggtgcagctgctgcgaggtcgggggagtcgttggtacaggtccgtggggggtccctggacgtacctctccgtgtcgtcacgcctgtggtacttcctaccgtttcgcgtctatcgactagtcgacgtcgttcgggtcccgccgtacggcctaccggaagggtaacggtcgggggctaggggtacggttggggttaccctaggtaaggtttaattaaggttaggggttggggttaacggtaaagttacgtaagttaacgttacggacgtaacggtaaccgttacccgggtagggaaccggggtcccgttaccttaccgtaacccgtacgttcccgtaaccggaacgtaaaccggtaacctaaaccgtttaacccgaaaacgtaaacccgtaaccgtaccgtttaagttaaccgtacgttacgaaaccctaaaacgttaccggaaaccgtacggtacccgtaagggaccgaacggacccgggtaacggaacccgtacccggtaccttaaccttacgttaccggtaacggtaaacgtaaaaggactaacccgaacgtacgtacggtacgtacgggaacgtaggaccgtaaacccggg

SEQ ID NO: 122397 - DNA, 768 bp, Homo sapiens
  misc_feature: GYAE6OF01D0VRE.52.81.H04.1.454.CMB.1.raw
  modified_base (348)..(348): a, c, t, g, unknown or other
  misc_feature (348)..(348): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcaccttttcgcgtctatgacatgagctgggtccgccaggcctccgaggaagtggggctgggagtcgggtctacgaggtaattaagtaggtggtaggaagtacattattacgcacgactccggtaggaacgggccgtcttcaccatcctaccgagagactaacttaccaaagaaccactactgtatcagtacaaatgaacngcctagacgacggaccggaaggaccgaaccggtaccctaaccgtttagtttacgtacggtaaaacgaaaagtaaactaaccgaacaactacggcggtaggaacgaggacgaaccgaaacgggcctaacttacgttcgtttacgaccttacggtacggggccgtaacgggacccgttggtaccctaccggttcctacccgtcgaccgtccctacccgaacccggaaccgggtcccctaacggttccccggtttaccccttccccccggtacggaccccgttaccccctccgtaacccgaacggtacccggacccgttaaacccggtcgggggttcggggaacccctaaccgggacccggggtaccccgggtaccccggtcggggtccccttccgggtcccggttacggggtaaaccccggg

SEQ ID NO: 122398 - DNA, 617 bp, Homo sapiens
  misc_feature: GYAE6OF01AX98B.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcgaggtcgggggaggcttggtacagccgtgggggtccctgacgactctccgtgtgcacgcctcgtggtacgttctacctttcgcgtctagtcgacatgagcgtcgggtcccgtccgaggcctaccgagggaagtcggggcgtgggaggtgggtctcgaggttaattaagtaggtggtaggaagtacattatacgcgagtaccgtcgtaggaacgggtccctcgtacacctatccgtaccagacgactaaattacccaaagaaccaacgtacctagtacttcgtagactaaatcgtaacacgtacgtaggacgaccgaccggaacggaccgaccggcctacctacgtttacgagtaacgaaaacgtactaaccgaacgaacgtacgacgtaaggacgaaggacgtaaacccggg

SEQ ID NO: 122399 - DNA, 651 bp, Homo sapiens
  misc_feature: GYAE6OF01BPRD8.52.81.H04.1.454.CMB.1.raw
  modified_base (228)..(228): a, c, t, g, unknown or other
  misc_feature (228)..(228): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcttttctgtggctaattttaaaaggtgtccagtgtgaggtgcagctgctgcgaggtcgggggagcttggtacnggccgtgggggtccctgagctctctgtgcngcctntggacttcacctttcgcgtctatgactagtgagtcgtcggggtcccnccgaggcctaccgagggaacgtggggctgggaggttcggtctcgtaggttaattaagtaggtaggtacgaagtacaagttagtacgacaagtaccgtcgtaggaacgggtccctacgttccaaccgtatccgtaccgaaggtaacgaacgtaaaccttaaccgaaagtaaaccctaactaccgttacgtaactccgtaacgaacctaaaagtaccgaaacgaacgtcccgtaagaaggtaccggaccggaacggaaccgaccggtaccctacgttaatttccgaacggtaacaaaggtactaacgaacacgacgtacgtagggacctaagggcgaaacccg

SEQ ID NO: 122400 - DNA, 768 bp, Homo sapiens
  misc_feature: GYAE6OF01CX3MJ.52.81.H04.1.454.CMB.1.raw
  modified_base (645)..(645): a, c, t, g, unknown or other
  misc_feature (645)..(645): n is a, c, g, or t
tcagcgcagtacgacacgaccggtgctcgatttagtagtgtagattcgcgggggagctctgagagaggagcccagccctgggatttcaggtgttttcatttggtgatcaggactgaacagagagaactcacatggtagtttgggctgagctggtctttttcttgtggtcttaagttttaaaaggtgtccagtgtgaggtgcagctgctgcgagggtcgggggggagtcttggggtacaggtccggttcgggggggtccctggacggaccttcctccgtggtgcgacgtcctcgtaggactttccgtacctttcggcgttcttaatgtaccagtggacggtccgttcggggtcccgccgtacggcccgtaccgaaggggtaaggtcgggggtacgtacgggtacgggttacgggttccgtaggtaaaggggtttaatttaaaagggttaggggttaaggggttaagggtaaaacgttaaacgtttaaacggttaacgtttaacccggaacgtaaacgggtaccccggttacgggttaacgggaaaccggggtcccggtaccttaccgtaaccctacgttacctaccgtaagaaccgtaactaaacgttacccaaaaggaacctaacgtaactacgttactcgtaanaccgtaaagtacgtaaacacggtacgacgtaggaacgaccggacgaccgaccgtacctaccttatacgtaacgtaacgaaacgtaacacctaacagtacgacgtaggaacgagaacgaacccg

SEQ ID NO: 122401 - DNA, 771 bp, Homo sapiens
  misc_feature: GYAE6OF01EPIFM.52.81.H04.1.454.CMB.1.raw
tcagcgcagtacgacacgaccggtgctcgatttagtagtgtagattcgcggggagctctgagagaggagcccagccctgggattttcaggtgttttcattggtgatcaggactgaacagagagaactcaccatggagtttgggctgagctggctttttctgtggctattttaaaaggtgtccagtgtgaggtgcagctgctgcagtcgggggagcttggtacagcctggggggtccctgagactctctgtgcagcctcgtggtacttcctacctttcgcgtctatcgacatgagcgtgggtccgccgaggtctccgaggagtggggctgggagtgggtctcgaggtaattaagtaggtgggtaggaagtactaagtacttacgacgaacggaccgttccggtaggaaacggggtcccgtactttaccgaaccctacttcccgtaccgaaggtaacgaaccgttaaactttaccccgaaaaggtaaaccctaaccgtaaacgtttacggtaaactttccgtacggtacctaaaaagttaccggaaaaccgtaacggtaccccgttaagggaaacgggtaccgggtaacccgggaaacgggggtaaacccaacccggggtacccctaaacccgtttaaacgtttttacccggtaaacgggtttaaaaacccgggaaaaaggttaaaacctaaacccgaaaccgtaaaccggtacgggtaaccccgttaagggggaaaccccgggtaaaggggaacccggtaaaaacccccggg

SEQ ID NO: 122402 - DNA, 559 bp, Homo sapiens
  misc_feature: GYAE6OF01BA4V9.52.81.H04.1.454.CMB.1.raw
  modified_base (265)..(265): a, c, t, g, unknown or other
  misc_feature (265)..(265): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccncttcaccatctccagagacaattccaagaacacactgtatctgcaaatgaacagcctgagagccgaggacacggccacctattctgtaacgaaagaatacacacagctggacgaggagaccgaaacggcgactacttctttgactacgtggggaccgacgggaaccctggtccaccgtctcctcacgccctccaccgaacggcccacgtccggtccttcccctcggccaccctcctccacgacgccgacctcgtcggggccacgacgccggcccgtgggctcgcgttggtaccg

SEQ ID NO: 122403 - DNA, 612 bp, Homo sapiens
  misc_feature: GYAE6OF01A1W5A.52.81.H04.1.454.CMB.1.raw
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
  modified_base (355)..(355): a, c, t, g, unknown or other
  misc_feature (355)..(355): n is a, c, g, or t
tcagcgcagtacgacacgaccggtgctcgatttagtagtgtagattcgcgggcacgaccggtgctcgatttagtagtgtagattcgcggggggaggcttggtacagcctgggggtccctgagactctcctgtgcagcctctggattcacctttcgcgtctatgacatgagctgggtccgccaggctccgaggaatggggctgggagtgggctacgaggtattaagtgtggtggaatacatnttacgcagactcgtgaaggccncttcaccatctccagagacaattccaagaacacactgtatctgacaaatgaacagcctgagtagccgaggacgaccggccaccttagtttcngtaacgaaagaatacacacagctggacgagagccaacgcgactacttcttgactacgcgggactacggaccctggtacacccgtctccctcgacgcccttaccgaacccgaacgggccccgaagtccggttcccttacccccgtacgggtaccctaccccgtcccgtacccgtaaacgaaccgtccgtaaccccgtcggtccgggggtccaccggtacggacccgcccggttcgggcgcccgtccgtcggtaaccgg

SEQ ID NO: 122404 - DNA, 870 bp, Homo sapiens
  misc_feature: GYAE6OF01BHMUQ.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggcttttctgtggctatttaaaaggtgtccagtgtgaggtgcagctgctgcaggtcgggggagcttggtacagccgtgggggtccctgagactctcctgtgcagcctcgtggacttcctaccgtttcgcgttctatgacatgagcgtggtcccgccgaggctccgaggaacgtggggcctgggagtcgggtctacgaggtattaagtagtggtaggaagtacattaacttacgacgtacgacgttccgggtaaggtaacggggtcccgtaccgtttaccgaacccgtacttaccgtacccgtaaggtaaaccgtaaccgtaaacgtttaaccccgaaaacgtaaaccgtaaaccccgtaaaccgtttacggttaactttacccgtttaacggaaacccgttaaaaaacgtttaccggaaaaacccgtaaccggtaccccggttaacgggtaaaccggggtaacccggtaaccccggggggtaaaacggggaaacccccgggttaaaccccggggaacccccgtttaaaaccccggtttaacccggttttttaaaccccgggttaaacgggtttaaaaaccccgggttaaaaaaacggttaaaccccgttttaaaacccaaaccccgggtaaaaccgtaaacccggggttaaccgggttaaaccccggggtaaaccggggttaaacccggggtaaaacccgggtaaaaacccccccgggg

SEQ ID NO: 122405 - DNA, 676 bp, Homo sapiens
  misc_feature: GYAE6OF01BFUOX.52.81.H04.1.454.CMB.1.raw
tcagcgcagtacgacacgaccggtgctcgatttagtagtgtagattcgcggggagctctgagagaggagcccagccctgggattttcaggtgtttcatttggtgatcaggactgaacagagagaactcaccatggagtttgggctgagctggctttttcttgtggctattttaaaaggtgtccagtgtgaggtgcagctgctgcgaggtcggggggaggcgttggtacaggccgtgggggggtccctggagacctctcctgtcgcagtcctcgtggaacttcctacccgtttcgccgtctatcggactagtgagtccgtgggtccgccacggcctccgaggtaacgtggggctagggagtgggtctcgtaggtattaagtagtggtaggaagtactatatacgacacgtacgtcgtaggaacgggcctcttccacctatccttaccgaagtacgaacctaagttacccaaagaaccaccagttacgtactctaggaacctaaaagtcgaaacacggtacctaggaacgtacggacccgaaggtacccgacggacccctaacgtttacgtttaccgtaacgggttaaacccggaaaagttaacccgtaaaccgaaacgtaaccggaaccggttaccggaacgggaaccgggtaaagggaccggtaaaaacccccggg

SEQ ID NO: 122406 - DNA, 631 bp, Homo sapiens
  misc_feature: GYAE6OF01EWUX8.52.81.H04.1.454.CMB.1.raw
  modified_base (182)..(182): a, c, t, g, unknown or other
  misc_feature (182)..(182): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgtttctaggtcgctaagtttaaaaggngtcagtgtgaggtgcagctgctgcgaggtcgggggagcttggacagtccgtgggggtcctggactctcgtcctgtgcacgcctctggacttcgtacctttcgcgtctatgacatgngccgttggaccncgagtcncgaggtagnggtgtaggngtcggtactaggtagttaagttaacgtaggtacggtagaacgtataagtacgtacgacgacgtacgtcggaagtacggcgtacgtacctactacactacgaacgtaacaacgtaactaaccgaaacgaaccgtaacgtacgtagtacgtcgtaacgaacgtaaacgaacgtaacgaacgacgtacgaacgacggaaccggaacggacgaccgtaccgtaccttacgttacgttaacgtaagaaacgtaaactaacgtaacgaacgacgacgtaacggaacggtaacgaacgaaccg

SEQ ID NO: 122407 - DNA, 563 bp, Homo sapiens
  misc_feature: GYAE6OF01BDROB.52.81.H04.1.454.CMB.1.raw
  modified_base (354)..(354): a, c, t, g, unknown or other
  misc_feature (354)..(354): n is a, c, g, or t
  modified_base (549)..(549): a, c, t, g, unknown or other
  misc_feature (549)..(549): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaacgggccgcttcaccatcctccagagacaattccaagaacacactgtatctgcaaaatgaacagcctgagagccgaggacacggccacctatttcngtaacgaaagaactacacacagctggacgaggagccaaacggcactacttcttgactactggggccacgggaccctggtccaccgtctcctcacgccctccaacccaacgggccccacgtccggtccttcccccgtcggcccaccctccctccaagacgccaccctcgcggggcaccgacgccggccctgggccnggcccgtggtaccg

SEQ ID NO: 122408 - DNA, 661 bp, Homo sapiens
  misc_feature: GYAE6OF01C41ZI.52.81.H04.1.454.CMB.1.raw
  modified_base (181)..(181): a, c, t, g, unknown or other
  misc_feature (181)..(181): n is a, c, g, or t
  modified_base (311)..(311): a, c, t, g, unknown or other
  misc_feature (311)..(311): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcttttcttgtggctattttaaaaggngtccagtgtgaggtgcagctgctgcagtcggggggagcttggtacagccgtggggggtccctgagactctcctggtgcagccctctggattccacctttcgcgtctatgactatgagccgtggggtcccnccgaggctccgaggaagtggggctgggagtgggtctcgaggttattaagtgtaggtaggtaagtacatagttacgcgaagacgttccggtaggaacggggccctcttacccgaacctactccgtacccaaggtaacgaacctaaacttacccgaaacgaaaccacctaactggttaacttctaggaaccctaaagtacgaaaccgacggccctagggacgtaaccggaccggaacgggtaccgaacccgggtacccaccctttagtttacccgtacggtaaaaccggaaaagtaaacctaaccaaccgactaacgggacctggggaaaccgaagggaccgaaaccccggg

SEQ ID NO: 122409 - DNA, 569 bp, Homo sapiens
  misc_feature: GYAE6OF01BL2U3.52.81.H04.1.454.CMB.1.raw
  modified_base (382)..(382): a, c, t, g, unknown or other
  misc_feature (382)..(382): n is a, c, g, or t
  modified_base (560)..(560): a, c, t, g, unknown or other
  misc_feature (560)..(560): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcgggggagcttggtacagccgtggggggtccctgagactctcctgtgcagcctcgtggacttccacctttcgcgtctatcgacatgagcgtgggtccgccgaggcctccgaggaagtggggctgggaggtgggtctcgaggtataagtagtgggtagaagtacattagtacgnagactcggtagaacggtccgacttcacctatcctccgaagaacgaactaacttaccaagtaacacacgttagtactctagacaaagtcgaacacgtccgtagagacgaccggaggaccaccggacctacgttattcgagtaacgaaagaactacgaacacgagcgtaggacgaacggngaaacccgg

SEQ ID NO: 122410 - DNA, 765 bp, Homo sapiens
  misc_feature: GYAE6OF01B5D5D.52.81.H04.1.454.CMB.1.raw
  modified_base (316)..(316): a, c, t, g, unknown or other
  misc_feature (316)..(316): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcaccatggagtttggctgagcgtgtcgtttctaggtcgctaatttaaaggtgtcagtgtgaggtgcagctgcgtgcgacggtcgggggagtcgttggtacgcggtccggtcgggggtcccagacgtactccgtccgtgtcgcgcgtccttcgtaggtacttcctaccgtttgcgtctagtcgatagngcgccggttcggccgaccgcgtccgtacggaggtaacggtcgggcgtagggtggtacggtctaggtaagttagttaagagggttaggacggttaaatactagttaacgttccgacgtaacggtaccgttcccgggaagggtaaccggtccgttacctcccgtaaaccgtcgttacctaccgaaacgaacgtaacctaacttaaccgaaacgaactaacgtacgttagtacctaacgttaccaaagttaacgacgtaaccgtacggccgtaaacggtagggacccgaacgggtaccggtaaacccgtacccgggtacccctttaaacgttacgggtttttaaacccgaacgggttaaaaacccggaaaactaaaccgtaaccccgtaaacgtaaccggaaccggtacggtaaaccgggaaccgggaaaagccccccgggtaaaaacccgg

SEQ ID NO: 122411 - DNA, 768 bp, Homo sapiens
  misc_feature: GYAE6OF01C0KB0.52.81.H04.1.454.CMB.1.raw
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacaggtcctgggcccagtctgtgttgacgcagccgccctcagtgtctgcggccccaggacagaagtcaccatctcctgctctggaagcagctaccaacattcggactaaattaaattttgtcgttaccctagggttaaccaggacctaaacctccccgaaggccaaccgaaccggaccccccctaaaatccccttactaaacttttaactacgaaacctaaagtacggaaacttaaacggcccggtaaacccccttacggaacggggtaaacttaaaccccgtcggaaacccggtaactttccgttacgtcggtacctacccgaaagttccgtacggacctacggtaccgaacgacccaaccccgtggggactaaccgtccgaacccgggtacctcccgaaggacgtacggggaccgaacgggaccgtaagtttaacgtacgtacggaaccggtaacacgttaagggaacttacggacgtaaccggaccgttaggaacgttacggacggtttaccggaccgggttaacgggggttacgggtttacccgggggacggggtaaaacccggggaaacccgtaaacgggtccggttaaacggtaacccccgggtttaaccccggg

SEQ ID NO: 122412 - DNA, 579 bp, Homo sapiens
  misc_feature: GYAE6OF01AXF6I.52.81.H04.1.454.CMB.1.raw
  modified_base (307)..(307): a, c, t, g, unknown or other
  misc_feature (307)..(307): n is a, c, g, or t
tcagcgcagtacgacacgaccggtgctcgatttagtagtgtagattcgcggggagctctgatagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcaggtcgggggagcttggtacagccgtggggggtccctgagactctcctgtgcagcctctggattcacctttcgcgtctatgacatcgagcgtgggtcccncaggctccgaggactggggctgggagtgggtctcgaggtaacttaagtaggtggtaggaagtacatattacgcagtactcgtgaacggccgtacttcacctatcctaccgagacgacaattaccaagaacacgactggtactcgtgacaagtcgaacacgcctagacggtacgaccggaggaaccacggaccctaacccttagtttccgtacgtaaaccgaaaggactaaccaactaacgacgtcgaggtaccggaaggaccgtaaacccgg

SEQ ID NO: 122413 - DNA, 795 bp, Homo sapiens
  misc_feature: GYAE6OF01AKXH5.52.81.H04.1.454.CMB.1.raw
tcagcgcagtacgacacgaccggtgctcgatttagtagtgtagattcgcgggcacgaccggtgctcgatttagtagtgtagattcggcggggggaggcgttggtacagccgtggggggtccctggagactctcctgtgcacgcctctggattcacctttcgcgtctatgacatgagcgtgggtccgcaggctccgaggaagtggggctgggagtgggtctcgaggtattaagtagtggtggaagtacatagttacgcagaccttccggtagaacggggcccgtcttccgacctagtcctaccgagacgacaacgttccaaagaaccaacaactagtactctacgacaaatgaaccgagtcctaggacgacggcccgaagggaccgtaccgggaccctaaccgttacgtttaccgtaacggtaaacggaaaactaaacgtaaccaacctaacgacgtactacgggaaacggtacgggaacgacccgtaaacgggaccgtaacttaccgttacgttacgtaaccgtaaccggtacggggtaccgtaaccgggaacccgttccgggtaccctaccgtacccgtaccctcccgtacgtaccccttacccgaacccgaaccggggccccctaacggttcccgttaccccgttccccccgtacgggtaccccaccccgttaccctaaccctaaccggtacccggaccctaaccccgggttccggtaccgggggtccccaacggacccggtaccccgggtcccgtaccgggtaccgtcccgggtacccgtcgggtaacccgg

SEQ ID NO: 122414 - DNA, 703 bp, Homo sapiens
  misc_feature: GYAE6OF01BV7DO.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggtctaattttaaaaggtgtccagtgtgaggtgcagctgctgcgaggtcggggggagtcgttggtacaggccggttcggggggtccctgacgactctcctgtgccagcctcgtggtacttcctacctttcgccgttctatagacagtgagcgtcgggtccgcgacggctaccgagggtagtggggctgggtaggtcgggtactacgtaaggttaattaagtaggtagggtacggaaagttactaagttacgttaccggactaacggtacgtccgggtaggaaccggggcccgtccttaccaccctacgtcctacccgagaacgtaactaacttacccgaaacgtaaccaaccgtacgtagtactccgtagacctaagtacgaaacgacgtaccgtacgaaggtaccggaccggacggaacccgacccggtaccctaaaccgttacgtttaccgtaacggttaaacgaaaacgtaacgtaaccaaaccgtaaccgtacggtaccgtaacgggaccggaacggtaaccggaaaccccggg

SEQ ID NO: 122415 - DNA, 580 bp, Homo sapiens
  misc_feature: GYAE6OF01E3513.52.81.H04.1.454.CMB.1.raw
  modified_base (564)..(564): a, c, t, g, unknown or other
  misc_feature (564)..(564): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcgaggtattaatagtggtggaagtacatattacgcagactccgtgaagggccgcttcaccatctccagagacaattccaagacacactgtatctgacaaatgaacagcctagagagccgaggacacggccaccttattctgtaacgaaagaactacacacagctaggacgaggacgacccgaaacggccgtaacttacttctttgaccttacgtcggggaccgacgggaaccctggtccaccgtcctcctcacgccctccaccgaacgggcccacgtccggtcccttcccctcggccacccctctacccaacgacgccgacctcggcggggcaccgcggccgcccgtggcncggtccgtcggtaccg

SEQ ID NO: 122416 - DNA, 750 bp, Homo sapiens
  misc_feature: GYAE6OF01EO62V.52.81.H04.1.454.CMB.1.raw
  modified_base (187)..(187): a, c, t, g, unknown or other
  misc_feature (187)..(187): n is a, c, g, or t
  modified_base (204)..(204): a, c, t, g, unknown or other
  misc_feature (204)..(204): n is a, c, g, or t
  modified_base (605)..(605): a, c, t, g, unknown or other
  misc_feature (605)..(605): n is a, c, g, or t
  modified_base (701)..(701): a, c, t, g, unknown or other
  misc_feature (701)..(701): n is a, c, g, or t
tcagcgcagtacgacacgaccggtgctcgatttagtagtgtagattcgcggggagctctgagagaggagcccagccctgggatttttcaggttgttttcatttggtgatcaggactgaacagagagaactcaccagtggtagtttggctgagcgtgttcttttcgtgtcgtacttaagtttaaaggngtcgtagtgtgacggtncagtctgcgtggcggtaggggtcgggggtacgtcgttacggacgcgggtcccgggttcgggggttccctaggaacgtccgttccgttccggttaggtcgaccgtcggtcccttcggtacgtaaccgtttcccttaccggtttccgtacgtttaccgtaagtacgactaggtcgcggtccggtccgggacccgacgacggttaccgtaccggtaagggtacggtcgggcggttaggtacggtcggtactaacggtaagtttaagttaacgtagggtggttaaagaacgttactaagtcgtacgacgtaacggttccgtacggaggtaccggcccttactaacaccgtacttacgaacgaagtaactaacgtaactaaccgaaactactacgtaatcgttacncgaataacaagtaccgaagccacggtaaacggcgacggaccgaagcccgtaacctacctttaacttaagtacgaaaacggtaaacgaactaaaccncgtaacggaacgtcgacgggtaaacgaagaacccggacgtaaaacccgg

SEQ ID NO: 122417 - DNA, 930 bp, Homo sapiens
  misc_feature: GYAE6OF01ATN66.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgctgcgaggtcggggggagcgttgggtacaggccggttgggggggtacccctggagtacctcgtcccttggtcgccgacgcccttcgtcgggtactttaccgttacccgttttccggccgtttacgttaacgttacgggaaccttaagttcgggtaacgggttccgggttccgggggttccccgacccggtacgggtacccgttaacccggtaaagggggtaacgggttcgggggggtaccgtggggggtaacgggtttcgggggttacccgtacggttaaagggtttaaagtttaaaacgggttaaggggtttaagggggttaaggggttaaaacggtttaacccgtaaagtttaacggttaaacccggtacgtaaacgggtaaccggtttcccgggtaagggtaaacccggggtccccgttaccgttacccgaacccttacgttaccccgttacccgaacggtaaaccgtaaaccgttaaaaccgtttaaccccgaaaacggaacctaacccgttaacgttagttaaccgttcgtacggtaaaccgtaaaacgttcggaaaaccgtacggccgttaaggaacgtaccgggaacccgggaacggaacccgaacccgggtaccctaacccgttaagttttaccgtaaccggtaacgaaaacgtaactacccgaaacgtaccgtaacggacggtaagggaaccggaaacgggtaacccggtaaacccggg

SEQ ID NO: 122418 - DNA, 818 bp, Homo sapiens
  misc_feature: GYAE6OF01C52VX.52.81.H04.1.454.CMB.1.raw
  modified_base (798)..(798): a, c, t, g, unknown or other
  misc_feature (798)..(798): n is a, c, g, or t
tcagcgcagtacgacacgaccggtgctcgatttagtagtgtagattcgcggggagctctgagagaggagcccagccctgggtattttcaggttgttttcatttggtgatcaggactgaacagagacaactcacatgggtgtttgggctgagcgtggtctttttgtgtggtacttaattttaaaaggtgtccaggtgtgaggtgcagctgctgcgagggtcggggggatcgttaggtaccgaggtcccggtgggggtcctaggagtaccttctccgtgtcggactacgcccgttacgttgggaactttcccggtaaccctttcgggccgtttacgtattaggaactaggttgaacgtcgtacggggtcccaccgaggtcctccggaagggaacggttcggggacttggggaaggttcggggtccttaagaaggtttaaagttaagtacgggttgggaaccggtaaagtaacctaagttacgtaacgacgtaaccggttaccgttaccgggaagggtaaaccggggcccgttaccgttaaccaaccgttaaccgtttaccaacccggaagggaaaccctaaaccgtaaaacttaacccgaaacggttaacaacccgtaataggttaactaccgtaaggaaactaaaccgtggaaacccgacgtttaaccgagaacggaaccgttaaccggaaggtacccgaacccggtaccctaaccggtttacttacccggaaagttaaaaccggaaagtaaacctaaacccgaacgaacccgttaacggaaccgtacgggaaaaccgnggggaaccaaaaccccgggg

SEQ ID NO: 122419 - DNA, 603 bp, Homo sapiens
  misc_feature: GYAE6OF01D95XD.52.81.H04.1.454.CMB.1.raw
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcgaggtattaataggtggtggaagtacatattacgcagactccgtagaagggccgcttcaccatctccagagacaataccaagaccacagtgtatctagacaaatgaacagcctagagacgccggaagacgaccggcctacttattcagtaacgaaagaatacacacagctggacgaggaacgaccgaaacggcgtacctactttcgttagacgttacggacgggacgaaccgggaccgtcggtaccaccgtcctcctcaccgccctccgaaccgacggcccagtccggttacccttccccgcgtcccaccctcccgtacctaacggacgccgtacccgtcgggtcgggccacgacgccggcccgtacgggctacggtccgtggtaaccg

SEQ ID NO: 122420 - DNA, 756 bp, Homo sapiens
  misc_feature: GYAE6OF01B8SM2.52.81.H04.1.454.CMB.1.raw
  modified_base (201)..(201): a, c, t, g, unknown or other
  misc_feature (201)..(201): n is a, c, g, or t
  modified_base (717)..(717): a, c, t, g, unknown or other
  misc_feature (717)..(717): n is a, c, g, or t
tcagcgcagtacgacacgaccggtgctcgatttagtagtgtagattcgcggggagctctgcttcagctgtgagcgcagaaggcaggactcggacaatcttcatcatgacctgcctccctctcctcctcctacccttctcacttcacgtcgccgacgcgggtcctcgggccctagtctggtgtcgacgcgacgccgtccctnaggtcgtccgtcggcccggaccccgaaggaaccgaaggaacgtccaacctactccgtccgtgccgtcgtaggaacgcacgtaccacctaatagtacggaacttaagtttagtttcggtacgttaccgtaggtaccacgtaccacctcgacgaccaccgacccaccctaactcctatagttacacaactaagatacgaaccgtccgaaccgtacgaacggtaacctaccgtacggtaaccgttcttaccgtagtaccggtaccttacgtacggtcgttaccggaacctaccgtaccgaccgacccgtaccggtggaccctaacggtcccggaacccgttacgacccggtaacggccgggtaacgggaacccggtaggtaaccttagttacgtaccggtacgaaacggtacgtaggtacggtacacggtaccgacggtcgtaaaggacgttcggaacggtacgggtacccggggtttaggggaccgggtacccggggtaaagggacccgggtaaccgngggttaacccccggtaccgggtaccggttaaccccgggg

SEQ ID NO: 122421 - DNA, 828 bp, Homo sapiens
  misc_feature: GYAE6OF01AZOIE.52.81.H04.1.454.CMB.1.raw
  modified_base (182)..(182): a, c, t, g, unknown or other
  misc_feature (182)..(182): n is a, c, g, or t
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (616)..(616): a, c, t, g, unknown or other
  misc_feature (616)..(616): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggtagtttgggctgagcgtgtcttttctagtggactaatttaaaggntcagtgtgagtcgacngtctgctgacgtagggtcgggggngtcgttaggtaccgtacggtccgggtgggggttcccctggtaaccgtaccgttccgtccgttggtcggaccncggtcccgtacgtacggttacctttcccgttaacccgttttccgtccgttccgtaattcggaactaacggttcggaaccggtcggtccgggtaacccggtccgtaacggtccgttacggaacgggtaagttcggggaaccggttagggtacggttaggtccgttaagtaacggtttaagttaacggtcgggttaagggtacggtaaacgttagtaacgttaacgtaccgtacgtaccggtaccgttaccggtacgggtacggcccgttactaccgtaccctacgttaccgaaccgtaacggtaaacctactaaaccggttanaaaccgtaaccgtacgtacctttagaccgtttcgaacgtagtaaacggctaaccgacgttacgaacggtacggacgaccgtaccggaacgttacccggtaccttaaacccgtttattaacccggtaaagttaaccgaaacgttaaaccgaccgtaaactaaccgggaacgttcccggaaacggtacggtaaaccggcccgtaaaaccccggg

SEQ ID NO: 122422 - DNA, 891 bp, Homo sapiens
  misc_feature: GYAE6OF01C3N4E.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggtacttaattttaaaaggtgtaccagtgtgaggtgcagctgctgcgagggtcggggggagtcgttaggtacgtacggtcccgggttcgggggggtcccctggacggtaccttccgtccgtggtcgctacggtccctcgttcggtactttcccgtaacccgttttccgccgttactacgtagacctagtagacggtccggttacgggtcccgacgtacggcctaccgaagggaaggtcggggtacgtagggtacgggtcgggtctacgtaaggttaagtttaaaggttagggttagggtaaggtaaacgtttaactaacggttaacgtttacggacgtaacggtaacccggtacccggtaacggggtaaccgggtccccggttaacctttacccgaaccccgttaacgttacccctaaccggaaacgggtaaccgtaaaacccgttaaaaccttaacccgaaaacgtaaaccccgtaaaccgttaaaccgttacggttaaacttccgtaaacggtaaacttaaaacggttaaccggaaacccgtacggtacccgtaacggaaacggacccgggtaacccgggaacgggaacccgtaaccccgggtaccccttaaaccgtttaacgttaccggtaaacggtaaaacgtaaaacggtaaacctaaccgaacgtaaacgtaccgggaaccgtaagggaaaccgggtagggaaacccggtaaaaccccgg

SEQ ID NO: 122423 - DNA, 649 bp, Homo sapiens
  misc_feature: GYAE6OF01EXRKG.52.81.H04.1.454.CMB.1.raw
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
tcagcgcagtacgacacgaccggtgctcgatttagtagtgtagattcgcggggagctctgagagaggagcccagccctgggattttcaggtgttttcagtttggtgatcaggactgaacagagagaactcaccatggagtttgggctgagcgtggtctttttcttgtggcttaattttaaaaggtgtcagtgtgaggtgcagctgctgcgaggtcggggggagtcttggtacagccgtggggggtccctgagctctccgtgtgcagcctntggattccaccttttcgcgttctatcgacatggagcgtcgggtcccncgaggcctacgaggagtggggctgggaggtcgggtctcgaggttaattaagtggtgggtaggaagtactaagttattacgcgtaagtaccgtcggtaggaacgggccgtcttaccgacctactcctaccgaagaacgtaactaaacttacccgaaagaaccaactactacgtatcctagactaaagtacgaaacacgtaccgtaggaacgacggaccggaaggacccgaacggtacccctaaaccgttacttttaccgtaacggtaaaccggaaagtaaactaaccgaactaacgacgtacgtaacgggacggaagggaccgaaaccccggg

SEQ ID NO: 122424 - DNA, 590 bp, Homo sapiens
  misc_feature: GYAE6OF01D7375.52.81.H04.1.454.CMB.1.raw
  modified_base (121)..(121): a, c, t, g, unknown or other
  misc_feature (121)..(121): n is a, c, g, or t
  modified_base (235)..(235): a, c, t, g, unknown or other
  misc_feature (235)..(235): n is a, c, g, or t
  modified_base (308)..(308): a, c, t, g, unknown or other
  misc_feature (308)..(308): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctntcctcctcacccttctcattcactgcacagggtcctgggcccagtctgtgttgacgcagccgccctcagtgtctgcggccccaggacagaagtcacatcctcctgctctggaancagctccaaacattggactaattaattttgtgtcctggtacccagcaactccaggcacacgccccaaatcctnacttagtgactaatcgaataacgccgtaccctgaggataccgcgtaccgattacctcgtggcctaccgaagttctggcacgtcaacgccaccctgggacataccgaccggactaccgagacgtcggggacgacggccgtaattactacgtggaccggaaatacgtgggaattacggacctacggtcccgtaggaacggtcggtagtcggacccggaggggttacggttcgggaaccgggtacggggaaaccctaaggtccgtccggaacccggttacccggg

SEQ ID NO: 122425 - DNA, 839 bp, Homo sapiens
  misc_feature: GYAE6OF01BQJ12.52.81.H04.1.454.CMB.1.raw
  modified_base (187)..(187): a, c, t, g, unknown or other
  misc_feature (187)..(187): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccagtggagtttgggctgagcgtggtctttttcgttgtggacttattttaaaaggtntccagtgtgaggtgcagctgctagcgagggtcggggggagtcgttacgggtacacggtccggtcgggggtccctggacgtactcgtcctgtcgcgacgtcccgtcgtacggtacttccgtaccctttccggcgttactatacgacacgtggacggtcgtcgggtacccgcgtacggtcctaccgagggtacgtcggggtacgttagggtaggtacgggttcctaaccggtaagggtttaacgttaaaggtttacggggttagggtaacggtaaacggtttaacaaacgtttaagtaacccggtacgtaaccggtacccgttccggtaacggggtaacccgggtccttaccttacccgtacccctaagttccccgtaaccggtaaaggaaaccgtaaccgttaaacgttacccaaacgtaacctaaccgtaaccgttcgtaacgttacgtaacggaaacctaaggttaaccgaaacctcgggtacccttaaggaaccccggtaaggtacccccgggtaagaaccccggttacccgacccgtttaaaaccgttcgttttaaaccgggtacctaaaaagggaaaactacgttaaacccaccgtaaacgtccgggtacctaagggggaaacgtaacgggtaccctaaaacccgggg

SEQ ID NO: 122426 - DNA, 623 bp, Homo sapiens
  misc_feature: GYAE6OF01EWMWY.52.81.H04.1.454.CMB.1.raw
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (466)..(466): a, c, t, g, unknown or other
  misc_feature (466)..(466): n is a, c, g, or t
tcagcgcagtacgacacgaccggtgctcgatttagtagtgtagattcgcgggcacgaccggtgctcgatttagtagtgtagattcggcgggggggaggcttggtacagccgtggggggtccctgagactctcctgtgcagcctctggattcacctttcgcgtctatgacatgagcgtgggtccgcaggcctccgaggaatggggctgggagtgggtctcgaggtattaataggtggtggaagtacatattacgcagactccgtagaacggccgcttcaccatcctccagagactaagttccaaagaaccacactgtatctagacaaatgaacngcctgagagcgagacacggccactnttcngtaacgaaagaatacacacacgctaggacgaggacgaaccgaacggctactactttcttcgactacggcgggaccacgggaccctggtccacccgtctcctacncgccctaccgaacccgacggcccctagttcccggttcccttccccgcggacccctaccccgtccctaccgaacgaccgtaccgtcccgtcgggtacggggaccaccggacggtccccggtaccggtcgggacccgtcggtcccgtcggtaaacccgg

SEQ ID NO: 122427 - DNA, 677 bp, Homo sapiens
  misc_feature: GYAE6OF01A263J.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttctgtggctattttaaaaggtgtccagtgtgaggtgcagctgctgcgaggtcgggggagcgttggtacaggccgtggggggtccctggacgactctcctgtgcagcctcgtggtattccacctttcgcgtctatgacagtgacgcgtcgggtccgccaggcctaccgagggaagtggggactgggtaggtgggtctcgaggttaattaagtggtgggtaggaagtacgtaattagttacgcgtaacgtaccgttccggtaggaacgggtcccgtacttaccaaccgtactacctaccgagaacgaactaaacttaccgaaagaacctaacacgttacgtacttactacggaacctaaagttacgaacacggtcccgtaggaacgtaccgggaccgaacgggaacccaccggtacccctaaaccgtttacgtttacgtaacggtaaaacggaaacggtaaactaaccaacgaacgtacggtacgtaaggggaaccgtaaagggaaccgtaaacccggg

SEQ ID NO: 122428 - DNA, 876 bp, Homo sapiens
  misc_feature: GYAE6OF01CVS7L.52.81.H04.1.454.CMB.1.raw
tcagcgcagtacgacacgaccggtgctcgatttagtagtgtagattcgcggggagctctgagagaggagcccagccctgggatttcaggttgttttcatttggtgatcaggactgaacagagagaactcacatggagtttggctgagctggtctttttctgtggtcttaatttaaaggtgtcagtgtgaggtgcagctgctgcgagggtcgggggagcgttaggtacgacggtccggtcggggggtccctggacgtaccgtcctccgtgtcgcgacgtccctcgtcggtactttcctaccgtttcgcgttacctatcgtaactagtcggtaacgtccggttccggggtcccgacccgacggtacccgttacccggaaagggtaacgggtcgggggtccgttaaggggtacgggttcggggttaccttaggttaaaggggtttaatttaaaaaggggtacgggtttaagggggttaaaggtaaacgtttaaaacgtaagttttaaacggttaccccggtacgtaaacgggttaacccggtttaccgggtaaccggggtaaaacggggtcccccgtttaaccgtttaaccccggaaacccttacgttaccccttaacccgaaagggtaaccgtaaaacctaaaacgtttaacccgaaaaacgtaaccaaccgtaacgtacgttaactcgtaacgtaacgtaaacgtacgtaaaccacggttaaccgacgggtaaagaaccggacccggaacgggaacccgtacccggtaacccgttaaaccgttccgttaaaggtaacggtaaaacgaaacgtaaacgttaaacccgaacgtacgaaccggtagtaccgggaacggacgggtaacccgaaacccgggg

SEQ ID NO: 122429 - DNA, 666 bp, Homo sapiens
  misc_feature: GYAE6OF01DTC1G.52.81.H04.1.454.CMB.1.raw
  modified_base (164)..(164): a, c, t, g, unknown or other
  misc_feature (164)..(164): n is a, c, g, or t
  modified_base (202)..(202): a, c, t, g, unknown or other
  misc_feature (202)..(202): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (409)..(409): a, c, t, g, unknown or other
  misc_feature (409)..(409): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcaccatggagtttgggctgagcgtgtgtttctagngctatttaaggtgtcagtgtgagtgcagctgcgtgcgnggtcgggggagtcgttggtacgaggccgtggggtccctggacgactctccgtgtacgcagcctgtggtacttccgtaccgtttcgcttctagtcgagtgtgcgtcgttcggtcccgaccaggtcctacggaggtacgtcgggngtagggtagtgggtctacgtaggttnttaaggtagttgggtagtaagtacaagttcgttaacgngtaacgtacctacgggtagaacgggttcctaccgttaccaacctacgttaccgtacgaaaccgtaacgtaaccgttaagaaccctaaacggtaaccaaaccgtacccgttagtacctacggttaacggaacctaaacggtacgaactaagtcccgtaggaacgaccgtacgacggtaccacccggtacgtaccttagttagtaccgtaaacgaagtacctaacacgaacgacgcgtaagaccgaggacgaaacccgg

SEQ ID NO: 122430 - DNA, 643 bp, Homo sapiens
  misc_feature: GYAE6OF01BIETR.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatgggagtttgggctgagctggtctttttcttgtggcttattttaaaaggtgtccagtgtgaggtgcagctgctgcgaggtcggggggaggcttggtacaggccgtggggggtccctggagactctcctgtgcagcctctggtacttcctacctttcgcgttctatcgacatggagcgtcgggtcccgccgaggctcgaggagtggggctgggagtgggtctagaggtattaagtaggtaggtaggtaagtacaagttagttacgacgtacggtacgtccggtaggaacgggccctacttaccaaccctacgttccctaccgaaaggtaacgtaaactaaacttaccgaaacgaaccactaacgttgtactctagaacctaaatcgaaactacggacctaggaacgacgtccgggaacgaccgaaccggtaccctaacttacgtttacgacgggtaaacaaagtactaccaacgaacgacggacgtagggaacgaagggacctaaacccgg

SEQ ID NO: 122431 - DNA, 591 bp, Homo sapiens
  misc_feature: GYAE6OF01BH8EP.52.81.H04.1.454.CMB.1.raw
  modified_base (182)..(182): a, c, t, g, unknown or other
  misc_feature (182)..(182): n is a, c, g, or t
tcagcgcagtacgacacgaccggtgctcgatttagtagtgtagattcgcgggcacgaccggtgctcgatttagtagtgtagattcggcgggggggaggcttggtacagcctggggggtccctgagactctcctgtgcagcctctggattcacctttcgcgtctatgacatgagctgggtccnccaggctccaggaatggggctgggagtgggtctcgaggtattaataggtggtaggaagtacattattacgcagactcgtagaagggccgcttcaccatctcccagagacaattccaagaacacactgtatctgacaaatgaaacagcctagagagccgaggaccaccggccacctatttctaggtaaccgaaagaactacaacacagctaggacgaggacgccaacggcaactacttcttgactagcgggccacggggggtaccctgtcgacccgtctcctcacgtcctccaccgacggaccctacgtccgtccttccccgtcgcccaccctcctaccaacgaccgccgaccgtctcgggggccacgacggacccggcccgtacgggcctcggtccgtcggtaacccgg

SEQ ID NO: 122432 - DNA, 810 bp, Homo sapiens
  misc_feature: GYAE6OF01CTTMR.52.81.H04.1.454.CMB.1.raw
  modified_base (282)..(282): a, c, t, g, unknown or other
  misc_feature (282)..(282): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcaccatggtagtttggctgagctggtcttttcttgtggtcttaagttttaaaaggtgtccagtgtgaggtgcagctgctgcgagggtcggggggagtcgttggtacacggccggtcgggggtcctggacgactcctccgtgtcgcacgtcctntggtacttcctaccgtttcgacgttcgtatcgactagtggtacgtccggtcgggtcccgaccgtaacggtcccgtaccggaagggtaacggttcgggggccgtttaggggaacgggttggggttacccttacggtaaggtttaagtttaaaaggttgggtaggggttaaggtaaagttaactaagttaacgttaacggccgaagtacccgttaccgggtagggaaccgggtcccgtaacctttacccgacctaaccgttccgaacccggtaagaaccgtaaaaccgttaaaccgttaccccgaaaagtaaaccctaccctaaacgttacgttaaccttacgaacgtaaacctaaagtaccgaaacgtacccggtagtaaccgggacgaaccggtacccggaacggaacccgaaccccgggtaaccctacccgtttagttaaccgtaacggaaaactaaaccggtaaacctaacgaaacccgtacgaacgttaacggacggggaaacgaacgggtacccgaaacccggg

SEQ ID NO: 122433 - DNA, 675 bp, Homo sapiens
  misc_feature: GYAE6OF01E02XV.52.81.H04.1.454.CMB.1.raw
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
tcagcgcagtacgacacgaccggtgctcgatttagtagtgtagattcgcgggggagctctgagagaggagcccagccctgggattttcaggttgttttcatttggtgatcaggactgaacagagagaactcacagtggtagtttgggctgagtcggtcgtcgttcgtaggtgactaagttaaaggtgtcngtgtgngtgcagtcgtgctgcggtaggtcgggggagtcgttcggacncggtccggtcggggtcctaggacgtcctcgtccgngtcgcacgtctcgtggtacttctcgttcgcgtactagcgatacgtggngtcggtacggtccgccgagtccagacggtaggngggtcttagggngttggctagagttaattagcgtaggagtanactagtntaccgagcgtaacgtcggtaacgggtacgccgtacgtctacgtactacgtacccgaacggtaaccgtaacctaacgttaaaccgaacgtaaccgtaactaaccgttataacgtaacgtacgtaacgtaacggtaacaacgtcgaacggtacgtacggacggaccggacgaaccgtaccggtaacctccgttaacgttaccgtaacgtaaacgaaacgtacgaaccgaacgtacgtacgacggtaacccggaggaaacccgaaccggaaaccgg

SEQ ID NO: 122434 - DNA, 859 bp, Homo sapiens
  misc_feature: GYAE6OF01CH2FF.52.81.H04.1.454.CMB.1.raw
  modified_base (338)..(338): a, c, t, g, unknown or other
  misc_feature (338)..(338): n is a, c, g, or t
  modified_base (704)..(704): a, c, t, g, unknown or other
  misc_feature (704)..(704): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagctggtctttttcttgtggctattttaaaggtgtccagtgtgaggtgcagctgctgcgaggtcgggggagtcttggtacaggtccgtgggggtccctggacgactctcctgtcgcagcctgtcggtattcctaccgtttcgccgttacgtactaggacctagtcggtaacggccggttaccgggggtcccnccggtaacggtcccgttacccggaaggggtaacggttcggggggtaccgttagggggtacgggttcgggggttacccttaacgggttaaacggggtttaaagttttaaacggggtttaaggggtttacggggttaagggggttaaaaacggtttaacgtaaacgttttaacggtttaaaccggccgtaaacgggtaacccggtttacccgggtagggtaaaccggggtccccgttacctttaccggaaacccttacgtacccgttacccggaagtaaccggtaaccttaaaacctttacccggaaagttaaacccgacccgttaagtaccgtaacttacgaacgtaccgtaaagtaccggaaaacncgtaacccggtaggaacccgaacggaccggtacggaaccgtaaccggtaccctaacccgttaagtttcccggtaacggtaaacccggaaaagtaactacccgaacgtaaacccagtacccggttaggaacccgggtaacggaggtaaacccccgg

SEQ ID NO: 122435 - DNA, 778 bp, Homo sapiens
  misc_feature: GYAE6OF01EE0U8.52.81.H04.1.454.CMB.1.raw
tcagcgcagtacgacacgaccggtgctcgatttagtagtgtagattcgcgggcacgaccggtgcgtcgatttagtagtgtagattcggcggggggaggcttggtacagccgtgggggtccctgagactctctgtgcacgcctcgtggtacttcctaccgttttcgcgttctatgacagtgacgcgtcgggtccgccgaggcctaccgaaggtaacgtcggggctgggtaggttgggtcctacggtaaggttaagttaaagttgggtaggtaacggtaactaactaattaacgttaaccgaccgaaggtacccgttccggtaagggtaaaccgggtcccgttaccgtttaccaacctaacgttaccgtacccgaagaacgtaaactaaacgttaccgaaaaacgtaaaccaactacgttaacgttacttaccgtagtaaaccgtaaataacgaacgacgtcgtagaaacggacgaccggtacgaccgtccgacttaccgttattacgaagtaaacgaaacgtaacaacgacacgaacgcgtaaggacgaggaccaacggaacgtctaaccgttacttacgttacgaacgttccggacggaccgtaaccggtacctcggtacctccgtcgtcctacgacctcccgaacccgaccgacggtcccgtacgttcccgttccctcccgacgtacccctacctaccgtaacacgacccgtaccgtacgccggggtacggccaccggtcgcccggtaccgaggtccgtcgtaccggtcgtaaaccg

SEQ ID NO: 122436 - DNA, 746 bp, Homo sapiens
  misc_feature: GYAE6OF01E1I8M.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggtcttaatttaaaaggtgtccagtgtgaggtgcagctgctgcgagggtcggggggagtcgttgggtacgaggccggttcggggggtcccctaggagtaccttcttccgtggtcgcacgcccttcgtggtacttcctaccgtttcgcgttctatcgactatggagtcggtcgggtccgccgacggtcctaccgaggtacggtcggggcgtgggaggttgggtctacgtagtaattagtaggtggtagagtatatagtacgacgtagtacgtcggtacggacgggtcccgtacttccgaacctctaccgtaccgaagaaccgtaacctaacttaacccgaaacgtaaacctaccgtaacttacggtacttacctaacggaaacctaagtaacgtaaacccgacgtaccggttaacggacggaaccgggtaccggaaaccgggtaaccgaacccggtacccgttaaaccttaccgttttaaccggtaacggttaaaaccgaaaaacggtaacctaaaccccgaactaaccggaacggtaccggtaacgggaacgggtaaacggggacccggtaaaaacccggg

SEQ ID NO: 122437 - DNA, 893 bp, Homo sapiens
  misc_feature: GYAE6OF01DGNZE.52.81.H04.1.454.CMB.1.raw
  modified_base (176)..(176): a, c, t, g, unknown or other
  misc_feature (176)..(176): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagctggtcttttctgtgctatttaaaggtntccagtgtgaggtgcagctgctgcgagggtcgggggagcgttggtacacggccggtcgggggtccctaggagacctcgtccgtgtcggctacgccttcgtggaacttttccctacccgttttcggcgtttaccgtatgtaccgtagttggacggtccggttcggggtcccccgaccggtacgggtacccttaccgggaaggggtaacgggttcggggggtaccggttaggggtaacggggtttcgggggttccttaacgggttaaagggtttaaacgttttaaaaggttacgggggtttaggggtaagggtaaaacggtttacctaagttaacgtttacccggacgtaacgggtacccgttaaccgggtaggggtaaaccggggtccccggttaccgtttacccaaccccgtacgtttaccccgtaacccggaacggttaaacccgtaaaaccgttaaaccgtttacccgaaaacgggtaaacccctaaacccggttaacgttacgtttaacgtaccgtttaacgaaccgtttaaacgaacggtaaaccgttaccggaccgttagggaacggacccgtaaccgggacggaacccgaccccggtacccgttaaacctttacgtttaacccgtaaggtaaaacccgtaaaggttaaacaaacccgtaccgaaacgtacggacgggaagggtaacggacgggaaaccggtaaaccccggg

SEQ ID NO: 122438 - DNA, 758 bp, Homo sapiens
  misc_feature: GYAE6OF01D2RG4.52.81.H04.1.454.CMB.1.raw
  modified_base (233)..(233): a, c, t, g, unknown or other
  misc_feature (233)..(233): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggtcttaattttaaaggtgtccagtgtgaggtgcagctgctgcgagggtcgggggagcgttggtaacncggtccggtcgggggtaccctggacgtacctctccgtgtcgcagtcctgtcggtacttccgtacccgtttcgaccgttacttagtacgtaacacgttaggaacggtccggttaccgggggtaccccgtaccggtacgggtcccgtacggaagggtaacgggtcggggtactacggggtaggttcgggtacctacggtaaaggtttaagttaaagtagggttagggtaaggtaagtaacctaagttacgtacgacgtaacgtacgtcggtacggaacgggtcctacgttaccaccgtacgttaccacggtaacgacgtaactaacttaaccgaacgtaaacctaccgtacgtacgtaactcgtaagaacctaaatacggaacctacgtaccgtagaaaccggacgacccggtacggaacccgacggtaacccttaccgttaacttacgtaacggtaaacaaaccggtaactaaccaacgaaccgtcggtaacggtacggaaacggcgggaaaccgtaaaccccggg

SEQ ID NO: 122439 - DNA, 688 bp, Homo sapiens
  misc_feature: GYAE6OF01BBTVH.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggtcttaattttaaaaggtgtccagtgtgaggtgcagctgctgcgagggtcggggggaggtcgttgggtaccaggtcccggtcgggggggtcccctggacgtaccgttccgtcccgttggtgccgtacggtccctcgtcgggtactttccctaacccgtttcggcgttctagtgactagtggagtccggtcggggtcccgccgacggtccaccggaggtaggtggggcgtgggaggttcgggtctaggtaaggtaatttaagtagggtaggtagtaagtaactagtactacgcaagtccgtacggaggacggccgtctaccacctctcctaccgaagtaacgaactaaactaccgaaacgaacaacctacgtacgtaactcgtaacgaactaaacgtacgaacacgacgtaggacggaacgacgggaacggaccgaccggaacccttacgttacgttacgtaacgttaaacggaaactaacgtaacacgaacgaggacgagggaacggaacggaccgaaaccgg

SEQ ID NO: 122440 - DNA, 781 bp, Homo sapiens
  misc_feature: GYAE6OF01EPGT8.52.81.H04.1.454.CMB.1.raw
  modified_base (181)..(181): a, c, t, g, unknown or other
  misc_feature (181)..(181): n is a, c, g, or t
  modified_base (350)..(350): a, c, t, g, unknown or other
  misc_feature (350)..(350): n is a, c, g, or t
tcagcgcagtacgacacgaccggtgctcgatttagtagtgtagattcgcggggagctctgagagaggagcccagccctgggtattttcaggtgttttcatttggtgatcaggactgaacagagagaactcacatggagtttgggctgagctggtcttttctgtggcttaagtttaaaggtntcagtgtgaggtgacagctgctgcgaggtcggggggagtcgttggacgacggtccggttcgggggtaccctggacgtaccttccgtcctggtcgacgtcgtccgttcggtcggtaacttccgtaccgtttccgtcgttactagtcgactagtgacgtcgtcgggtaccncgacggtcctaccggagggtaacgtcggggacgttagggtaacggttgggtaccgtaggtaaggtttaaacttaaggttcgggtagggtaaagtacgtaacgtagttaaccgttacgaaccgagttaaccgtccgggacgggtacggtcccgttacctaacctaccgaccgtttcaaccggtaacgtaaacggtaacctaaaccgtaaccgaaacgtaacctaacgtaacgttaccgttatacgtacggaactaaacgtaccgaaacgtcgtaacctagggtaacgaaccgggaccgtaacggggtaccacccggttaacccgtacgtttaaacgtttaccgaaacggtaaaacttaaacggaaacttaccggtaaccgaaccgttaacgggaccggttaagggaacggtaacgaaccggggtaaaccccg

SEQ ID NO: 122441 - DNA, 853 bp, Homo sapiens
  misc_feature: GYAE6OF01EAP95.52.81.H04.1.454.CMB.1.raw
  modified_base (207)..(207): a, c, t, g, unknown or other
  misc_feature (207)..(207): n is a, c, g, or t
  modified_base (277)..(277): a, c, t, g, unknown or other
  misc_feature (277)..(277): n is a, c, g, or t
  modified_base (729)..(729): a, c, t, g, unknown or other
  misc_feature (729)..(729): n is a, c, g, or t
tcagcgcagtacgacacgaccggtgctcgatttagtagtgtagattcgcggggagctctgcttcagctgtgagcgcagaaggcaggactcggacaatcttcatcatgacctgcctccctctcctcctcctacccttctctattcacttgccacgtcgggttccgtcgggccctagttctgttcggttcgacgctacgcccgccctgngtcgtcgcggccggccccaaggaccgtaaggtaacggtccaaccgtctcctccgtgcttcggtaggaacncctacggtctaaccgaacgttagttacggacttaaagttttacgttttcggtcgttacccgtcgggttaacccagtaaccctacgttacccggacggaccctaaccgtaacccgaaccccctaaacttcccttaattactttacgacgtaaactagttacgaacgtaacgccccgttaaccgacggtaagggtacctaccggtccgtaaacggtttcttaccgttcgtaccggttactaccgttacggtacggtccggtaacctaccggtccggtaccgaaccccggttacggtacggaacctaccgtacccggacccgggttaacctaccgggtaaacgggtaccggggtaaccgggggtacttaacgggtaaccgttacgttaacgttacgggacccggtaacggttaacgggtaagttacggggaactaccggggtacttaccggggtntaaacgggttcggtaacggtaccggtttcgggaccgggggttacgggtttccgggtaaccgggggacgggttaaacccggaccggtaacggtttcccggtaccggggttccgggtttaaccggg

SEQ ID NO: 122442 - DNA, 609 bp, Homo sapiens
  misc_feature: GYAE6OF01EJ4DN.52.81.H04.1.454.CMB.1.raw
  modified_base (488)..(488): a, c, t, g, unknown or other
  misc_feature (488)..(488): n is a, c, g, or t
tcagcgcagtacgacacgaccggtgctcgatttagtagtgtagattcgcgggcacgaccggtgctcgatttagtagtgtagattcggcggggggggaggcttggtacagccgtggggggtccctgagactctcctgtgcagcctctggattcacctttcgcgtctatgacatgagcgtgggtccgccaggcctccgaggaagtgggggctggagtgggtctcgaggttattaagtggtggtaggaagtacatattacgcagactccgtaggaacgggcctcttcaccatcctccagagaactaattaccaaagaacacactgtatctgacaaatgaacagcctagagacgccgaaggaccaccggcctaacttattcagtaacgaaagactaacacacacgcgtaggacgaggacgaccgaacggacgtactacttcttagacgtcgacgggaccgaacgggaccgtcggtccaccgtcctcctcacncctccaccgaccggccacgtccgtcccttccccgcgaccccaccctccaccgaacgacgtcccaccgtcggtcggggccacggtccgaccggtcccgcgggtcctcgtccgtcggtaaccg

SEQ ID NO: 122443 - DNA, 619 bp, Homo sapiens
  misc_feature: GYAE6OF01CWLJA.52.81.H04.1.454.CMB.1.raw
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (188)..(190): a, c, t, g, unknown or other
  misc_feature (188)..(190): n is a, c, g, or t
  modified_base (192)..(193): a, c, t, g, unknown or other
  misc_feature (192)..(193): n is a, c, g, or t
  modified_base (195)..(195): a, c, t, g, unknown or other
  misc_feature (195)..(195): n is a, c, g, or t
  modified_base (202)..(203): a, c, t, g, unknown or other
  misc_feature (202)..(203): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (314)..(314): a, c, t, g, unknown or other
  misc_feature (314)..(314): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagcggcgtgttcaggcgctaattaaggntcagtgtngngacnnngnngngagtggnntgngngcgtcggcagctntcgcngcacncgtcgtcgtacgtctcctcgttcacgtctagtgactgtacgtacgtcgtcggtccgcgacgtacgacgtacggtacggtcggnggtggtacggtaggtacgtacgtagtagttaggtaggtaggtaggtaagtactacgtacgtacgagacgtacgtacgtacggtacgtacgtactactactacgtacgtacacgtaacgaacgtaataacgtaacgtaactactacgtacgtacgtacgtaacgtaactaacgtaacgacgtacgtacgtacgacgacggaccggacggtaaccgtaccgtaaccgtaccgttacgtacgtaacgtaacgaacgtacgtaaccgtaacacgtaacgacggtacggaacggtaacggtaacgaacgg

SEQ ID NO: 122444 - DNA, 972 bp, Homo sapiens
  misc_feature: GYAE6OF01CZ6ZP.52.81.H04.1.454.CMB.1.raw
  modified_base (209)..(209): a, c, t, g, unknown or other
  misc_feature (209)..(209): n is a, c, g, or t
tcagcgcagtacgacacgaccggtgctcgatttagtagtgtagattcgcggggagctctgagagaggagcccagcccgtgggtattttcgaggttgttttctagtttggtgatcgaggactgaacagagagactcacagtggagttggctgagcttggtctttttcgtgtggtacttaagttttaaaggcgtcctagtggtgaggtgcngctgcgtagcggtaggggtcgggggtagtcggttaggtaccgacggtccgggttcgggggtacccctggtaaccgtaccttccgtccgtggtacgacctacggtccgttacgttggtacctttccgttacccgtttcggtccgttactaagtcgaacgtacgtaggacggtccggtccgggtacccgaccgtaccggtccgtacggaagggtacggtccgggtaggtacgggtaggtcgggttaccgtaaggttaaggttaatttaagggtacggttaagggtaggtaaacgttactaacgttaacgtaccggtaagtaccggtaaccggttaccgggtaacgggtacccgggttacctacccgttaaccaacccgttaccggttacccgacccgtaaaggtaacccttaaaaccgttaaaccgttaacccgaaaaccgtaaccgttaaccgttaaacgttacgttaaacgttacgtaaaccggtaaaccgttaaaaacggtaccggtaaaaccgtaacccggttaaacccgtaacggggtaacccggaaacccgggtaacccgggtaacccgggtaaacccggttaaaccccggttaaccccccgttaaaggtttttaacccgttacccgggttaaaaaccggttaaaaacgggaaacctttaaaaccccgtacccggaaaaccgttacgtaaaccccgggttaccgggaaacgggtaaaacccccgggtaaagggtaaccccccgggtaaaaaaccccggg

SEQ ID NO: 122445 - DNA, 640 bp, Homo sapiens
  misc_feature: GYAE6OF01BBBD7.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagttgggctgagctgtctttttctgtggctattttaaaggtgtcagtgtgaggtgcagctgctgcgaggtcgggggggagtcttgggtacacggtccggtggggggtcccctggacgtactcctccgtgtcgcagcctcgtggtactttccgtaccttttccgccgtctatgacatgacgcgtcgggtccgccgacggctccgaggaagtggggtactgggaggtgggtctacgtaggttaattaagtaggtgggtaggtaagtactagttactacgcgacgacttcggtacggtacgggtccgtcgtcacctatacgtccagacgtaactaactaccgaactaacaactactagtactctagactaagtacaacgcgtactaggagacgaaccggacggaaccggcctacccgtaaactacgtttaccgtaagtaaaccgtaaagaaactaaccaacgtaacgaggtaccgaggggaaccgaacgggaaccgtaaaccccggg

SEQ ID NO: 122446 - DNA, 749 bp, Homo sapiens
  misc_feature: GYAE6OF01A9MY3.52.81.H04.1.454.CMB.1.raw
  modified_base (568)..(568): a, c, t, g, unknown or other
  misc_feature (568)..(568): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcgttttctaggtggctaattttaaaaggtgtccagtgtgaggtgcagctgctgcgaggtcggggggagcgttgggtacaggtccggtcggggggtccctggacgacctcgtcctgtcgcacgcctcgtggtacttcctaccgtttcgcgtactatgacagtgagtccgtcgggtcccgccgtacggcctaccggaagggtacggtgggggtccgtaggggtaagggttcggggtacctacggtaaaggtttaactttaaacggttagggttaggggtaacggtaaaacgtacgtaaagttaacgttaacccggacgtaacggtaccgttaccgggtaggaaccgggtcctcttacccgactacttcaccgagtaacaactaactaccaagaacctaccattcggtactcgtanaaacctaagtacgaacgtacgacctagggaacacggaccggaaccggaccgtaaaccggacccctttaaccgtttaagttaacccgttaacgggtaaaagaaaacgtaaaccggacctaaacccgaacggtaaaccggtccggttaaagggaaacgggaggaaaccccgggtaaaccccgg

SEQ ID NO: 122447 - DNA, 826 bp, Homo sapiens
  misc_feature: GYAE6OF01DIWBB.52.81.H04.1.454.CMB.1.raw
  modified_base (288)..(288): a, c, t, g, unknown or other
  misc_feature (288)..(288): n is a, c, g, or t
tcagcgcagtacgacacgaccggtgctcgatttagtagtgtagattcgcggggagctctgcttcagctgtgagcgcagaaggcaggactcggacaatctcatcatcgacctgcctcccctctccctcctaccctaccctttctactatttccacgttcgaccacgtacggggtcctacggggccctaaggttctgttcggttcgaaccgccgagccccgccctagtagtctcgcggcccgacccgaggaccaaggacgtacaccatcctccgtagcctagtaggaacncgacgtaccacctaacgagttacgtaacttaagtttaacgtttcgtacggttccgttacggaaccctacgaacccgtaccgtacccggacggacccaaaccgacccgtaacccctaaacttccgtacttaatttacgaacgaactaacgtaacgtaacgaaaccgaccgaacccgttagacggtaactccggactacgttattccgtcgtacgtaactcgtaacgtcgtcgaccgtaccgtaccgacccgtacccgtaccgtacgacctaaccgtaccgaacccgtaccgtaaccggagggttaacccggacgggggtaacccgtaaggttaaccccggttaattttaacccgggtaacgggtaaccgtaaccggggtaacggttacgggtaacggaacgttacgggaaccgaccggttaaggtacgttaacgggacgtaacccgggtacgggtaccggttagggggtttacccggaggggaaacccgggtaaggaacccggtaccggtaccggtaccccggtacgttaaaccccggg

SEQ ID NO: 122448 - DNA, 837 bp, Homo sapiens
  misc_feature: GYAE6OF01DGWFW.52.81.H04.1.454.CMB.1.raw
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcacatgggtagtttgggctgagcggtcgtgtttctaggtcgacttaagtttaaaggngtcgngtgtgnggtncgagctgcgtgcgagggtcgggggatcgttggacgacggtccggttcgggggaccctgggaacgtaccgttccttccgtaggtcgaccgacgtccctaggtcgtaatttacccttaccggtttggccgttactacgtacgaactacggtgaaccggtggttccgggacccgccgttaaggcccgttacggaaaggtacgggttacggggtacgtaggggtcggtaagggttaccttacggttaagggtttaacttaaaggtgggtaaccggttagggaaacctctaaagttaacgtccgtagacgtaacggttaccggagggtaacccggtctaccttacggaaccctcttacccgacggaaaggaacgtaacgtttaaacgtccgaaaagtacgtaactaacctttcggtttaaccgtaacacggtttaaaccaaaggtttacggaaaccctagggtacctaaacggggccgaaaccggttccggggtaaaccggaacccggtaccccgttaacccttaacgtttaacccgggtttaaacgtaaaaccgggtaaaaccgtaaaactacccgaaacgtacccgtaacggtaacgggtaacgggaaccggaacgggaacccggaacccggttaaacg

SEQ ID NO: 122449 - DNA, 768 bp, Homo sapiens
  misc_feature: GYAE6OF01BCCYS.52.81.H04.1.454.CMB.1.raw
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (189)..(189): a, c, t, g, unknown or other
  misc_feature (189)..(189): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggcgtgttctaaggcgctatttaaaggtcngtntgcgtncagctgctgcgagcgggagcgttgtacagcgtcgggtccgacgagagtcgtcctgtgcgaacgtctaccttggaattctaaccgtttccttcggacgtaaagttcgtaccaaaacgttcgtaaagtaccggtaccgggtacccggtccccgtaaaggtaccggtccctaacgggaaaacggttagggtcccggaacgggtacggttcggggaaactttcgaacggggtaagtttaaaactttcgggtaacgtaggggaaacgttaacgtaacgttaagtttaacgtaaccctaacggtaagtaccccggtaacggtaaaggacccgggttccgtttacgtaaccccgtaaacgtaccgtaaccgaacgtaacgtaacgtaaccgtaaccgtaacgtaaacgtaacgtaacgtacgtacgtacgtaacgtaacgtaacgtaacgaacgtacgtaacgtacgtaacgtacgaccgaccgtaaccgtacgtaaccgtaacgttacgtaacgtaacgtaaacgtaaacgtaaacgtaaacgaacgaacgtaacgtacgaaggaacggacggtaacggtaaccg

SEQ ID NO: 122450 - DNA, 748 bp, Homo sapiens
  misc_feature: GYAE6OF01C7AWA.52.81.H04.1.454.CMB.1.raw
tcagcgcagtacgacacgaccggtgctcgatttagtagtgtagattcgcggggagctctgagagaggagcccagccctgggtattttcaggttgttttcatttggtgatcaggactgaacagagagactcacagtggtagtttggctgagtcgtggtctttttctgtggtactttaagttttaaaggtgttccagttggtggaggtgcagtctgcgtagcggtaggggtcgggggagtcgttaggtacgacggtccggtcgggggtccctgacgtcttccgtcgtgtcgcacgtcctgtcggtactttcctaccgtttcgacgttctagtcgtaactagtcgtacggtccgttccgggacccgtaccggtacggtacccgtaacggtaacgggtagggttggggtcgtagggttacgggtaggttcctaacgggttaggtttaaagttaaggttaggggttaggtaacgggtaaattacgtaagttacgttacggaaccgtacggtaaccgttcggaacggtaccgggtcctacttaccgactacctcgtaacgactaacgtaactaactacggaataacacctagtatacttacgagtaactaaagtaccgaactacggaaccgtgaacgaccgtacggacggaaccgtcctaaccgtactttaggtacgtaaaggaaaccgtaaataacgtaccgaacgttaaggcggaacgtaacggggaacccgaaggtaacccggtaaacccg

SEQ ID NO: 122451 - DNA, 889 bp, Homo sapiens
  misc_feature: GYAE6OF01CS0T6.52.81.H04.1.454.CMB.1.raw
  modified_base (245)..(245): a, c, t, g, unknown or other
  misc_feature (245)..(245): n is a, c, g, or t
tcagcgcagtacgacacgaccggtgctcgatttagtagtgtagattcgcggggagctctgagagaggagcccagccctgggtattttcaggttgttttcatttggtgatcaggactgaacagagacccccccccgaatcaccatggagttggctgagtctggtctttttcttgtggtacttaattttaaaaggtgtccagtgtgaggtgcagctgctgcgagggtcggggggagtcgttggtacncggtccggtcggggggtcccctggacgtaccttcgtccgtggtcgcacgtccctgtggtacttccgtaccgtttccgcgttctatacgactagtcggtacggtcgtcgggtacccgccgtaggcctaccggaaggtagggtcggggtacgtagggtacggtcgggtacttacggtaaggtttaagttaaagttagggtagggtacggtaaagttaactaatacggttaccgagtaaccggtacccggttaccgggtaagggaacccggggtcccgttacgttacccaacccgttaccgttaccgtacccgtaaaggaaccgtaaacttaaacgtaccccgaaagtaaacccaccgttaacgtacgttaccttaacgtacgggtaaaacctaacgtaacggtaaacctaacggtaccggtaacggtaaacgggaaccccgggtaacccggggtaaccgggaaaccccggtaacccgggttaacccccgtttaaaaccggttttaccgtttaacccgggttaaaaacgggttaaaacggtaaaaacccggtaaaccgttaaaacccgaccccgttaaacggaaacccggggttaggtaaacccgggggaaaccgggaacggggtaaacccccggaaaaaccccggg

SEQ ID NO: 122452 - DNA, 811 bp, Homo sapiens
  misc_feature: GYAE6OF01A78UY.52.81.H04.1.454.CMB.1.raw
  modified_base (182)..(182): a, c, t, g, unknown or other
  misc_feature (182)..(182): n is a, c, g, or t
  modified_base (208)..(208): a, c, t, g, unknown or other
  misc_feature (208)..(208): n is a, c, g, or t
  modified_base (229)..(229): a, c, t, g, unknown or other
  misc_feature (229)..(229): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctggagcggtgtcgtttctaggtggctaatttaaaggngtcagtgtgaggtgcagctgctgcgnggtcgggggagtcgttggacnggtccgtgggggtccctggaatctctccgtgcgcagccctgtggtaaccttccgtcctttcggcgttactatcgactatggaacgtccggttcgggtccgccgaggcctaccgaagggtacggtcggggtagtacgggaggttcgggtctacggtaaggttaacgtttaaaggtcgggttcggtaagggtaaaccttacgtaatttaacgttacgaccctaacggtaccgttaccgggacgggtaaaccgggtccccgtactttacccgaacctaccgtttaccgaccggtaaaccggtaagtaaacccttaaccggttaacccaaacgggttaaaccctaaccccgggttaatttacgggtaaccttaccggttaacgtaaacccggtaaattaacggaaccgtacggtaacccggttaaggaacgttaacccgggacccgtaacgggaccgtaacccgggtacccttaaaccggttacggtttaaccgtacggttaaaaccgggaaactaaacgtaaccccggtacaaccggtacgttaccgggaacggacgggtaaccgggtaacccgtaaacccgggg

SEQ ID NO: 122453 - DNA, 695 bp, Homo sapiens
  misc_feature: GYAE6OF01A0YV1.52.81.H04.1.454.CMB.1.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (273)..(273): a, c, t, g, unknown or other
  misc_feature (273)..(273): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctagtgctatttaaaaggtgtcagtgtgaggtgcagctgctgcaggtcgggggagcgttggtacngccgtggggggtcccnggacgtctctcctgtcgcagtccctcttaggnttcctacctttcgtcgtcttaatcgtacagtcgagtccgtgggtcccgaccaggtctccgaagggaacttcgggggccttggggtaacgggttcggggttcctacgtagggttaacgtttaaagttaggtagggtacggtaaagtttaacgacttagttaacgcgtaacgtaccgtacccggtaggtaagggcccgtcttaacctacctataccctacgacggactaacgtaacttaccgaaacgtaaactcccaagtacttataacgtagacctaaagtaggaaaccagtccgtagacgggacgacccgaggtaacccgaccgggtccctaacccgttattcccgtaaggtaacccgaaaaggtaaaccttaaccaaacgacctaaggaccgtacggggaacgaaagggtcggaaacccgg

SEQ ID NO: 122454 - DNA, 754 bp, Homo sapiens
  misc_feature: GYAE6OF01A1VJM.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagctggtcttttctgtggctatttaaaggtgtcagtgtgaggtgcagctgctgcgaggtcggggggagtcgttgggtacacggtccggtggggggtccctggacgacctcgtccgtggtcgcacgtcctcgtggtacttccgaccgtttcgccgttactatcggactagtcgtacggcgttcgggtcccgccgacggtcctaccgaagggtaacgttcgggggacgttaggggtaacggttcgggttaccgtacgtaagggttaacgtttaaggtacgggtaggtaaggtaagtaactaagttaacgttacggaactaacggtaccgttaccggtagggtaaccgggtccctaccgttacccgaaccgtacttccgtaaccgtaagaaccgtaactaaaccttaccgaaaagtaaccaaccgtaacgtacggttaataccgtaacgtaacgtaaacgtcgaaaccgtaccggtactagggaacgaccggaccggaacggtaccgaacccggtacccgttaacttaccgtttacgaacggtaaaccgtaaaggtaaacctaaccacgtaaccgtacgtacgtaagggacggaacggtcgaaaaccccgg

SEQ ID NO: 122455 - DNA, 798 bp, Homo sapiens
  misc_feature: GYAE6OF01BLEMN.52.81.H04.1.454.CMB.1.raw
  modified_base (318)..(318): a, c, t, g, unknown or other
  misc_feature (318)..(318): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcgaggtcggggggagtcttgggtacaggcccggtggggggtccctggacgacgtctccgtgtgcacgtcctcgtcggacttcctaccgtttcgcgttctatgacctagtcgnggtcgtcgggtcccgccgaggtcctccgaagggtagtggggctagggtacggttggggtctacggtaagggttaatttaacggtaggtaggggtaaggtaacggtaactaagttaacgttacgactaaggtaccgttaccggtacgggaacgggtccccgtacttcccgaaccctacctttccccgaactaacggaacgtaacctaaaccgtttaacccgaaacgtaaaccctaaccgttaaaccgttagttaaccgtttaccgtaacgaacgtaaaccgtacgaaaccggtaccggtccgttaacggaaacggggacccggtaccgggaaaccggacccggtaaacccggttacccgtaaaccccggttttaacgtttacccgttaacgggtaaaacgaaacggtaaacctaacccgtaaaccgacggtaccggtaacggtaacggggaaaccggtaccggggaacgtaaaaccccggg

SEQ ID NO: 122456 - DNA, 718 bp, Homo sapiens
  misc_feature: GYAE6OF01AWJJU.52.81.H04.1.454.CMB.1.raw
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcacgccgccctcagtgtctgccggccccaggacagaacggtcaccatctcctgctcgtaggaacgcacgcctaccaatagttaggactaaattaagttttcgtgtccgtggtaccagccaacctccgacggaccaccgacccgaccccaaactcctactatttatacgaactaatagaacgtaacgaccaccctacggaacggtactaccgtacggtaacccgttagttccgtacgtcggtacctaccggtaaacgttccgttacggacctaccgtaccgaccggacccctaccccggttacgggacctaccgtacccgacccggtacctacccgtacggtaccgggtacgggggaaccggtacgggtacccgttaactttaaccgttaccggtacggaaccggtaacgtagggttacgggaatacgcgtaacggtccgtacggtaggtacgtaaggtccgggtacgggtacggggttcgggtaccgggacggggtaaccgggtaaccggacgttccggtaaccggtcccggttacccggg

SEQ ID NO: 122457 - DNA, 846 bp, Homo sapiens
  misc_feature: GYAE6OF01DFLG4.52.81.H04.1.454.CMB.1.raw
  modified_base (826)..(826): a, c, t, g, unknown or other
  misc_feature (826)..(826): n is a, c, g, or t
tcagcgcagtacgacacgaccggtgctcgatttagtagtgtagattcgcggggagctctgagagaggagcccagccctgggtatttcaggttgttttcatttggtgatcgaggactagaacagagagaactcacagtggtagttggctgagcgtggtctttttcgttgtggtacttaagttttaaaggtgtaccgagtgtgaggtgcgagctgcgtggcgagggtcgggggagtcgttggtactacggtccggttcgggggtaccctaggacgtacctcctccgtgtcgctacgtccgtcgtaggtacttcctaccgtttcgcttacgtagtcgactgtcggacggtcggtcgggtacccgacgtacggtcctaccgggtaagggtacgggtcggggtaccgttaggggtacggttacgggtaccgtaagggttaaaggtttaagtttaaaacgggtgggtttaaacgggttaacggtaaacgtttaaacgtaacgtttaacgtaaccggtacggtaacggtaacccggtttacggggtaacgggtaaacccgggttccccgtaacccgtttaacccaacccgtttaacggtaccccgtaaacccggtaaaggtaaccgtaaaacccgtaacgtttaaccccgaaaacgtaaccctaacccgtagttacgtaacctacgtaaccgaaactaagtaaaccgaccgtaacgtcccggaagtaccggacggaaccgacggtaacccgtacccggtaacctaaccgttattaaccggaaacgtaacgtaaaagtacctaacgaaccgacgtacggaaccgagggaaaccncgggtaaaccgtaaacccgg

SEQ ID NO: 122458 - DNA, 924 bp, Homo sapiens
  misc_feature: GYAE6OF01AKSPA.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcgaggtcgggggagtcttggtacagccggtggggggtccctggacgtactctccgtgtgccacggccctcgtggtactttccgtacccgtttcggccgttacttagtcgtaaccagttggacggtccggttacggggtccccgaccgagggtcccttacccggaagggtaaacgggttcggggggtccgttaggggggtaagggtttcgggggtttaccccgttacggttaaacggggttttaaactttttaaaagggttacgggggtttagggggttaaacggggtaaaaacggtttaaaccgttaaacgtttaaaccgttttaaacccggggacccgttaaaccgggttaaaccccggtttcccggggtaaacggggtaaaacccgggggttccccggtttacccgtttaacccgaaaccccgttaaccgttaccccgttaacccgtaaacgggtaaaccggtaaacccttaaaaccgtttaacccgaaaacggtaaaccctaaccgtaaacgttacgttaactaccgtttacggaactaaaacgtacggaaaccgtacggtaccgtaggaacggtacggaccccggaacggaaccccgtaccggtacccttaaacccgtttagtttacccggtaacgtaaaacggtaaaacgtaactaaccgaaaccgtacgacggtaccgtaagggaacccggtaagggacccgtaaacccggg

SEQ ID NO: 122459 - DNA, 662 bp, Homo sapiens
  misc_feature: GYAE6OF01CYLEI.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacatggagtttggctgagctggtctttttgttgtggtacttaattttaaaaaggtgtaccagtgtgaggtgcagctgctgcgaggtcgggggagtcgttggtacaggccggtcggggggtccctggagtactcctccgtgtgacgcgcctctggtattctacctttccggctactatgacatgagctcgggtccgccaggcctccgaagggaagtggggctgggtagtcggggtatcgtaaggtatttaagtagggtgggttaagaagtactataacgttacgatacggtactaccggtaggaacgggccctcgttacaacctactcctaccgaagaacggaaacctaaacgttaaccaaacgaaacgtaccaacgtagtactcgtagacctaaagacgaaacacggacctagaacgacggaccaacggacccgaacgtacccgtaaccttacgtttacgtaacgtaaacgtaaaacgaactaaccaacgtaaacgtacgacgtagggaacggtaaggaacgtaaaccccggg

SEQ ID NO: 122460 - DNA, 813 bp, Homo sapiens
  misc_feature: GYAE6OF01B35DO.52.81.H04.1.454.CMB.1.raw
  modified_base (210)..(210): a, c, t, g, unknown or other
  misc_feature (210)..(210): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcacagtggtagtttgggctgagcgtgtcttttctggtgtcttaagtttaaaggtgtcagtgtgaggtgcagctgctgacgngggtcggggggaggtcgttggacgacggccggttcggggggttccctaggacgtaccgttcctccggtgtcgcgacggtcctcgtaggtacttctacctttcggccgttctagtagacagtcggcgtccggtcgggtcccgacgacggtcctaccggagggtaacggttcggggtggtcgggtagggttcgggtacttacggtaggttaattaaggtaggtaggggtaagtaaacggtaacgtaattaacggttacggacgtaacggaccggttacggtaggggaaccgggtccgttacctccgtaactaccggtacctacgaaggtaaccgtaaactaaaccgttaacaaacgtaacctaacgtaccgttaagtacgtcttaaccgaaactaaacgtacgtaaaccgtcggaaccgttacggaaaccggaacggccccgggaacggtaacccggtacccggttaacccttaaacccgttttacggttaaaccgttaacccggggttaaaagaaaaccgggttaaacaaacccggtaaaccgtaacgtaacggtaacgggtacgggaaaaccggggttaacgggaaccccggtaaaacccggg

SEQ ID NO: 122461 - DNA, 844 bp, Homo sapiens
  misc_feature: GYAE6OF01A2MVN.52.81.H04.1.454.CMB.1.raw
  modified_base (181)..(181): a, c, t, g, unknown or other
  misc_feature (181)..(181): n is a, c, g, or t
  modified_base (832)..(832): a, c, t, g, unknown or other
  misc_feature (832)..(832): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactccaccagtggagtttggctgagcgtgtcgtttcgtagtcgtctatttaaagngtctagtgtgaggtgcagcgtgctgcgtaggtcggggagtcgttggtacacggtccggtcggggtcctggacgtctctccgtggtacgcgtaccgtccgtcgttacggtactttaccgtacccgtttccggcgttaccgttaacgtacgtacgtaacgtacggtaccggtaccgggttccgggtaccccggtacccgtaacggggtccctaacccggtaaggggttacggtaccgggggtaccggttagggtaccgggtttaaccgggtaccgttaaccggtaaggtttaaaccgttaagggttacgggtttaagggtacgggttaaacgtaaccgttaagttaccgtaacggtacgtacgtaaccgggttcggtaacgggtaacccggtcctaacgttaccgaacgtacgtaccgtaacgtacggaacctaacgtaaccttacccgaaaacgtaagtaccgttaaacgttcgtaacgttccgtaaggaaccctaaaggttccgaaccggtaacgtcgtaacggaacggtcccggaaccggtaaccgtaccgtaaccccggtctttaaaccggttacgttacggaaaccggtaagtaaacgactaacgaacccggtaactccgggtaccgtaagggaccggtaaacccggnggttaaaacccg

SEQ ID NO: 122462 - DNA, 734 bp, Homo sapiens
  misc_feature: GYAE6OF01BGSAD.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacagtggagtttggctgagcgttggttctttttcgtggtggtacttaagttttaaaaggtcgtaccgtagtggtgaggtgcgagcgtgcgtggcgagggtcgggggagtcgttaggtacgcggtccgggtacggggtcctagacgtcctcgtccgtgcgcgacgtcctcgtggtacttccgtaccgtttccgacgttctagtagacagtggacgtccggtcggtaccgccgtacggtcctacggaaggtacggtggggtcgtagggtacggtacggtcgtacgtaaggttaagttaacggtagggtaggtacggtaaagtacgtaagttacgtaccgaacgtacggtaaccgtacggtaacgggaccggtacctccgtaaccacgtactaccgaacgaagtaacgaactaaacgtaccgaaagaactaccgtaagtatacgtctaacgaactaacgtacgaacgtacgtaccgtaggaccggaaccgacgggaacgtaccgaccggttactaaccgtttacgtaacgtaacgtaaaagggtaactaaccgaacgaaccgagaccggttacggaaggtaaacgggaacgtaaccggtaaaacccgg

SEQ ID NO: 122463 - DNA, 855 bp, Homo sapiens
  misc_feature: GYAE6OF01CYZZC.52.81.H04.1.454.CMB.1.raw
tcagcgcagtacgacacgaccggtgctcgatttagtagtgtagattcgcggggagctctgagagaggagcccagccctgggatttcaggtgttttcatttggtgatcaggactgaacagagagaactacaccatggtagtttgggactgagctggtcttttcttgtggtcttaagttttaaaggtcgtcaggtgtgaggtcgcagcgtgtcgtgcgagggtcgggggagtcgttgggtacacggtccggtcgggggtccctaggacgtactccgtccgtgtgcctacgtccgtcgtaggtaccttccttacccgtttcgtaccgttactaagttcgtactacgtcggaacggtccggttaccgggtcccgtaccggacggtccctaccggtaaggggtacggtggggtaccggtagggtaccggttacgggtctacggtaaaggttaacgtttaacggtagggttacggtaaggtaacgttaacgtaacgtacgttaaccggcgtaacggtaccccggttcgggtaaccgggtaaccgggttccctaacgtttaacccgacccgtaccttaccgtacgaaacgtaacgtaaaccttaacgtacccaaaacgtaaccctaacgtactacgttaaccgtacgtacgtaacgtaagtaacccgtacggtaaccggtcgtaaccggaccggtaccgaacccggggaacccggtaaccgtaccccgggtaacctttaccccggttaagtttacccggtaaaaccggtaaaaccgttaaacgtaaccaaacccgtacggtaacccggtacggaacgggtacccgggtaaaaccggacgggtaaaccccgtaaaacccgggg

SEQ ID NO: 122464 - DNA, 698 bp, Homo sapiens
  misc_feature: GYAE6OF01EMLR0.52.81.H04.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (664)..(664): a, c, t, g, unknown or other
  misc_feature (664)..(664): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagcgtgtgttttctggtggctaattttaaaggtgtcagtgtgaggtgcagctgctgcgaggtcggggggagtcttggtacaggccgtgggggtccngagtctctctgngcacggtcctcgtggacttccgtacctttcgcgtctagtcgactagtgacgtccggttgggcccgcgacggtcctaccgggtaaggacggtggggcttggggaggttcgggtcttacggaaggttaaacgttaaggtagggttaggggtaaggtaaacgtagtaagttacttaccgagtagtaccgttccggagggtaaccgggtcctctacccgtactactaccgtacgaacgtaccgaaacgtaaccttacccgaaaacgtaaccctaaaccgtccgttacttactacgtagtaaactaaaacgtccgaaaactcggtaccctaggtaacggaccggaaccgaacggacccgaccgtaccgttaccttaagtttcgaacgtaaaggaaactaaactaacaacgaanacggtcggtaaaggacgggacgtaacggaaccgg

SEQ ID NO: 122465 - DNA, 893 bp, Homo sapiens
  misc_feature: GYAE6OF01EDMGK.52.81.H04.1.454.CMB.1.raw
tcagcgcagtacgacacgaccggtgctcgatttagtagtgtagattcgcgggcacgaccggtgctcgatttagtagtgtagattcgcggggggagcttggtacagcctgggggtccctgagactctcctgtgcagcctctggattcaccttttcgcgttctatgacagtgagcgtcggtccgcgagctacgaggtagtggggcgtggtaggtggtcctacgtaaggttaatttaagtaggtgggtaagaacgttactaagttacttaccgactacgacgttccggtaaggaaccgggtcctacgttaccgaacctactcctaccgaagaacaacttaacttaccgaaacgaaccactacgttgttactcgtacgaactaagtacgaacacgtacgtaggaacgtacggaccggtaaggaccgtaccggtaccctaactttacgtttacgtacggttaaaacgaaaacgtaacgtaaaccaaccgtaacgaccgtacggtaaacgggaaaccggaacggtaaccggaacccggtaaaccggtacccggtttaacctttaaccgttttaccggtttaaacgttacccggttaacgggtacccggggtaacccgggtaacccgggttaacccggttcccggtttaacccgttaaccccggtttcccgtccctttaacccggaaccccgttaccccggtaaccccggtaaccggaaccccgggttacccgtttacccggttaccccggttttcccccgttacccccgtacccgtaccccttaccccggtaccctaaacccggacgtacccggtacccgtacccggttacgggccgggacctaccgggacccgtaccggtccggacggttcccgtagtcccggttaccggtaaaccgg

SEQ ID NO: 122466 - DNA, 738 bp, Homo sapiens
  misc_feature: GYAE6OF01DWJQW.52.81.H04.1.454.CMB.1.raw
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcttttctaggtggacttaatttaaaaggtgtcagtgtgaggtgcagctgctgcgnggtcgggggagcttggtaacnggccgtcggggggtccctggagtactctccgtgngcagtcctcgtggacttccacctttcgcgtctatgaaccngtagagtccgtggtcccgcgaggctaccgagggtaacgnggggtctagggtagtcgggtctacgtaaggtattaagtggtaggtagaagtacgtaattacttacgctacgacgtacggtacggaacggggccctaccgttacaacccgttacgtccctaacgtaaggtacaaacgttaacgtaccgaacgaactacgtaacgtagttactacgttcgaaacgtaaagtacggaaacgtcggtaccccgttaaggaaccgggttaacggaacccccgggaagggtaaccccgaacccggggtaacctaaacccgtttaaccgttttaccggaaagggttaaaacccgaaaaggttaaacccgttaaacccgactaaaccgggtacttaccggggaacgggttaaaccggaaggggaacccgtaaaacccccggg

SEQ ID NO: 122467 - DNA, 755 bp, Homo sapiens
  misc_feature: GYAE6OF01DAVOT.52.81.H04.1.454.CMB.1.raw
  modified_base (504)..(504): a, c, t, g, unknown or other
  misc_feature (504)..(504): n is a, c, g, or t
  modified_base (610)..(610): a, c, t, g, unknown or other
  misc_feature (610)..(610): n is a, c, g, or t
tcagcgcagtacgacacgaccggtgctcgatttagtagtgtagattcgcggggagctctgagagaggagcccagcccgtgggtattttcgaggttgtttttcagtttggtgatcgaggactgaacagagagactcacagtggtagtttgggctaggagtcgtgttcgttttcgttggtggtactttaaagtttaaaggtcgtaccgtaggttggtggtaaggttcgactcggtccgtgccgtaggaccggtacgggggtcggggggacgttcggttcgggtaacgccggtccggtcggggtccctaggtacgtactcttccgtgtacgcctcgtccgtcgttacggtacttcccttaccgttttcggcttacgtaggtcagtaggtcggtggtccggtccggtacccgacggaccggttccgaacggagggttaggtcgggtgtaaggggtcggtcggtactacgggtaagttaagttaacgttagggtaggtaacgtaacgtntaacgttccgagacgtacgtccgtcggacgggtacccgtcctaccgtaccgtacctacgtacctacgtaacgactaactaccgtaccgaaacgtaacctatacgtntacgttgtacgaaagtactaagaacgacgacctaggacgcgaccgacgaccgtaccgtaaccgtacgtacttaacgtacggaaacgtaaaccgacttaaccgaacgacgtacgacggtaacggaccgtaaccggacgaaacccgg

SEQ ID NO: 122468 - DNA, 650 bp, Homo sapiens
  misc_feature: GYAE6OF01B2ZSB.52.81.H04.1.454.CMB.1.raw
  modified_base (305)..(305): a, c, t, g, unknown or other
  misc_feature (305)..(305): n is a, c, g, or t
tcagcgcagtacgacacgaccggtgctcgatttagtagtgtagattcgcgggcacgaccggtgctcgatttagtagtgtagattcggcgggggggaggcttggtacagccgtggggggtccctgagactctcctgtgcagcctctggattcacctttgcgtctatgacatgagctgggtccgccaggctccgaggaagtggggctgggagtgggtctcaggtattaatagtggtgaagtacatatacgcagactccggtagaacgggccgcttcacctatctaccagagacaactccaagaacanactagtatctgacaaatcgaaacagtccaggaagacgtaccggagacgaccggcctaacttatttccgaggtaaacgaaaagacctacaacacgagtctacggaacggagtacgaccgaacggcgtaactactttcttacgacgttacgtcggggaccaacgggaacccgtgggtaccaccggtcctaccgctaacgccctaccgaccgaacgggccctagtcccggtccttccccgtggccctacccgtcctaacccgagtaccgtaccgtacccgtcggtacggggcccacgtacgggaccccgttcccgggtcggaccgttcggcccgttacggtaacccgg

SEQ ID NO: 122469 - DNA, 856 bp, Homo sapiens
  misc_feature: GYAE6OF01ELZVF.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctaggtggctaatttaaaggtgtccagtgtgaggtgcagctgctgcgaggtcgggggagtcttggacacggccggttggggggtcccctaggacggaccttccgtccgttagtcgactacggtcccgtcgttagggtaaccttccgtacccgttttcgccggttacttaacgtagacctaagttcggtacgtccggttcgggtacccgaccgtacggtccgttaccgaagggtaacggtcgggtacgttagggtaaggttcggggtccttacggtaaggtttaacgttaaaggttggtagggtaggtaaacgttacgtaagttacgttaacggctaaaccggtacccggtacggtagggaaccgggggtcccttacgttacccgtaaccgtacgttaccccgttaaccggaaggttaaaccgaaaccgttaaacgtttaacccgtaaaacggaaacccttaaccggtaaccgtttaggttaacccttcgttaaacggaaaccgttaaacgttacgaaaccgttacccggaccgttaagggacgaaccgggttaaccggaacggttacccggaaacccggtacccttaaacccggtttacgttaccgttaaaacggtaacccggtaaaattaccgtaacccgaagtaccggaacgttacggttaaacgggacggaacggggtaacccaaacccgggg

SEQ ID NO: 122470 - DNA, 728 bp, Homo sapiens
  misc_feature: GYAE6OF01BGTRW.52.81.H04.1.454.CMB.1.raw
  modified_base (197)..(197): a, c, t, g, unknown or other
  misc_feature (197)..(197): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcaccatggagtttgggctgagctggtctttttctgtggcttagttttaaaggtgtcagtgtgaggtgnagctgctgcgagggtcggggggagtcgttagggtaccaggccggttcgggggtccctggcgacttcgtccgtgtcgactcgccttcgtaggtacttcctaccgttttccggacgttcttaagtagacctagttagacggtcgtcggggtcccgccgaaggttcctaccggaggtaacggtcggggcgtgggtaggttcgggtacctacggtaggttaacgtaagttagggtgggtaagtaagtaactatttaacgttcgacgtacgtacgtccgggtaggtaaccggggccttaccttacgaacccgttagttaccctaacccgggagtaaaccgaacgtttaaaccttaaccgaaacgtaaccgaaccgttacgtacgttacgagttaccgtaactaaacggtacaaacgacgtaccgtggaacggtacggaccggaaggacccaccggaccttaccttagtttaccggaagtaaaccgaagtactaaccgacaacggactacggagggtaacgcgggaacgtaaacccg

SEQ ID NO: 122471 - DNA, 732 bp, Homo sapiens
  misc_feature: GYAE6OF01EN6MO.52.81.H04.1.454.CMB.1.raw
  modified_base (76)..(76): a, c, t, g, unknown or other
  misc_feature (76)..(76): n is a, c, g, or t
  modified_base (195)..(195): a, c, t, g, unknown or other
  misc_feature (195)..(195): n is a, c, g, or t
  modified_base (613)..(613): a, c, t, g, unknown or other
  misc_feature (613)..(613): n is a, c, g, or t
tcagcgcagtacgacacgaccggtgctcgatttagtagtgtagattcgcggggagctctgcttcagctgtgagcgnagaaggcaggactcgggacaatcttcatcatgacctgcctcccctctccctcctccacccttctcattcactgcacgacgggtccgtggccctagtctgtgtgacgcacgcccgccctnagtgtctcggccggaccccaggacaggaacggtccacctactcctcctgtcctcgtaggaacgccacgtcctaccaaactagttacgtactaaaagtttattttacggtcgttacccgttaggtaacccaagaccctaacccgtcccgaaggcctacccgacccgaccccctaactccttactatttactacgaactaagtacgaacgtaccgccgtaacccgtacgggacgtaacttaccccgtagtaacccgtactttccgtcgtccgtactaccgtaacgttcgtaacgccgtaccgtacgacccgtcccgtaccgtcgggtaacctacggtcccccgaaccgggtacccaccggtaccggaccggtaacggggaccgtaacggtacctacgttacgtaccgtacgacggtaagngtacggtacgtacgacgtcgtaccgtggtaacgtggtaccgttagggacccgggttaggggtccgggtacgggaccgggaacggaccgacgggcccggttacggcccgttaacccgggg

SEQ ID NO: 122472 - DNA, 898 bp, Homo sapiens
  misc_feature: GYAE6OF01BCY9B.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggtcttaatttaaaggtgtccagtgtgaggtgcagctgctgcgagggtcggggggagtcgtttgggtaccacggtcccgggttcgggggggtcccttagggacggtaaccttccgttcccgttgtacggacctacgtcccttacgttggtaacctttcccgttaccgtttccgtaccggttacttatacggtactagttcggacggtccgggtaccggggtcccgaccggacgggtacccgtccggtaaaggggtaacggtcgggggtccgttaggggtacgggttcgggttccttaacggtaaggtttaaacgtttaaaggtaggtttagggggtaaggtaaacttaacgtaagttaaccgttacgacgtaacggtcccggttacccggtagggtaacccgggtcccgttaccgttacccggtaaccctacctaccggtacccgtaacggtaaaccgtaacttaaaaccttaaccccgaaaacgtaaccccaaacgttaccgttaacgttactaccggtaactaaccgtaaagtacgaaccgtaaccggtaccgtaacgggtaacggaaccggaccggggaaacccggtaaccggacccggtaaccctttaaacccgtttacggtttaaccgttaaaccggtaaaacgtaaaacggtaacctaaccgaacccgtaaacgtacgggtacggttaacgggaaccgggtaaacccgggtaacggtaaaccccgggg

SEQ ID NO: 122473 - DNA, 739 bp, Homo sapiens
  misc_feature: GYAE6OF01B5221.52.81.H04.1.454.CMB.1.raw
  modified_base (426)..(426): a, c, t, g, unknown or other
  misc_feature (426)..(426): n is a, c, g, or t
  modified_base (580)..(580): a, c, t, g, unknown or other
  misc_feature (580)..(580): n is a, c, g, or t
tcagcgcagtacgacacgaccggtgctcgatttagtagtgtagattcgcggggagctctgagagaggagcccagccctgggtattttcaggttgttttctatttggtgatcaggactgaacagagagaactcacagtggtagtttggctgagtcgttggttctttttcgttggtggtacttaaagtttttaaaaggtcgttaccgtagttggtggtaggtgcgagtcgttgcgtgcggacggggtggggggtacgtcgttagggtaccgcggtccgggtcgggggtccctaggacgtccgtcctaccgtggtcgcgaccgtctcggtcgtacgttacctaccgtttccggcttcttagtcgaactagtcgacgtcggtcgggtccacgtcgaccgtacgaggtaggtgggcgtgggtggtcgggtntaacggtagttagttaaggtgggttaggtaaggtaactaagtacgttaacgttcgacgtacgtacgtaccgggagtaccggtccgtacctacgactacgtactaccgagaacgtactaaacgtaacaacgaacaacgtacgtagtactacgtanaaccgtaacgtagtaacgacgtaccgtaggacgtaacggacgaccggacgtaaccccggtacttaccgtttaagttaaccgttaaggtaaacgtaaaccgaaagtaccgaaacaacggtacgacggtaacggaacggtaaccggaacggtaaacccggg

SEQ ID NO: 122474 - DNA, 956 bp, Homo sapiens
  misc_feature: GYAE6OF01E1FEO.52.81.H04.1.454.CMB.1.raw
tcagcgcagtacgacacgaccggtgctcgatttagtagtgtagattcgcggggagctctgagagaggagcccagccctgggtattttcaggttgtttttcagttttggtgatcaggactgaacagagagaactcaccagtggtagtttggctgagtcgttggttcttttttcgttggttggtactttaagtttttaaaaaggttgtaccgtaggtggtaggagggtcgcgagtcgtcgtcgttggcggtaggggttacggggggtaggtcgtttacggtaccggtacggtcccgggttcggggggttccccgtaggtaaccggtacccgttccgttcccggttcggttacggaccgttacggttccccgttacggttacgggttaccttttacccgtttacccgttttccggtccgtttacgttaacgttacgtaacgtaacggttcggtaccggtccggtttaccggggtaccccggaccggtacgggtacccgtaaccgggtaaacggggtaagggttccgggggtacggttacggggttaacgggtttccggggttaccggtttaacggttaaacgggttttaaaacgttttaaaggttaacggggtttaggggtaaacgggttaaacgtttaaacgttaaacgttttaacgttacgtaacgtaaccgggttacccggttacgggtaacgggtaaccgggtaccctttcgttaaccccgtaccgtaacgtttacccgtaaccgaaaggttaaacccgtaaaccttaacgttaaaccccggaaactaacccgttaacgtacgtttacgtataccgtacgaaataacgtacgaacgtactccggaagaacgacgaccggtaacgaccctccggacccttaacgtacgttaaggaacgtaaacaaacgttaaccacgaacacggtacgcgtaacggaacgacggtaacgaaaccgg

SEQ ID NO: 122475 - DNA, 832 bp, Homo sapiens
  misc_feature: GYAE6OF01AN6VQ.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcgaggactgaacagagagaactcacagtggaggtttggctgagtcgtggtctttttcgttggtggtacttaagttttaaaaggtcgtccgagttgtggaggtcgcgagcgtgctgcggtagggtcgggggagtcgttggtacgacggtccgggttcgggggtccctggtaacgtccgttccgtccgttggtcgaccgtacgtcccgttcgttcggttaacctttccgttacccgtttcggcgtttactagtacgacgtagtcggtacgtccgggttccgggtacccgccggtaacggtcccgtaccgggtaagggtaacggttcggggtacgttagggtacggtttaccgggtcgttaacggtaaggtttaaacgtttaaggttagggttagggtaacggtaaacttaacggttaagttacggttaaccgagtaaccggttaccggtaccggtaagggacccggttaccttccgttaaccgacccttacgtacccgtaacgacgtaaacgtaactaaccgttaaacgaaacctacgtaaaccgtcgtaacgttaccgtaacgtacgtaaacaacggttacgaaaccgtcgtaacgtaaggaaccggccgtaccggaacgtacccggtacccgtacttaacgttcgttaacggtaaacgtaacgaaacgtcctaacgtaacaccggtagaccggtaaggaaccggtaacggaaccgtaaacccggg

SEQ ID NO: 122476 - DNA, 760 bp, Homo sapiens
  misc_feature: GYAE6OF01EQ6LM.52.81.H04.1.454.CMB.1.raw
  modified_base (260)..(260): a, c, t, g, unknown or other
  misc_feature (260)..(260): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtcttgacgcagcccgccctcagtgtctcggccgccccaggtacagaacggtccaccatcctcctgctcgtaggaacgcagcctaccaactnttggactaaattaagttttgtacgttcctggtaacctaggcctaaacctcccgaggtccaaccgaccgaccccctaaacttccctacgtattttacacgtaacaacgttacgaacttaacggaccccgtaacccgtacggtaaacggggtaacctttaccccgtaacggaccccggttaattttcccggtaccgttccgggaccctttaacccgtaaacggtttccgttaccggggacccttaccgttaccggaccgtaccccgtaaccccggttcgggacctacgtacccggaacccgtaccgttacccgaacggtaccgggtacggggaacccggtacggtacccgttaacgttacgttaccgtaggaccggtaacgtaggtacggggaacttacggacgtaccggtccgtagggacgttaacggcgttacggtacggtacgggttcgggtacgggacgggtaacggtaccgtaagcggtaccggcccggttaaccgg

SEQ ID NO: 122477 - DNA, 754 bp, Homo sapiens
  misc_feature: GYAE6OF01C5U2X.52.81.H04.1.454.CMB.1.raw
  modified_base (298)..(298): a, c, t, g, unknown or other
  misc_feature (298)..(298): n is a, c, g, or t
  modified_base (685)..(685): a, c, t, g, unknown or other
  misc_feature (685)..(685): n is a, c, g, or t
tcagcgcagtacgacacgaccggtgctcgatttagtagtgtagattcgcggggagctctgagagaggagcccagcccgtgggtattttcgaggttgttttctagtttggtgatcgaggactagaacagagagaactcactagtggtaggtttggctggagtcgttggttctttttcgttgtaggtactttaaagttttaaaaggtgtaccgtaggtagtggtaggtgaccgagtcgtgcgtcggacggagggtacgggggtagtccgttcggtaccgacggtcggtccgggggtaccnggacgtaccgttcgtcgtgtcgactacgtcctgtacggtacttaccttacccgtttcgtacgttactagtacgacgtagcggaacgtcggtccggtaccgaccgacggcctacggtaggtaggtgggtcgtaggtcggtcggtacgtagtaagttacgtaagtaggtacggtagtaacgtatacgtacgtacgacgtaacgaccggtagtacggaaccggtccgtactaaccgtaccctacgttaccgacgtaaacccgtagtaaaacctaacgtaaccgtaacgtaaactaaccgtataacgtacttacgtaacgaacgtaacaacggtaaccagtaaccgtacggtaagacgacggtaccggacgtaaacccgttcgtaacgttntaacgtaacggtaaacgaaagttaaccaacgaacctaggtaccgaagcggtaaacgcgacgtaaaccgg

SEQ ID NO: 122478 - DNA, 821 bp, Homo sapiens
  misc_feature: GYAE6OF01DID5G.52.81.H04.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagcgcagtacgacacgaccggtgctcgatttagtagtgtagattcgcggggagctctgcttcagctgtgagcgcaagaaggcaggactcgggacaatcttcatcatgacctgcctccctctcctcctcctacccttctctattcacttgcacgtagggtccctcgggccagtctgtgttcgacncgacgccgcctcgacgtcgtcncgcggccaggacaggacgtccacactcnctacgctcgtggaagcacgtcctacgactagttgaacttaagtttaacgtttcggtcgttaacgtacggtaacccttaacggaacctaaccgtacccggaacggtaccaacccgtaaccccggtaaccccctaaacctcctttaacccgttatttaacggtacaaactagtaagtaacgtaaaccggtaccccggaaacttaccgggaacgggtaaccttaacccgtacggtaaaccggttaccttcggtacgtaccggtaccgttaaaccggttaacggttccggtaacggttccccgtaaccggttaccgaaccggtacccggttaccccggttacgggaaccttaaccgttacccgaacccgggtacctaacccggtaacggtacggggtaacgggaaccggtaccgggtaaccggtttaacgtttaacgttaaccgggtagtacccgggtaacagggtaacggtacgtacgtacggactacggtacgtagttacggtacggtacgcgggttaacgggtccggttaccgggaaccgggtacggtaaaccgggtaccgtacgggtccgtaaccggttacccgg

SEQ ID NO: 122479 - DNA, 857 bp, Homo sapiens
  misc_feature: GYAE6OF01E0G2Z.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagactcacatggagttggctgagctggtctttttctggtgtactaagtttttaaaaggtgtcctaggtgtaggaggtgcagctcgactgcgtagggtcgggggagtcgttggtacacggtccgggtcgggggtccctggacgtaccttccgtcccgttagtcgcacgtcccttacgtcggttacttccctacccggttttcgaccgttcttaagtcgacgtaagttcggaggtccgggtcggggtcccgaccggtacggtcccttaccggaagggttaacggttcgggggtaccgttaggggtacgggttccggggttctaacggttaaaggggtttaaagtttaaccgggtttaaggggtagggggttaaacggtaaaacgtttaaccggttaaatttaaacggttaaccgtacggtaaacggttacccgttacgggttaaccggaacggggttccccgttaccttaccgtaaccgttacgttacccgtaccgaaacgtaacgtaaactaacgttaaccgaaacgtaaaccaacttacgtacgttactacggtacaacgtaagtaccgaaccgtcgtacccgtaggaccgacggtaccggaacggtaacccgtaccggtacccttaaaccgttaccgttttaacgaacggttaaaaccggtaaacgaacgttaaccgaacgacgtaaacggacgggtaaagggaacccggtaaaggtaaccggtaaaccccggg

SEQ ID NO: 122480 - DNA, 749 bp, Homo sapiens
  misc_feature: GYAE6OF01EK6VG.52.81.H04.1.454.CMB.1.raw
  modified_base (321)..(321): a, c, t, g, unknown or other
  misc_feature (321)..(321): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccgaggaagtggggctgggagtgggtctcaggtataatagtggtggaagtacatattacgacagactccggtgaacgggccgcttcaccatcctaccaagtacgaacaattaccaaagaacacaactgttacnctagacaaaatgaacacgcgtagagacggaccgaaggaccacggaccctaaccttagttttacgaacgtaaacggaaaacgtaaacgtaacctaacgaacgaacgaccgttacgggaaacgaaaggggaaccgaacccggtaaaccgggaccgtaaccctttaacgtttaccgtttaacggtaaacccgttaacgggtacggggaaccggtaaccgggtaaacccgttcgggtacctaccccgttcgtacccgtaccgtaccgacccgtaaccacccggaaacccgggtcccgtaaccgtttcccgggttacccctttcccccgtacggtcccctaacccctcccgtacccgaaacgtaccgcccgtaacccgtcgggtacgggaccacgtacggccggtcccgtcgggacctcggccgtcggtaacg

SEQ ID NO: 122481 - DNA, 680 bp, Homo sapiens
  misc_feature: GYAE6OF01B37F1.52.81.H04.1.454.CMB.1.raw
  modified_base (544)..(544): a, c, t, g, unknown or other
  misc_feature (544)..(544): n is a, c, g, or t
  modified_base (560)..(560): a, c, t, g, unknown or other
  misc_feature (560)..(560): n is a, c, g, or t
  modified_base (641)..(641): a, c, t, g, unknown or other
  misc_feature (641)..(641): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagctgtctttttctgtggacttaagttttaaaggtgtccagtgtgaggtgcagctgctgcgtagggtcgggggagtcgttggaccgacggtccggtgggggtccctgacgtctccgtcctgtacgcgacgtccctcggtggtacttcctaccgtttccgcgttactatacgctatcggaggtccgtccgggtcccgccgacggtacgtacccggagggtaacggtggggcttgggtacggtcgggttctacgtaggttaattaaggtggtagggtaggtaagtacgtattaacgtacaacggtaccgtaccgtaccgggtggaaccgggtcctacctccaacctatcccacaaggaaccaagtaacttacccaaagacctactgttacgtactcgtanaacctaagtacgaacncgtacccagggaacgtcgacggaccgaccgtaccgaaccgtaccgttattaaccgtaacgtaaacgaaactaacgaaaccncgtaacgacgtccgaaggaccggtggaaccgaaacccgg

SEQ ID NO: 122482 - DNA, 824 bp, Homo sapiens
  misc_feature: GYAE6OF01C9FGI.52.81.H04.1.454.CMB.1.raw
tcagcgcagtacgacacgaccggtgctcgatttagtagtgtagattcgcgggcacgaccggtgctcgatttagtagtgtagattcggcggggggagcttggacagcctggggggtccctgagactctcctgtgcagcctctggattccacctttcgcgtctatgaacatgagcttcgggtcccgcaggcctcgaaggagtggggctggagtggtacctgaggttaattaagaggtggtaggaagtacatattacgcaacgtactcgtagacgggccgtcttcacctatctaccgagaagaactaacgtaccaaaagaaacctacgtacttacggtactaccgtaggtaaccaaaagtacgaaaaccgtacgacccggttaagaacggaaccgacccggaaacgggaaccaaccgggtaccctaacctttaagtttaccgttaaacggtaaacgtaaaaacgaaacttaacccgaactaaacggaccggtacgtacggggaaaaccggaaggaacccggaaacccgtaaacgggtacccggttaaccttaaaccgtttttccgttaacgggtaaacccttaccggggtaacggggtaaccccgtaaaccggggtaacccgttacgggtaccctaacccggtccttacccggtaccacgtaccctacccggaacccgaacgggtccccaacgttcccggtacccttaccccgttaccggccctaaacccccgtctaaccggaagtaccgaccctaaccggtgggtacccgggacaacccgtacggcccggtcccgaacggttcctaccggccgttcggtaaaccgg

SEQ ID NO: 122483 - DNA, 689 bp, Homo sapiens
  misc_feature: GYAE6OF01DDQNR.52.81.H04.1.454.CMB.1.raw
  modified_base (155)..(155): a, c, t, g, unknown or other
  misc_feature (155)..(155): n is a, c, g, or t
  modified_base (404)..(404): a, c, t, g, unknown or other
  misc_feature (404)..(404): n is a, c, g, or t
  modified_base (440)..(440): a, c, t, g, unknown or other
  misc_feature (440)..(440): n is a, c, g, or t
tcagcgcagtacgacacgaccggtgctcgatttagtagtgtagattcgcgggagctctgagagaggagcccagccctgggattttcaggtgttttcagtttggtgatcgaggactagaacagagagaactcacatggagttggctgagcgtggtnttttcgtagtggcttaagttttaaaggtgtccgagtgtgaggttgcagctgctgcgagggtcggggagtcttggacgcgtccggtcgggggtccctagacgtactcctcgtgtgaccagtcctcgtcggtacttccctaccgttttcgccgttacttagcggatagtacgtaacggtccggttaccggccgaccgacggtaccctccggaagtcggtgggcctagggtacgtggtacgtgtaaaggttntaaggtaggtacgtagtaagtacaagttactaacgngtacgacccggttacgaggaccgtaccgtgttacccgactacgttaccaacgagtacgtaaaccgtaacgttaccgaaacgtaccgacgttactacgtcgttaacacggtacgtaaacacggacgtaacggaccgtaggaccgtaacgtacccgggaccgacgtacccgagtacccgtattaccgtaagaaacccgttaaagaccttaaccgaacgtacacggtaacgcgaacgccggaacggtaaccg

SEQ ID NO: 122484 - DNA, 850 bp, Homo sapiens
  misc_feature: GYAE6OF01BO43N.52.81.H04.1.454.CMB.1.raw
  modified_base (262)..(262): a, c, t, g, unknown or other
  misc_feature (262)..(262): n is a, c, g, or t
tcagcgcagtacgacacgaccggtgctcgatttagtagtgtagattcgcgggggagctctgcttcagctgtgagcgcagaaggcaggactcggacaatcttcatcatgacctgctcccctctcctcctcctacccttctcattccactgcacgacgggtcctcgggccctagtcctggttagttcgacgcgacgcccgccctcgaggtcgtcgcgccgacccgaggacagagccactactcctctcgacgtacgtacggaanctacgctaccaattcgtgaactaatttacgtttagtcgtaccgtacggtaccacgtacctaaccgacctacggaccaaccgtacccgtaaccccctaacttccttactaacgtttacgacgaactaagtcgaactaacggacctaacccgaggtaacggtacgtaaccgtcgtaaccttacgttcgccgtacgtaccggtaaccgttacgtccggtacgaccgttaccgacgtaccccgtaccccgttaacgggaccggtaaccttacccgacccgggtaaacccggtccctaccggggtaacgggtaaacccggggttacgggggaccgtaaaccggtttaccccgttttaaagtttcccgtaaacccggggttacgggtaaaccccggaaggttttaacggaaggggtttaacccacggtaaaccgggttccctacgggggtttaacggaacggttaccggttaaacgggtccccgggggttaaacgggggtttaaccggttcgggggtaccccgggggaaacggggtaaacccgtaccccgggaagtttaccccgggggttaacccctccgggggtaaacccggg

SEQ ID NO: 122485 - DNA, 744 bp, Homo sapiens
  misc_feature: GYAE6OF01D4SMC.52.81.H04.1.454.CMB.1.raw
  modified_base (180)..(180): a, c, t, g, unknown or other
  misc_feature (180)..(180): n is a, c, g, or t
  modified_base (266)..(266): a, c, t, g, unknown or other
  misc_feature (266)..(266): n is a, c, g, or t
  modified_base (332)..(332): a, c, t, g, unknown or other
  misc_feature (332)..(332): n is a, c, g, or t
tcagcgcagtacgacacgaccggtgctcgatttagtagtgtagattcgcgggcacgaccggtgctcgatttagtagtgtagattcgcgggggggagcttggtacagcctgggggtccctgagactctcctgtgcagcctctgggattcacctttcgcgtctatgacatgagctgggtccnccaggctccaggatggggctggagtgggtctcaggttattaagtagtggtaggaagtacatattacggcagactcgtagacgggcncttacacctatctccaggtaacacaaattcccaaagtaacactactagtactcgtagacaaaagtnaacacgtcctagaacgagcccgaaaggaccgacggtaccccaacgtttacgtttcaacggttaaaccgaaaagtttaacaacctaagaacgacggacgttaggacgaaggaacaccgaaacgaccgaactttacgttctttaggaaccgttaccggtagggtcccgaacggggtaacccgtagggtacctaacgttccacccgtactacgaccccgttccgaacccgtaaccgggtaccctaaccgttcccggttaccgtttccccccccggtagggtacccctaacccccgttccttaacccgaacggtaaccctaccggttaaaccccgtcgggttacgggggtccccaacggttaccggaccccggtcccggttacgggtccgtccggtcccgttccgggtaaacccgg

SEQ ID NO: 122486 - DNA, 1168 bp, Homo sapiens
  misc_feature: GYAE6OF01CN10Z.52.81.H04.1.454.CMB.1.raw
tcagcgcagtacgacacgaccggtgctcgatttagtagtgtagattcgcgggcacgaccggtgctcgatttagtagtgtagattcggcggggggagcttggtacagccgtgggggtccctgagactctcctgtgcagcctctggacttctacctttcgcgtctatgacagtgacgtcgttgggtcccgccgaggtcctacccgaagggaaacgtcgggggcgtgggaaggttcgggtacctacgtaaggtttaactttaaagtaggttggggtaaggtaaagttaaccgtaattaacgtttaaccggaccgtaacggtaacccgttacccgggtaggtaaaaccggggtcccgttaccttttacccgaacccgttacgttacccttaaccccgaaaggtaaccggtaaaccttaaaacgttttaaccccgaaaaaaccggtaaacccgtaaaccccgttaaaccgtttaacggtttaaaccttacccgttaaccggtaaaaaccgtaaaaaacggttaccggtaaaaacccgtaacggttaccccgtaaaagggtaaccgggtaaaccgggacccccgggtaaacggggaaaccccggtaacccgggtaacccccgttttaaacccgttttaaaccgttttttaaccgggttaaaccgggttaaaaacccggaaaaaacgtttaaaccgtaacccgaaaaccgtaaaccgtaaccgggttaccggttacggggaaaaccgggaaacccgggaaaccggtaaacccggaaaacccgggtacccggtttaaccgtttaacccgtttttaccggtttaaccggaaccccggtttaacgggtacccggggtaacccggtaaaccggggttaaccccgttacgggttaccccttaaccccggtcctttacccgtacccggtaaccgtaccccgtaaccccgttaaccgggaaacccgggttcccccgttaaaccggttccccggtttaccccccgtttacccccggtacccggtacccccttaacccccggtaccccttaacccgaaccgggttaacccgaccccgttaacccggttcccggggtaacggggtcccctaaacccgggacccggggccccgggttacccgggttcggtacccggttcccggtacccgttaacggggttaacccg

SEQ ID NO: 122487 - DNA, 896 bp, Homo sapiens
  misc_feature: GYAE6OF01CPN3V.52.81.H04.1.454.CMB.1.raw
  modified_base (187)..(187): a, c, t, g, unknown or other
  misc_feature (187)..(187): n is a, c, g, or t
  modified_base (299)..(299): a, c, t, g, unknown or other
  misc_feature (299)..(299): n is a, c, g, or t
tcagcgcagtacgacacgaccggtgctcgatttagtagtgtagattcgcggggagctctgagagaggagcccagccctgggattttcaggttgttttcattttggtgatcaggactgaacagagagaactcaccatgggagttgggctgagcgtgtcgttttctggtggtacttaagtttaaaggtntcagtgtgaggtgacagctgcttaggcgagggtcggggggagtcggttaggtaacgcgggtccgggtgggggtccctaggacgtccttcgtccttggcgctacgtcccgttntcggttacttcccgtaccgtttccgtccggtactaatccgtaagtagtcggtgggtccgttcgggcccgaccgtacgggtaccaccgggtaaggtagggtcggggtcggttaggtagggtccgggtaaccgtaggttaaaggtttaaagttaaaggggttcgggttaagggttaaacgggtaacgtttaaacacggtttaacggttaacggaaccgtaccggttaacggtaccgggttccgggaaacggtttcccgtaccctttaacccggaaccttaaccgttaccgtaaccgaacggtaaacgtaacccgttaaacgttaaacccgtaaacccgaaacgttacccgtaaggttacttaaccgtacggtaaccgttaaaccgaaacgttaaccggaaagttaaccccggtacggttaacgggaccggtaacgggaacccgggaaccgggtacccgtaaaaccccggttacccgtttaaccgtttaacgtttaaccggttaaaacggttaaaaccggaaaacggttaaacctaacccggaacaaccggtacgaaaccgggtacgggaaacccggaacgggaaccccgtaaacccggg

SEQ ID NO: 122488 - DNA, 710 bp, Homo sapiens
  misc_feature: GYAE6OF01BP650.52.81.H04.1.454.CMB.1.raw
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
  modified_base (618)..(618): a, c, t, g, unknown or other
  misc_feature (618)..(618): n is a, c, g, or t
  modified_base (628)..(628): a, c, t, g, unknown or other
  misc_feature (628)..(628): n is a, c, g, or t
  modified_base (641)..(641): a, c, t, g, unknown or other
  misc_feature (641)..(641): n is a, c, g, or t
  modified_base (699)..(699): a, c, t, g, unknown or other
  misc_feature (699)..(699): n is a, c, g, or t
tcagcgcagtacgacacgaccggtgctcgatttagtagtgtagattcgcggggagctctgagagaggagcccagccctgggtatttttcaggttgttttcattttggtgatcaggactgaacagagagaactcacatggtagtttgggctgagcggtgtcgtttctagngntatttaaaggntcagtgtagngtgacgngntagctgacgagggtcgggggangttacggacacggtccggtcggggtacctaggagccttctcgtggcacacgtccttagcgtacttaccctacgtttcnccgtttacagttacgactaagtcgcggtcggaacggttcccgacgaacggtcctaaccggaggtaagtgggtcgtaggtacggttgttaacgtacgttaaggtttaacttaaggtaaggtcggggtaagtaaaccgttggtaaaacttcgtaaccggtacgtagttaaacccggacgggtttaagaaccgggtcccgtaacccggtttaccaacgttactaccgttaacccgaaaggtaacgtaacctaacgttaaccgaaaccgactaaaccggtccttaagtactaaccgtagaacctaagactaacacgtacgnggaacgtacncccggaagtaccncaaccgttctacgtcgtaacgaacaagtaactactagactacgggcaagggtaaccgngacggttaacc

SEQ ID NO: 122489 - DNA, 782 bp, Homo sapiens
  misc_feature: GYAE6OF01B1ZM6.52.81.H04.1.454.CMB.1.raw
  modified_base (237)..(237): a, c, t, g, unknown or other
  misc_feature (237)..(237): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggtagtttggctgagcgtgtcttttcttggtggtacttaagttttaaaggtgtaccgagtgtgaggtgcagctgctgcgtagggtggggagtcgttggtaacnggtccggtcgggggtccctaggacgtacgtcctccgtggtcgcgacgccttcgtaggtacttcctacctttccgacgttcctaatcgactagtcgacggcgttcgggacccgccgtacggcctacggagggaacgttggggctagggtcggtacggtcgtacgtaaggttacgttaagtaggtaggtaaggtagtaaccgtaagttaacgtaccggacgtaaggtaccgtccgggtaaggtaaccggggtcctaccgttaccgaaccgtaccgtttacccgaaccggtaagtaacccggtaaactaaacccgttttaaccggaaaacgtaacccctaacgtaaccgttacttaacggtaccgttacgaaaccgtaacgttaaccgaaacggacgtacccgaaggtaaccggaaccgggaccgtaacggacccgtaaccgggtaccctaaacccgtttcggtttaaccgtacgggtaaaaccaaaacgttacgtaaccacgtaacgtaacggtcgtaaacggaggaccgggtaacctaaacccggg

SEQ ID NO: 122490 - DNA, 760 bp, Homo sapiens
  misc_feature: GYAE6OF01CN0C5.52.81.H04.1.454.CMB.1.raw
tcagcgcagtacgacacgaccggtgctcgatttagtagtgtagattcgcggggagctctgagagaggagcccagccctgggattttcgaggttgttttcagtttggtagatcaggactgaacagagagaactcacagtggtagttggctgagtctggttcttttcgtgtggtacttaagtttaaaggtgtccgtagtggtgaggtgcgagcgtgcgtggccggagggtcgggggtagtcgttagggtaccgacggtccgggtacggggtccctagacgtcgttcctcgtcgtcgcgtaccgtccgtgttacgtacttaccctaccgtttcgacgttacgtagtacgaacgtgtacggtcggtaccggtccggtacccgaccgacggacctacgggaaggtagggtccgggtagtagggtgtacggtctaggtaagttataaggtaggtcggtaagagtactagtacgtacgcgtaacggtcgttacggaaccggacggtacccgtaccgtaccgtactaacgtacccgtaacgaacgtaacgaaaccgttaaacgtaccgtaaacgaacctaacggtactacggttaacctacgacgtaaacgtaacgtaaacgtaccgacggttaacgacggaacggtaccggaaccggccgtaacccgaaccgttaaccgtacctttaaggtaccgtaaaacggtaaactaaacggacctaaccgaagtaccgaagtaacggacggacgtaacggaccgtaaaccggg

SEQ ID NO: 122491 - DNA, 736 bp, Homo sapiens
  misc_feature: GYAE6OF01B2ZOC.52.81.H04.1.454.CMB.1.raw
  modified_base (152)..(152): a, c, t, g, unknown or other
  misc_feature (152)..(152): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
  modified_base (389)..(389): a, c, t, g, unknown or other
  misc_feature (389)..(389): n is a, c, g, or t
tcagcgcagtacgacacgaccggtgctcgatttagtagtgtagattcgcggggagctctgagagaggacgcccagcccgtgggtattttcaggttgttttctagtttggtgatcaggactgaacagagagaacctcacagtggtaggttggntgagtcgttggttcttttcgtaggtgtactttaaagtttaaaggtcgtcgtaggtgtaggtgtcgacgagtcgtgcgtgggacgggtaggggtcgggggtagtcggttaggaccgtcggtccgggttccgggtcctaggacgtcctcgtcgtgcncgcgtctgtgtactctacgttcgcgtanatcgatgtacggcgtcggtccggcccgtcgacgtcgtaacggaggtaggtcggngttgggaggtggtactaggtaagttaagtagtgggtaaggtagaatactagtaacgtacgacgtacgtcgtacggagggaccgtccgtctaaccgctaacgtccgtacgaagtaactaaaccgtaacctaaaccgaactaaaccgtacctagttaacgacgtaactaacgaactaaagcgaaaccgtcgaaacggtacgaacgaacccgggtacgtaaaccgggtaccgaacccggtaaccttaaacggtttaaccgttaaacgaacgtaaaaaaccgtacgaaacgtaaccgaacgtacggaccggtagggaaaccggacggaaaccgggtaccgtaaaacccggg

SEQ ID NO: 122492 - DNA, 650 bp, Homo sapiens
  misc_feature: GYAE6OF01A66QA.52.81.H04.1.454.CMB.1.raw
  modified_base (317)..(317): a, c, t, g, unknown or other
  misc_feature (317)..(317): n is a, c, g, or t
  modified_base (413)..(413): a, c, t, g, unknown or other
  misc_feature (413)..(413): n is a, c, g, or t
tcagcgcagtacgacacgaccggtgctcgatttagtagtgtagattcgcgggggagctctgagagaggagcccagccctggggattttcagggtgttttcatttggtgatcaggactgaacagagagaactcaccatggagtttgggctgagctggtcttttctgtggctaattttaaaggtgtcagtgtgaggtgcagctgctggcaggtcggggggagtcttggacaggccggtgggggtcctgacgacttctcctgtgcacgcctctggtacttcctacctttcgcgttctatgacatgacgtcgtcgggtccncgacggtcctacgagggtaagtggggctggggtagtgggtactacgtaggttaattaagtgtaggtacggtaagtaactattacgtaacgcgtaanaccggtccgtagggaacgggtccctacgttaccacctactcctaccgaagtaacgaactaagttacccaaacgtaacaaccgtactacgtatactagaacaatagaacgacgtcgtaagacgacggacgacggaaccgcccgtaaccgttaccttagtttaccgtaagtaaacggaaaactacgtaaaccaacgtacacggtacggacgggaacggtaaggaacccggtaacccggg

SEQ ID NO: 122493 - DNA, 801 bp, Homo sapiens
  misc_feature: GYAE6OF01CI23S.52.81.H04.1.454.CMB.1.raw
tcagcgcagtacgacacgaccggtgctcgatttagtagtgtagattcgcggggagctctgagagaggacgcccagccctgggattttcagggttgttttcatttggtgatcgaggactgaacagagacgaactcaccatggtagtttgggctgagctggtcttttcgtgtacggtctttaaatttaaaggtgtcctaggtgtggaggtgcagccgtgctgacggagggtcgggggagtcgttgggtacaggtcggtcgggggtccctggaagtcttccgtcctgtcgcacgtcctacgtcggtattcccgtacctttccgacgttctaagtgaaccgagttacggacgtccgggttacggaccccgcggaacggtcccgtaacggaacgggacggttgggacggttagggaaggtcggtaacggttacgtaacggttaagttaaggtaggtagggaagttaaacgtagtaaccgtttaagtaccgacgtacggtacgtaccggtacgggtaaacggtccccgtacgttaacccaccgtaaccgtcctacgaacggtaaacaaccgttaaacttacccgaaaacgtaccgtaaacccagtttacgtaaccttacgataaacccgtaagtaacctaacggaccggttacgacggaaggttacccgacggtaacctacccgggaccgttaacccggtaaactttgttaaccccggaaacgtaaacggtaaacctaaacggtaacctaaccccgtaaagtacccgggtaacgttacgggacggtaaagggtacccgaaaacccgg

SEQ ID NO: 122494 - DNA, 718 bp, Homo sapiens
  misc_feature: GYAE6OF01A0508.52.81.H04.1.454.CMB.1.raw
  modified_base (193)..(193): a, c, t, g, unknown or other
  misc_feature (193)..(193): n is a, c, g, or t
  modified_base (256)..(256): a, c, t, g, unknown or other
  misc_feature (256)..(256): n is a, c, g, or t
  modified_base (578)..(578): a, c, t, g, unknown or other
  misc_feature (578)..(578): n is a, c, g, or t
  modified_base (636)..(636): a, c, t, g, unknown or other
  misc_feature (636)..(636): n is a, c, g, or t
tcagcgcagtacgacacgaccggtgctcgatttagtagtgtagattcgcgggggagctctgcttcagctgtgagcgcagaaggcaggactcgggacaatcttcatcgatcgacctcgcctcccctctcctcctccacccttctctattccactcgcctacgtagggtccgtcggccctagtctgtgtcggacncgacgccgcctagtcgtcgtccgcggccgacccaggacacggaacgtccacgacttcctccgntcctacgtacggaactcacgtcctacgtaacgtacgttacggaacttaaagtttacgtttcggtaccgtaccggtaggtaaccgacgtaccgtaaccgtacccggacgaccctaacccgtaccccgtaccccctaaacttaccctagtttaactttaacggtacggtaaacttaagtacgtaacgtaaccggtacccgtaccgtaggaacggttacctacccggtacggtacctagttccgtacgtaccgtaactaccgtagtacccgtacgtaccaccgtcgaccgacccgtacgtcggactaaccgtccgaccggtaccncggacgtacgggtacgggacgtacggaaccgttagtaccgtacggtacggacgtacgngttacggacacgacgtacgacgtgaacgtgtcggtgcggtacggtcggaacggtccggaacgtcgacgctacggtccgtacg

SEQ ID NO: 122495 - DNA, 796 bp, Homo sapiens
  misc_feature: GYAE6OF01EA9LI.52.81.H04.1.454.CMB.1.raw
  modified_base (253)..(253): a, c, t, g, unknown or other
  misc_feature (253)..(253): n is a, c, g, or t
  modified_base (755)..(755): a, c, t, g, unknown or other
  misc_feature (755)..(755): n is a, c, g, or t
tcagcgcagtacgacacgaccggtgctcgatttagtagtgtagattcgcggggagctctgagagaggagcccagccctgggatttttcaggttgtttttctattttggtgatcgaggactagaacagagagaactcacagtggtagtttgggctgagcgtgttctttttcgttggtggtactttaaagttttaaaaggtcgttaccgtaggttggtaggtaggtgcgtagtctgcgtgcggagggtcgggggngtcgttggacgacggtccggtcggggtcctgacgtctcgtcgtgtcgcgacgtcctgtgtcttccgttccgttcgcgtctagtgacagtgcggtcggtccggcccgaccgtacggccgtacggagggtacggtcggggtacgtagggtacggttacgggttaccgtaaggttaaggttttaagttaacgggttagggttagggtaaacggtaacgtttaacgtaaacgtttaacgtaacggtaacgtaaccggttacggttacccgggtaacgggtaaccgggtcccgttaccttaacccgaccgttaccgtaccaacccggtaaaggtaaacctaaaccgtaaccgttaaaccgaaacgtaacccgtaaacttacgtacgttaagtaccgtaacgtaactaaacgtacgaacgtacgtacgtaacggaacgacggaaccggacgaccgtaccgtaccttacggttaacttacggaaaccgtaaacaagtaaccaccgaaanccggtaacgtacgggaagaacggtacggaacccgtaaacgg

SEQ ID NO: 122496 - DNA, 803 bp, Homo sapiens
  misc_feature: GYAE6OF01AXJKI.52.81.H04.1.454.CMB.1.raw
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
tcagcgcagtacgacacgaccggtgctcgatttagtagtgtagattcgcggggagctctgagagaggagcccagccctgggattttcaggttgttttcatttggtgatcaggactgaacagagagaactcaccatggagtttgggctgagcgtgtctttctagtggctatttaaaggntcagtgtgaggtgnagctgctgcgaggtcgggggagtcgttcggtacacggtccggtcggggggtccctaggacgtacctccgttccgtgtacgcgacgttccgtacgtacggtactttaccgtaccgtttacgccgttcttaagtccgaactagtcgacggtccgttcgggtacccgaccgacggtcctacccggaagggttaaccgggtcggggtcgtagggtacggttcgggttacgtacggttaaggtttaaactttaacggtagggttacgggtaacggtaaacgtttacgtaaacgtttaacgttaccggacgtaaaccggttacccgttccgggtaaccgggtaccggttcccgtacccgtttacccgaacccttaccttaccgttaacccgaaggtaaaccctaaccttaacgttaaacccgaaacgtaaccctaacgttaccttacgttaccgtacttacgaacctaaacgtacgaacgtcggtaccgtaggaaccgaccgaacggaccgtaaccgccggtaccttacccggttcgttaaacctacggtaaacgtaacgtaaactaccgaccgtacgaacgttccggaaagggacgtaaaccgggctaaacccggg

SEQ ID NO: 122497 - DNA, 759 bp, Homo sapiens
  misc_feature: GYAE6OF01DFKCA.52.81.H04.1.454.CMB.1.raw
  modified_base (155)..(155): a, c, t, g, unknown or other
  misc_feature (155)..(155): n is a, c, g, or t
  modified_base (287)..(287): a, c, t, g, unknown or other
  misc_feature (287)..(287): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggtagttggctgagcgtggtnttttctggtggcttaatttaaaaggtgtccagtgtgaggtgcagtctgctgcgaggggtcggggggagtcgttagggtacacgggtccggtcggggggtccctaggacggtacttccgtccgtggtcggccncgtcctcgttacggtaactttcctccgtttcgtcggtctacgtgtactaagtggtcggtccgttcggggtcccgccggtacggccgtaccggaagggtaacgggtcggggtacgtgggtagttgggtcgttacggtaggttaagttaaggtagggttacggtaaggtaagtactaagttagtacgacgtacgtacggtcgtacgggtacgggccctcgttccacctacttacccgacgtaacgtaactaacgtaacctaacctaaacgaaccgttaactaaccgttataccgtaactacgaaccgtaaacgtaacgaaaccgaccgttaccgggacggtaacgggaccggaccgggaccgaacggtaacccgtacccgtacttacggtttaacgtacggtaaaacgaataaaccgaacctacgaaccgtacggtaacggtaacgggaacggtaacggaacgtaaaccccggg

SEQ ID NO: 122498 - DNA, 686 bp, Homo sapiens
  misc_feature: GYAE6OF01EBMRR.52.81.H04.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (370)..(370): a, c, t, g, unknown or other
  misc_feature (370)..(370): n is a, c, g, or t
  modified_base (608)..(608): a, c, t, g, unknown or other
  misc_feature (608)..(608): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagcccgccctcagtcgtctcggccggccccaggacaggagtccaccatctccngctcgtaggaancagcctaccaactagttcggactaaatttattttcgtcgttacccgtaggtaaccaggacctaaacccgtcccgagggacccaaccgtacccgaacccccctaaactccccttaacgttaattttanacgtaactaagttaggaaacttaaccggcccgtaacccgttacgaaccggggtaacttacccggtaacggaaccttactttacccgtcgtcggcccttaacgtacgtcgtcggactacccggtacaccgtccccgtcccgtaggccctagcccgaccgacctccgaggtaccggtacggggaccaggtaccgtatttacgtacgtacggacgaacgtagtagggacagtccaggtacnggtacggtatacgggtcgaccgggttggggcggttcgggaacgggtaaggaccgtacgtcggccggtaccggtaccgg

SEQ ID NO: 122499 - DNA, 915 bp, Homo sapiens
  misc_feature: GYAE6OF01B2SPG.52.81.H04.1.454.CMB.1.raw
tcagcgcagtacgacacgaccggtgctcgatttagtagtgtagattcgcggggagctctgagagaggagcccagccctgggatttcaggtgtttcattggtgatcaggactgaacagagagaactcacatggagtttgggctgagcgtggtcttttcgtgtggtacttaagttttaaaggtgtccgagtgtaggaggtgcgagcgtgcgtgcgtagggtcgggggagtcgttcggtacacggtccggtcgggggtccctggacgtaccgttcgtccgtaggtcgaccgtacggtcccttcgtacggtactttacccgtaacccgttttccggaccggtttacttaaaggttacggtaacgtaacgttacgggtaccggtccgggttaccgggggtccccggtaccggaaccgggtcccggttaacccgggtaaaggggtaaccgggttcggggggtacggttacgggggtacgggttccggggttaaccgttacggtaaacggggtttaacgtttaaaggggttacggggtttaaggggttaaacggggtaaaacgtttaacccgtaaacggtttaaacggtttaccggaaccgtaaacggttaccccggttaccgggggttaaccggaaccggggttcccccgttacttaaccccgtaaccgttaaccgtacccgttaaccgaaacggtaaccgtaacggtaaacctttaccgaaacggtaaaccctcgtaaacttcgttaacgtcgaacgtaactaaacggttcggaaacctccgggtacccgtaaggtacgggaaccgtaccggacggtacccgacccggttacttaacccgttagtttaaccgtaacggtaaacgaaaacgtactaaccgaacgtagcggttacgaaggcggaaacgccggtaaaccccgg

SEQ ID NO: 122500 - DNA, 733 bp, Homo sapiens
  misc_feature: GYAE6OF01BMGMT.52.81.H04.1.454.CMB.1.raw
  modified_base (55)..(55): a, c, t, g, unknown or other
  misc_feature (55)..(55): n is a, c, g, or t
  modified_base (122)..(122): a, c, t, g, unknown or other
  misc_feature (122)..(122): n is a, c, g, or t
  modified_base (256)..(256): a, c, t, g, unknown or other
  misc_feature (256)..(256): n is a, c, g, or t
  modified_base (434)..(434): a, c, t, g, unknown or other
  misc_feature (434)..(434): n is a, c, g, or t
tcagcgcagtacgacacgaccggtgctcgatttagtagtgtagattcgcgggganctctgcttcagctgtgagcgcagaaggcaggactcgggacaatcttcatcatgacctgcctcccctntccctcctcacccttctcattcactgcacgtcgggtccgtcgggcccagtcttggttgttcgacgcgacgtcccgccctgagtcgtccacggccggccccaaggacgaagacggtccacctacgttccctcgtntccgttcggaggaacgccacggtccctaaccaaagtgttacggacttaaatttacgttttcgtcgtccgtaacggttaccaacgtcctaaaccgtccgtacggaaccaacctaccccgaaaccccctattccctattactttacagaactagtagactaacgcccacgtagacgtacncgtacgtactacgttactcgacgtacctacggtaaccttcgacgtaccgtacccgtaccgacccgcccgggttacgacgggtaccaccgttaccccggaccgttacgtaaccggacggtaccgggtaccggggaccgttaccgtaaccgtttagttaacgttacggtaaccggagttaacgacggtttagacgacgtcgacgttcggagtacggtagtcgggttaacgtcggggtcggtaccggggtcgggaacggggtaacccacggtaaccggccgttaccgggttccgtaacccgg

SEQ ID NO: 122501 - DNA, 694 bp, Homo sapiens
  misc_feature: GYAE6OF01B84JM.52.81.H04.1.454.CMB.1.raw
  modified_base (237)..(237): a, c, t, g, unknown or other
  misc_feature (237)..(237): n is a, c, g, or t
  modified_base (577)..(577): a, c, t, g, unknown or other
  misc_feature (577)..(577): n is a, c, g, or t
  modified_base (585)..(585): a, c, t, g, unknown or other
  misc_feature (585)..(585): n is a, c, g, or t
  modified_base (594)..(594): a, c, t, g, unknown or other
  misc_feature (594)..(594): n is a, c, g, or t
  modified_base (640)..(640): a, c, t, g, unknown or other
  misc_feature (640)..(640): n is a, c, g, or t
  modified_base (665)..(665): a, c, t, g, unknown or other
  misc_feature (665)..(665): n is a, c, g, or t
tcagcgcagtacgacacgaccggtgctcgatttagtagtgtagattcgcggggagctctgagagaggagcccagccctgggattttcaggttgttttcatttggtgatcgaggactgaacagagagaactcacatggtagtttgggctgagctggtctttttctggtgacttaagttttaaaggtgtaccagtgtgaggtgcagctgctgcggagggtcgggggagtcgttggtacncggtccgggtcgggggtcctggacgtcttccgtcgtggtcgccgacgtcccgttgtacggtacctttccgtacccgtttccggtccgttacctaagtcgaacgttagtacggacgttccgggttaccggggtcccgccggtaaccgggtccctaccgggaaacgggtacgggttcgggggcgttggggtacgggtccgggtttacctacggttaaagggtttaactttaaggtacgggttagggtaacgtaagtaactattacgtaccgacgtacgtacgtcggtaggaccgtcgtcctacactctccgacagactactaacgtaccaacactacacgtntactctanaacaacganaccgacgtctagaacggcgaacggacgaccgaccgtacctaccgtntaacgtacgaaagtaacaaacacanacgcgacgaggacgacggacgtaaaccgg

SEQ ID NO: 122502 - DNA, 926 bp, Homo sapiens
  misc_feature: GYAE6OF01C6PTD.52.81.H04.1.454.CMB.1.raw
  modified_base (260)..(260): a, c, t, g, unknown or other
  misc_feature (260)..(260): n is a, c, g, or t
  modified_base (898)..(898): a, c, t, g, unknown or other
  misc_feature (898)..(898): n is a, c, g, or t
tcagcgcagtacgacacgaccggtgctcgatttagtagtgtagattcgcgggcgacgaccggtgctcgatttagtagtgtagattcggcggggggagtcttggtacagtccgtcgggggtcctgacgacctctccgtgtcgcacgtcctcgtggtacttcctacctttcggcgttactatacgactagtggacgtcgtcgggtccgcaggcctacgaagtaggtcgggtcgtaggtaggtggtcctagaggttattaagnggtaggtacgaacgtatagttactacgactacggtaaccgtccgggtaaggaccggccttacttaccgactactacaccgaagacgaacttaacgacaaacgacacgtattacgacttcacgactaaagacgactaacggccgtaaggacggaccgtaccggaaacggtacccgccgttaaccccgttaattttacgtaacccggttaaaaggtaaaaccgaaacgtttaaactacccgtaaacggaaccggtacggttaaccgggtacggggaaaaaccggaaccggggaaaccccgtttaaaccggggaaacccggtttaccttaacccggttttttaaactttcgggtaaacgtaaccccggggttacgggttaaaccggggtaaccgggtaacggtttacccgttaaccgggtttaccccggaacccgtttccccgttaccccttaccgtacccgtaccccgttacccgtaacccggaaacccgggttacccggcccgtttaccggtttcccccgttaccccgttccccgaccggtaccccctttaaccccgaccgtaaacggacccgttcccgaaccccggtttagggacgggtacccgaacccgttcggaaccccggttcccgggttcccgnggtacccgccgggttacccgttaacggg

SEQ ID NO: 122503 - DNA, 811 bp, Homo sapiens
  misc_feature: GYAE6OF01AGKRA.52.81.H04.1.454.CMB.1.raw
  modified_base (348)..(348): a, c, t, g, unknown or other
  misc_feature (348)..(348): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagttggctgagctggtctttttcgtgtggtcttagttttaaaaggtgtccagtgtgaggtgcgagctgctgcgtaggtcgggggagtcgttaggacgacggccggttcgggggtccctggacgtaccgtccttccgtgtcgcgacgtccgtcgtcggtacttaccgttaccgtttcgcgttactagtcgactagtcgacgtccgtcgggtccncgtaggccgtaccggaggtaacggtcggggtcggtagggtacggttcgggtaccgtaaggtaacggtttaaagtttaaggtagggttagggttaacggtaaacgttacgtaaagtttaacgttaaccggaacgtacgttaacccggttaccgggtacggggtaacccgggtacccgttacccgtttaaccccgaaaccgtttacccttaacggtaaccccgtaaaacggtaaaaccgtaaaccttaaacctttaaaccggaaaaccgtaacccttaaccgacgtttaacgtacttaaccgtaagaaaccttaaacgtacggaaaccgaccgttaccgtaaggaaccgtaccggaccggaccggtaccgacccgtacctaacgtttacgtaccggttaaacgaagtaaaacgtactaaacccgagtaacgcggacgtaacggacggaaaccgcgtaaaacccgg

SEQ ID NO: 122504 - DNA, 542 bp, Homo sapiens
  misc_feature: GYAE6OF02HZ6GB.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggcgttttctaggtggctattttaaaaggtgtccagtgtgaggtgcagctgctgcagtcgggggagcttggtacagcctggggggtccctgagactctcctgtgcagcctctggattcacctttcgcgtctatgacatgagctgggtccgccaggcctccgaggaacgtggggctggagtgggtctcgaggttattaagtagtggtaggaagtacatattacgcagactccgtgaagggccgcttcaccatctccagagacaattccaaagaacacactgtactctagacaaatgaaacagacctagaagacgccggaaggaccacggcccacttactttccgtagtaaccgaaagaatacaacacacgctaggaacgaggacgaaccgg

SEQ ID NO: 122505 - DNA, 511 bp, Homo sapiens
  misc_feature: GYAE6OF02IGDGR.52.81.H04.1.454.CMB.1.raw
  modified_base (368)..(368): a, c, t, g, unknown or other
  misc_feature (368)..(368): n is a, c, g, or t
tcagcgcagtacgacacgaccggtgctcgatttagtagtgtagattcgcggggagctctgagagaggagcccagccctgggattttcaggtgtttcatttggtgatcaggactgaacagagagaactcaccatggagtttgggctgagctggcttttcttgtggctattttaaaaggtgtccagtgtgaggtgcagctgctgcagtcgggggagcttggtacagcctggggggtccctgagactctcctgtgcagcctctggattcacctttcgcgtctatgacatgagctggggtccgccaggcctccaggaatggggctggagtgggtctcaggtattaagtagtgggtggaagtacatattacgnagactctgtgaagggccgcttcaccatctccagacgacaattccaagaacacactgtatctagcaaatgaacagcctgagacgccgaagccacggccacctatttcagtaacgaaagaactacacacagctaggacgagaccg

SEQ ID NO: 122506 - DNA, 523 bp, Homo sapiens
  misc_feature: GYAE6OF02I7DSO.52.81.H04.1.454.CMB.1.raw
tcagcgcagtacgacacgaccggtgctcgatttagtagtgtagattcgcggggagctctgagagaggagcccagccctgggatttcaggtgttttcatttggtgatcaggactgaacagagagaactcaccatggagtttgggctgagctggcttttcttgtggctattttaaaaggtgtccagtgtgaggtgcagctgctgcagtcgggggagcttggtacagcctggggggtccctgagactctcctgtgcagcctctggattcacctttcgcgtctatgacatgagctgggtccgcaggctccaggaatggggctgggagtgggtctcgaggttataatagtggtggaagtacatatacgcagactccgtgaacgggccgcttcaccatctccagagacaatccaagaacacactgtatctgacaaatgaacagcctagacgacgccgaggaccacggacccaccttattcgtagtaacgaaagaactacacgaccagaccgtggacgaggagaacccgg

SEQ ID NO: 122507 - DNA, 524 bp, Homo sapiens
  misc_feature: GYAE6OF02IFXTR.52.81.H04.1.454.CMB.1.raw
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtgtttctagtggctatttaaaggntcagtgtgaggtncagctgctgcagtcggggggagcttggtacagccgtggggggtccctgagactctcctgtgcagcctctggattcaccttttcgcgtctatgacatgagctggggtccgccaggctccaggatggggctggagtgggtctcgaggtaattaagagtggtggaagttacatattacgctagactccgtgaacgggccgcttccaccatctccagagacaattccaaagaacacaactgtatcctgcaaatgaaccagacctgagagccgaggacaccgggccaccgtatttcagttaacaaagaactacacaacagcctaggacgaggagaaccg

SEQ ID NO: 122508 - DNA, 540 bp, Homo sapiens
  misc_feature: GYAE6OF02GKC7M.52.81.H04.1.454.CMB.1.raw
  modified_base (305)..(305): a, c, t, g, unknown or other
  misc_feature (305)..(305): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtcgtttctaggtggctattttaaaaggtgtccagtgtgaggtgcagctgctgcagtcggggggagcttggtacagccgtggggggtccctgagactctcctgtgcagcctctggattcaccttttcgcgtctatgacatgagctgggtccnccaggcctccgaggaatgggggctgggagtgggtctagaggtattaagtaggtggtaggaagtacatattacgcagactccgtgaacgggccgcttcacctatctccagagacaattccaagaacacactgtactctgacaatgaacagccgtagagacgccgacggacgaccgcctactattcgtacgtaacgaaagaactacaaccacgacgctagggacgaggacgaacccg

SEQ ID NO: 122509 - DNA, 508 bp, Homo sapiens
  misc_feature: GYAE6OF02FN5E5.52.81.H04.1.454.CMB.1.raw
  modified_base (385)..(385): a, c, t, g, unknown or other
  misc_feature (385)..(385): n is a, c, g, or t
  modified_base (503)..(503): a, c, t, g, unknown or other
  misc_feature (503)..(503): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcgggggaggcttggtacagcctggggggtccctgagactctcctgtgcagcctctggattcacctttcgcgtctatgacatgagctgggtccgccaggctccaggatggggctggagtgggtctcaggtattaagtagtggtggaagtacatattacgcagactccgtgaagggccncttcaccatctccagagacaattccaagaacacactgatctagcaaatgaacagcctgagagcgaggacacgccactattctgtaacgaaagaactacacacagccgtggacgagganaaccg

SEQ ID NO: 122510 - DNA, 566 bp, Homo sapiens
  misc_feature: GYAE6OF02GQUTZ.52.81.H04.1.454.CMB.1.raw
  modified_base (349)..(349): a, c, t, g, unknown or other
  misc_feature (349)..(349): n is a, c, g, or t
tcagcgcagtacgacacgaccggtgctcgatttagtagtgtagattcgcgggcacgaccggtgctcgatttagtagtgtagattcgcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaatccaagaacacactgtatctgacaaatgaacagcctgagagccgaggacacggccacctattcngtaacgaaagaatacacacagctggacgaggacgaccaacggcgactacttcttgactacgtggggaccacgggaaccctggtccaccgtctcctcacgcctaccaccgaacgggcccatccggtccttccccgtcggcccacccgtccctacccgacgacgcctacccgtcgtcggggccacgcgaccggcccgtcggccgtcgtccgtggtaccg

SEQ ID NO: 122511 - DNA, 539 bp, Homo sapiens
  misc_feature: GYAE6OF02IAWXJ.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcgggggagcttggtacagcctggggggtccctgagactcgtcctgtgcagcctctggattcacctttcgcgtctatgacatgagctgggtccgccaggctccgaggaatggggctgggagtgggtctcgaggtattaagtagtggtggaagtacatagttacgcaagacctccgtagaacggggccgtcttcgaccatctccagagacaattccaaagaaccacactagtatctagacaaatgaacagcctgacgagccgaggacacgccaccttattacgtagtaacgaaacgaactaacacacacgacgtaggacgacggagaacccgg

SEQ ID NO: 122512 - DNA, 646 bp, Homo sapiens
  misc_feature: GYAE6OF02HTS2U.52.81.H04.1.454.CMB.1.raw
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattggcaataatttgtgtcctggtacagcaactcccaggcacacgcccccaaactcctacatttatgacaatgattaacgccgaccctcgagggtactaacccgtgaccgtattttctggcctaccaagtctggctaggtcacgccacccgtgggctactccgaccggactccgagaccgtgggaccgacggacgggtacccgtaatttaacgttaaccgtggaccgacctaagttccgaaggttacggggaacgttcggggacctaacgggtaaccccttaaaacgaccggttacggtacgggtaccttaacgggtttacccggggaccggggtaaccgggggtaacccgttaaacggggttttaccggtaaccccggtttacccggttaaaccggggg

SEQ ID NO: 122513 - DNA, 514 bp, Homo sapiens
  misc_feature: GYAE6OF02G8BTY.52.81.H04.1.454.CMB.1.raw
  modified_base (440)..(440): a, c, t, g, unknown or other
  misc_feature (440)..(440): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaagcagctccaacattggcaataattttgtgtcctggtaccagcaactcccaggcacacgcccccaaactcctcatttatgacaatgaataagcgaccctcagggactacctgaccgtattcctctggctccaagtctgcacgtcagcccacccgtgggcatccgaccggactccgagactggggacgacggccgaattacttacnggaccgaacagtgggatagcagcctagagtgatcggccagggtcgtcggcggacggaccaggcgtgaccgtccg

SEQ ID NO: 122514 - DNA, 548 bp, Homo sapiens
  misc_feature: GYAE6OF02FWCD2.52.81.H04.1.454.CMB.1.raw
  modified_base (335)..(335): a, c, t, g, unknown or other
  misc_feature (335)..(335): n is a, c, g, or t
  modified_base (435)..(435): a, c, t, g, unknown or other
  misc_feature (435)..(435): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattggcaataattttgtgtcctggtaccagcaactcccaggccacagcccccaaactccctcatttatgacaatgaataagcgaccctnaggatacctgaccgattctctggctccaagtctggcacgtcagccacccgtgggcatccaccggactccagactcggggacagggcctaattacttacgngaccggaaacagtaggggatacggcacggtcctagaggtgaagttcggcccgtaaggggtttcttacggggcgggaacgggacccgaaggccgttacgggacccgttacccgg

SEQ ID NO: 122515 - DNA, 607 bp, Homo sapiens
  misc_feature: GYAE6OF02IZXF5.52.81.H04.1.454.CMB.1.raw
  modified_base (152)..(152): a, c, t, g, unknown or other
  misc_feature (152)..(152): n is a, c, g, or t
  modified_base (261)..(261): a, c, t, g, unknown or other
  misc_feature (261)..(261): n is a, c, g, or t
  modified_base (365)..(365): a, c, t, g, unknown or other
  misc_feature (365)..(365): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgngtgtttctaggtggctatttaaaaggtgtccagtgtgaggtgcagctgctgcagtcgggggaggcttggtacagccgtggggggtccctgagctctcctgtgcagcctntggattcacctttgctctatgacatgagctgggtccgaccaggctaccgaggatgggctggagtggtctgaggttatagtagtgggtggatacagtaattacgnagactccgtgaacgggcctacttcaaccgtatcctaccgaggataaccgaatttacccaaagaacctaacacgtttagtatcccgttagacctaaatcgaaacacggaccgtaggaaggacccgtaccggaaacggaccgaacccgggaccctactttaagtttaccggttacgttaaacgggaaactaacttaacccaacgaacccgaggtaccgacgggaaggaccggaccgaaacccgg

SEQ ID NO: 122516 - DNA, 574 bp, Homo sapiens
  misc_feature: GYAE6OF02IZGMI.52.81.H04.1.454.CMB.1.raw
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (405)..(405): a, c, t, g, unknown or other
  misc_feature (405)..(405): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgttctaggtcggctaattttaaaggngtcagtgtgaggtgcagctgctgcgaggtcgggggagtcttaggcagccgtgggggtccctgagctctcctgtgcagcctnggacttcacctttgctctatgacagtgngtctggtccnccgaggcctaccgaggaatggggctgggngtgggtctcgaggttattaagtcggtagggtaggaattacattaagttacgcaaggcctcggtaggaacgggtccnttccacactcgtaccagacacaacttccaaagacacgtactacgtattcgataaccaatacgaacacgaccgtagacgacgcgacgaacgaccgacctaccgtacttacgtacgttaacgaaacgaaactaacaacaacgacgacgacggtaacggacggacgaaccgg

SEQ ID NO: 122517 - DNA, 577 bp, Homo sapiens
  misc_feature: GYAE6OF02H75F8.52.81.H04.1.454.CMB.1.raw
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcaccttttcgcgtctatgacatgagctgggtccgccaggctccaggaatgggggctgggagtgggtctcaggtattaatagtggtggaagtacatattacgcagactcgtgaagggccgcttcaccatctccagagacaattccaagaacacactgtatctgacaaatgaacagcctgagagccgaggacacggccacctatttcngtacgaaagaatacacanagctggacaggagaccaaacggcgactacttctttgactactcgggacagggaaccctggtcaccgtctcctcacgcctccaccgaacgggcccaagtccggtcctttcccccgtcggccaccctccctcccaacgacgccaacccgtccgtcgggggccaaccgacggccggccccgtacgggcctcggcccgttggtaaccgg

SEQ ID NO: 122518 - DNA, 513 bp, Homo sapiens
  misc_feature: GYAE6OF02G24MD.52.81.H04.1.454.CMB.1.raw
  modified_base (303)..(303): a, c, t, g, unknown or other
  misc_feature (303)..(303): n is a, c, g, or t
  modified_base (479)..(479): a, c, t, g, unknown or other
  misc_feature (479)..(479): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggaggcttggtacagcctggggggtccctgagactctcctgtgcagcctctggattcacctttcgcgtctatgacatgagctgggtccnccaggctccaggatggggctggagtgggtctcgaggtattaatagtggtaggaagtacatattacgcagactccgtgaacgggccgcttcgaccatcctcccagagacaattccaaagacacactgtatctgacaaatgaacagcctagagagccgaggacacgccacttattcgngtacaaagatacanacagccnggacngganaccg

SEQ ID NO: 122519 - DNA, 623 bp, Homo sapiens
  misc_feature: GYAE6OF02HW5D2.52.81.H04.1.454.CMB.1.raw
  modified_base (154)..(154): a, c, t, g, unknown or other
  misc_feature (154)..(154): n is a, c, g, or t
  modified_base (398)..(398): a, c, t, g, unknown or other
  misc_feature (398)..(398): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgngttttctagtggctattttaaaaggtgtcagtgtgaggtgcagctgctgcagtcggggggagcttgggtacagccgtggggggtccctggagactctcctgtgcagcctctggattccacctttcgcgtctatgacatgagctgggtccgcaggctccgaggatggggctgggagtgggtctcgaggttattaagtagtggtagaagtacatattacgcagacctccggtaggaacgggtcccncgttaccaccaagttcctaccgagacgaactaacttacccgaaagtaaacacgactaggttaactcgtacgaacctaaagttacgaaacgacgtccgtaggaacgacggacccggaagggaacccacgggaccctaaccgtttacgttttacgaacggtttaaacggaaaacgtaacttaacccactaacgaggtacctaggggaaccgacggacgaaaccccgg

SEQ ID NO: 122520 - DNA, 530 bp, Homo sapiens
  misc_feature: GYAE6OF02GIW4Q.52.81.H04.1.454.CMB.1.raw
  modified_base (306)..(306): a, c, t, g, unknown or other
  misc_feature (306)..(306): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggaggcttggtacaggccgtgggggggtccctgagactctcctgtgcagcctctggattcacctttcgcgtctatgacatgagctgggtccnccaggctccgagggaatggggctgggagtgggtctcgaggtattaataggtggtaggaagtacatatacgcagactccgtggaacgggccgcttcaccatctccagacgacaacttaccaagaacacactgtactctagacaatgaacacgactgagacgcgagacacgccactattcgtgtaacgaaagaactacacacagacgtaggacgaggacgaaccgg

SEQ ID NO: 122521 - DNA, 515 bp, Homo sapiens
  misc_feature: GYAE6OF02IZK33.52.81.H04.1.454.CMB.1.raw
tcagcgcagtacgacacgaccggtgctcgatttagtagtgtagattcgcggggagctctgagagaggagcccagccctgggattttcaggtgtttcatttggtgatcaggactgaacagagagaactcaccatggagtttgggctgagctggcttttcttgtggctatttaaaaggtgtccagtgtgaggtgcagctgctgcagtcgggggaggcttggtacagcctggggggtccctggagactctcctgtgcagcctctggattcacctttcgcgtctatgacatgagctgggtccgcaggctccgaggaagtggggctgggagtgggtctcaggttataagtagtggtgaagtacatatacgcagactccgtgaagggccgctacacatctccagacgacaacttaccaagaacacactagtatctgacaaatgaacagcctgagagccgaggaccacgccacctattcgtagtaacgaaagaatacacacacgctaggacgaggacaaccg

SEQ ID NO: 122522 - DNA, 527 bp, Homo sapiens
  misc_feature: GYAE6OF02IWCD6.52.81.H04.1.454.CMB.1.raw
  modified_base (329)..(329): a, c, t, g, unknown or other
  misc_feature (329)..(329): n is a, c, g, or t
  modified_base (381)..(381): a, c, t, g, unknown or other
  misc_feature (381)..(381): n is a, c, g, or t
  modified_base (521)..(521): a, c, t, g, unknown or other
  misc_feature (521)..(521): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtcgtttctaggtcggctaattttaaaggtgtcagtgtgagtgcagctgctgcaggtcgggggagcttggtacagccgtggggggtccctgagactctccgtgtgcagcctctggattcacctttcgcgtctatgacatgagctgggtccgccaggctccgaggagtggggctggngtgggtctcgaggttattaaagtaggttggtggaaagtacaagttattacgnagactccggtagaaggccgcttaccacatcctcagagacaagttccaagaacacactgtatctagacaatgaacagctagagacgcgacgacacgacactattcgtagaacaagaactacacacagcgtacggacgaggngaaccg

SEQ ID NO: 122523 - DNA, 615 bp, Homo sapiens
  misc_feature: GYAE6OF02G06JQ.52.81.H04.1.454.CMB.1.raw
  modified_base (304)..(304): a, c, t, g, unknown or other
  misc_feature (304)..(304): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagctgctgcagtcgggggagcttggtacagccgtgggggtccctgagactctcctgtgcagcctcgtggattccacctttcgcgtctatgacatgagctgggtccncgaggctccgaggaatgggctggagtgggtctcaggtattaagaggtggtaggaagtacagtattacgcagacctccggtaggaacgggcccgtcttaccgacctaacttcctaccgagtaacgacctaaacttacccgaaacgaacactacgttacgtatctagacctaaagtcgaaaccacgtactaggacgaacgacccggtagaaccgaccggtacctaccgttatttaccgtaggtaaaccgtaaagtaaactaacccgaacgaaccgtacgtacggttaacggaccggaaggaccggaaacccgg

SEQ ID NO: 122524 - DNA, 583 bp, Homo sapiens
  misc_feature: GYAE6OF02I91IE.52.81.H04.1.454.CMB.1.raw
  modified_base (327)..(327): a, c, t, g, unknown or other
  misc_feature (327)..(327): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggcttttcttgtggctattttaaaggtgtccagtgtgaggtgcagctgctgcagtcggggggagcttggtacagcctggggggtccctgagactctcctgtgcagcctcgtggattcacctttcgcgtctatgacatgagcgtgggtccgccaggcctccgaggatggggctgggngtggtctgaggtattaagtaggtggtaggaatacattagtacgcagtactcggagaacgggccgcttccaaccatcctaccgagacgaacaactaccaaagaaccacacttagtaatcctagacaaatgaacagcctaggaacgacgaccggaacggaaccgaccgaccctaccttacgtttaccgtacggtaaaccgaaacgtaactaaccgaaccgaccacggtaccgtacgggaaccggacggacgaacccgg

SEQ ID NO: 122525 - DNA, 552 bp, Homo sapiens
  misc_feature: GYAE6OF02GNT0F.52.81.H04.1.454.CMB.1.raw
  modified_base (384)..(384): a, c, t, g, unknown or other
  misc_feature (384)..(384): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgctgcagtcggggggagcttggtacagccgtggggggtccctgagactctcctgtgcagcctctggattcacctttcgcgtctatgacatgagctgggtccgccaggctccgaggaactggggctgggagtggggtcctcgaggtattaaagtagttggtggaagtacatattacgcagactcgngaggccgcttcacatctcagagacaattccaagaacacactgtactctagacaaagtgaaacagccctagacgacgccgaaggaaccaccggacccaccttacgtttacgtagtaaccgaaagtaacgtaacaccgacaggccgttagggaccgagggacgaacccgg

SEQ ID NO: 122526 - DNA, 586 bp, Homo sapiens
  misc_feature: GYAE6OF02G2DKA.52.81.H04.1.454.CMB.1.raw
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgacaaatgaacagcctgagagccgaggacacggccacctattcagtaacgaaagaatacacacagctaggacgaggacgaccgaacggcgactacttcttgactacgtcgggaccgacgggaaccctggtccaccgtcctcctcacgccctccaccgaacgggccctacgtccggtcccttccccgtcggccctacccctcctacccacgtaccgccgtacccgtcgtcgggggccaccgacggccggacccgtcgggccgtcggccgtcggtaaccgg

SEQ ID NO: 122527 - DNA, 526 bp, Homo sapiens
  misc_feature: GYAE6OF02F68X7.52.81.H04.1.454.CMB.1.raw
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggagcttggtacagcctggggggtccctgagactctcctgtgcagcctctggattcacctttcgcgtctatgacatgagctgggtccncaggctccaggaatgggggctgggagtggggtctcgagggttattaataggtggtaggaagtacatattacgcagactccggtgaacgggccncgttcaccgatctccagagacaattccaaagacacactgtatcngacaaatgaacagcctgagagaccgaggacaccggccacttattctagaacgaaagactaacacgacacgacaggacaggagaacccg

SEQ ID NO: 122528 - DNA, 539 bp, Homo sapiens
  misc_feature: GYAE6OF02F0C91.52.81.H04.1.454.CMB.1.raw
  modified_base (428)..(428): a, c, t, g, unknown or other
  misc_feature (428)..(428): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctgcagtcggggggaggcttggtacagccgtggggggtccctgagactctcctgtgcagcctctggattcaccttttcgcgtctatgacatgagctgggtccgccaggctccaggaatggggctggagtgggtctcgaggtattaataggtggtaggaagtacatattacgcagactccgtgaacgggccgcttccaccatctccagacgacataccaagacacactnactctagacaatgaacacgcctagagacgccgaggacaccggaccctaccgtattccgtagtaaccgaaagtaactaacacacgagaccgtaggaccgaggacgaacccgg

SEQ ID NO: 122529 - DNA, 607 bp, Homo sapiens
  misc_feature: GYAE6OF02HP04F.52.81.H04.1.454.CMB.1.raw
  modified_base (175)..(175): a, c, t, g, unknown or other
  misc_feature (175)..(175): n is a, c, g, or t
  modified_base (182)..(183): a, c, t, g, unknown or other
  misc_feature (182)..(183): n is a, c, g, or t
  modified_base (188)..(188): a, c, t, g, unknown or other
  misc_feature (188)..(188): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggcgtgttctaggtcgctattaagngcagtgnngtgcngctgctgcagtgggagctgacagcctggggcctgagctctctgtgcagcctntggattcacctttcgcgtctatgaactgtgagctggtccgccaggcctccgaggaagttggggngtggtaggtggtcgtcgtagtagttagtagtaggtaggtaagtaacgtagtacgtacgtacgacgtacgtacggtacggtacggtaccgtcgtaccgtacgtacgtacgtaccgtacgaacgtaacgtaactaaccgaacgtaacgtaactacgtacgtactacgtacgtaacgtaagtaacgaacgacgtacgtacgacgacgaccggacggaccgaccgtaccgtaccgttacgttacgtaacgtaacgtaaacgtaacgtaaccacacgtacgtacgtacggaacggacggacggaaccg

SEQ ID NO: 122530 - DNA, 534 bp, Homo sapiens
  misc_feature: GYAE6OF02JBT4O.52.81.H04.1.454.CMB.1.raw
  modified_base (247)..(247): a, c, t, g, unknown or other
  misc_feature (247)..(247): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacnttggcaataattttgtgtcctggtaccagcaactcccaggcacacgcccccaaactccctcatttatcgacaatgaataacgcgaccctcgaggactacctagaccgtattctctggcctccaagtctggcacgtcacgcccaccgtggcatccgaccggactccagaccgtggggacacggcccgtattacgtactcgacgaacagtggaatacgcagtcctgacgtgagtcgccggagggttcgttacgggcgggacgggaccaaggccgtacgacccgttaccg

SEQ ID NO: 122531 - DNA, 567 bp, Homo sapiens
  misc_feature: GYAE6OF02GF14J.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcgggggggaggcttgggtacaggccgtgggggggtccctgagactctcctgtgcagcctctggattcacctttcgcgttctatgacatgagcgtgggtccgccaggcctccaggaatggggctgggagtgggtctcgtaggtattaagtaggtggtaggaagtacattaattacgctagactaccggtgaacgggccgcttacacctatctccagacgactaataccaagtaacacactgtatctagactaaatagaacacgcctagacgacgccggaaggaccgacggaccctaccttacttcgtacgtaacgaaacgtaactacacacacgacgtaggaacggaggacgaacccgg

SEQ ID NO: 122532 - DNA, 706 bp, Homo sapiens
  misc_feature: GYAE6OF02HUAM4.52.81.H04.1.454.CMB.1.raw
  modified_base (183)..(183): a, c, t, g, unknown or other
  misc_feature (183)..(183): n is a, c, g, or t
  modified_base (263)..(263): a, c, t, g, unknown or other
  misc_feature (263)..(263): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtcgtgtttctaggtcggctaattttaaaggntcagtgtgaggtgcagctgctgcagtcgggggagcttggtaccagcctggggggtccctgagctctcctgtgcagtcctntggattcgacctttcgcgtactatcgactatgagccgttggggtcccaccgagggcctaccggaaggaaagttgggggacctgggtggtcggggtcctacggtaagggtttaatttaagtaaggtttgggtaacgggaacgttacgtaattaaagttccgagtacgtaacctttcccggtaaggaacggggacccttcgtttacccgaacccaacgtttctaacccgaggaaacttaaccgaaatttaaccccgaaaaagaaaccctacgtaaccgttataccgtacgtacgaacgtaaacgtaacgtaacgtacgacgtacgaacgacgacggaacggaaccgaccgtaccgttaccgttaccgtttaccgttaacggtaaacgtaaacgtaacgtaacgaacgaacgacgtaccggtacggaacggtacggaacgaaccgg

SEQ ID NO: 122533 - DNA, 590 bp, Homo sapiens
  misc_feature: GYAE6OF02GQSRW.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctatttaaaaggtgtccagtgtgaggtgcagctgctgcagtcgggggagcttggtacagcctggggggtccctgagactctcctgtgcagcctctggattcacctttcgcgtctatgacatgagctgggtccgcaggctcagagtgggctggagtggtctcaggtattaagtagtggtaggaagtacatattacgacagtacctccggtagaacgggccgacttccgacctactcctaccagacgaacaattaccgaagaacacaccttagtactctgaactaaagtcgaaaccagtccctaggacggaacgaccggaacggaaccgaaccgggccctaccgttatttccgtaaggttaaaccgaaaacggtaactaaaccacgaacgacggaccgtagggaacggtagggaaccgaaacccgg

SEQ ID NO: 122534 - DNA, 693 bp, Homo sapiens
  misc_feature: GYAE6OF02J3Q3L.52.81.H04.1.454.CMB.1.raw
  modified_base (179)..(179): a, c, t, g, unknown or other
  misc_feature (179)..(179): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (585)..(585): a, c, t, g, unknown or other
  misc_feature (585)..(585): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgtttctagtggctagtttaaaggngtcagtgtgaggtgcagctgctgcgnggtcggggngcgttggacncggtccgtgggggtccctgacgtaccgtcttccgtcggtcgcgacggtcctccgtaggtacttacctaccgttttccggacgttctaagtcgtaccgagttcggacgtccggttcggtcccgtaaccgtacggccgttaccggtagggaacgggttcggggccgttacgggacggttccgggttacgtacggtaaggttaacgttaaggtaggtacggtaaggtaacgtactaagttactacggacgtacgtaccggttacggacggtaccggtccttactcccgtaactccgttaacgaccgtagtaaccgaacttacgaaccaagtacaacgtactagttacncgtaacanaaacgttnaaccgtgactaggaacgtcggtacaacggtcgaacgttgacgtagttacgtacctgggattacgaacttacacgtacggacgtacgacgttaccgtcccggtacccgg

SEQ ID NO: 122535 - DNA, 712 bp, Homo sapiens
  misc_feature: GYAE6OF02IKTHF.52.81.H04.1.454.CMB.1.raw
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctgcgagggtcggggggagcgttgggtacaggtccggtcggggggtccctggacgacctcctccgtgtcgcacgtcctcgtggtactttcctacccgtttcgcgttctagtgaacagtgaggtccgttcggggtcccgccgaggcctaccgaggtaagtggggctgggaggtgggtctacgaggttattaagtagtggtaggaagtactatacttacgactaacgtacgtccggtaggaaccgggtccgtacgttaccaacctactcctaccgaagaacgtaactaacttaacccgaaacgtaaaccaacctaacgttacgttaacttcgtacgaactaaacgtacgaaacgtacgtacccgtaaggaacggaccggaaccgggaacggaaccccgaaccgggtaccctaaccgtttaacgttttaccgtaacggttaaaaccggaaaacgtaaactaaccaaccgtacgaacggtacggtacgggaacggacggaccgaaacccgg

SEQ ID NO: 122536 - DNA, 705 bp, Homo sapiens
  misc_feature: GYAE6OF02IC2PH.52.81.H04.1.454.CMB.1.raw
  modified_base (182)..(182): a, c, t, g, unknown or other
  misc_feature (182)..(182): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtcggctattttaaaaggngtcagtgtgagtgcagctgctgcagtcgggggagctggtacagcctgggggtcctgagctctctgtgcagcctntggattcncctttcgcgtactatgactatggacncgtcgggtccgcgaggcctaccgaggaagtcgggggctgggaggtgggtcctcgaagggtaattttaagacgtttggagggaaagtacctaagtaattacggaccaaagtccgtaccgttagggaacgggcccggtacttccaacctacttacccgtaccacggtaaacggaacctaaacgtttacccaaaaggtaacaaaccctacggttagtaaacgtccttaaggaccaaattaacgtaaacggaacgtacccgtaacggaaggtaacgacccggaacggtaaccgaccggggaccccgtaacccgttaactttaccgttaaccggtaaccggttaaacgggaaaccgttaaccgtaaccaaccgaacggttaccggtacggtaaccgggtaacgggacggtaaaccccggg

SEQ ID NO: 122537 - DNA, 558 bp, Homo sapiens
  misc_feature: GYAE6OF02G27GV.52.81.H04.1.454.CMB.1.raw
  modified_base (314)..(314): a, c, t, g, unknown or other
  misc_feature (314)..(314): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgaacagggtcctgggcccagtctgtcttgacgcagccgccctcagtgtctgcggccccaggacagaaggtcaccatctcctgctctggaagcagctccaacattggcaattaattttgtgtcctggtaccagcaactcccaggcacacgccccaaactcctcatttacngacaatgataagccgacctcgagggactaccgtgaccgtattctctggctccgaagttctggcacgtcacgccacccgtggcacgtcgacccggactaccgacgacgtcggggacgacggccgtaattacttaccgtaggacggaaactaggtgggaataggccaagtcccgtagacgtgacgtcggaccggtagggttcggtcggcgggacgggaccgaaggcgtacgtacccgtcgtacggg

SEQ ID NO: 122538 - DNA, 571 bp, Homo sapiens
  misc_feature: GYAE6OF02JDPFB.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagccgtggggggtccctgagactctcctgtgcagcctctggattcacctttcgcgtctatgacatgagctgggtccgccaggctccgaggaagtggggctgggaggtgggtctcgaggttattaagtaggtggtacggaagtacatattacgcagactcgtgaacggccgcttcgaccatcctcagacgaactaacttaccaaagaaccacacttagtactctagactaaatagaacacgcctaggagacgaccgaaggaccgacgggaccctaccgttactttcgtaacggtaacgaaaaggtactaaccacaacaggaccgtacggacggaggacgaacccgg

SEQ ID NO: 122539 - DNA, 666 bp, Homo sapiens
  misc_feature: GYAE6OF02FTLPJ.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggaggcttggtacagccgtggggggtccctgagactctcctgtgcagcctctggattcacctttcgcgtctatgacatgagctgggtcccgccgaggcctccgaggaacgtgggggctgggaggttggggtctcgaggtattaagtaggtggtaggaagtacatatacgcagtacgtccgtaggaacgggcccgtcgttaccacctactcctacccgtaaggacgaacctaaacttacccaaacgtaaaccaaccaacttagttaactccgtacgaaccaaagttacgaaacctacggtaccctagggaacgtacgacgtacggaacgggaaccgtaccgggtacgttcggttacggttaacttaaccgttacgggtcggaaccgttaaacgtttaacgtacccggtaagggaaccgggaaccctaaccggggtacccgtaacccccccggg

SEQ ID NO: 122540 - DNA, 574 bp, Homo sapiens
  misc_feature: GYAE6OF02HVGJF.52.81.H04.1.454.CMB.1.raw
  modified_base (392)..(392): a, c, t, g, unknown or other
  misc_feature (392)..(392): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgctgcagtcggggggaggcttggtacagcctggggggtccctgagactctcctgtgcagcctctggattcacctttcgcgtctatgacatgagcgtgggtcccgccgaggctccgagggaatggggctggaggtgggtctcgaggtattaagtagtggtagaagtacatattacgcagactccgtgacggccnctcaccatctccagagacaattccaaagaacacactagtactctagacaaatcgaaacacgacctggaagtacgacccggaagaccgaccggaccctaccgttaatttaccgtaggtaaaccgaaaagaaacttaaccgaacgaaccgaaggtaccgtagggaacgtacgggacgaacccgg

SEQ ID NO: 122541 - DNA, 651 bp, Homo sapiens
  misc_feature: GYAE6OF02JWWMN.52.81.H04.1.454.CMB.1.raw
  modified_base (504)..(504): a, c, t, g, unknown or other
  misc_feature (504)..(504): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctgcagtcggggggaggcttggtacaggccgtggggggtccctgagactctcctgtgcagcctctggacttcacctttcgcgtctatgacatgagcgtgggtccgccgaggcctccgaggaagtcggggctgggaggtggggtctcgaggtattaagtaggttgggtaggaaggtacaattacgttacgctagacgttcccggtaggaacgggcccgattccgaacctattcccgcctaaggaacgacctaattcccaaaaggtaccactaacttggtactctacgaacctaaagtcgaaaccncgtaccctaggaacggaacgtcccgggaacggaccgaaccgggaccctaaccgtttcgtttacgaacggtaaaccggaaagtaacttaaccgaaccgtaacgacggaccggttacgggaaccggtacggggaaccgtaaaccccggg

SEQ ID NO: 122542 - DNA, 560 bp, Homo sapiens
  misc_feature: GYAE6OF02G0REV.52.81.H04.1.454.CMB.1.raw
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttctgtacgaaagaatacacacagctggacgaggagccaaacggcgactacttctttgactactggggccagggaaccctggtcaccgtctcctcacgcctccaccaacgggcccatccggtccttcccccgtggccaccctccctccacgacgccaccctccgtcgggggccaccgacggccggcccgtcgggcctcggcccgtggtaccgg

SEQ ID NO: 122543 - DNA, 581 bp, Homo sapiens
  misc_feature: GYAE6OF02HWDV2.52.81.H04.1.454.CMB.1.raw
  modified_base (346)..(346): a, c, t, g, unknown or other
  misc_feature (346)..(346): n is a, c, g, or t
tcagcgcagtacgacacgaccggtgctcgatttagtagtgtagattcgcgggcacgaccggtgctcgatttagtagtgtagattcgcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaaggccgcttcaccatctccagagacaattccaagaacacactgtatctgcaaatgaacagcctgagagccgagacacggcacctattcngtacgaaagaatacacacagctaggacgaggagaccaaacggcgactacttcttcgactactgggaccagggaacctggtcaccgtctcctcgacgcctaccaccgaacgggccccaacgtcccggtacctttcccccgtcgggtcccaccccttccctaccctaacgacgccgaaccctccgtcgggggtccaccgacggccggacccgtcgggcctcggtcccgtggtaaccg

SEQ ID NO: 122544 - DNA, 665 bp, Homo sapiens
  misc_feature: GYAE6OF02H7YX1.52.81.H04.1.454.CMB.1.raw
  modified_base (192)..(192): a, c, t, g, unknown or other
  misc_feature (192)..(192): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttctgtggctattttaaaggtgtcagtgtgaggtncagctgctgcaggtcgggggaggcttggtacaggccgtggggggtccctggacgactctctgtgcagcctctggattcacctttcgcgttctatcgttacgatgacgtcgtcggggtcccgccacgggcctccgaagggaacgttcgggggctgggtaggtcgggtctacgtaggtaattaagtagtggtaggaaatacagtaacttcgactaagtaccgtaccggtaggaacggggtcccgtcttaccgaaccgtactacctaccgaacgaacgtaacctaacttacccgaaagaaaccgactaactgtaacgtactacggacctaaagttaacgaaccgtaacgtaccgtacggtaacggacgaccggaacggaacccgtaccgacccgtacccttaagtttccgtaacggtaacgaaagtaaccgtaaccaacgacacggaccgtagggaaccgtagggacaaacccggg

SEQ ID NO: 122545 - DNA, 556 bp, Homo sapiens
  misc_feature: GYAE6OF02HQVWV.52.81.H04.1.454.CMB.1.raw
  modified_base (445)..(445): a, c, t, g, unknown or other
  misc_feature (445)..(445): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggcacggccacctatttcagtacgaaagaatacacacagctggacgaggacgaccaaacggcgactacttcttgactacgtgggcaacgggaccctggtcaccgtctcctcacncctccaccgaacgggcccagtccggtccttccccgtcggccaccctcctccagacgccaccgtccgtcggggccaccgacggccggcccgtgggccgtcgccgtggtaccg

SEQ ID NO: 122546 - DNA, 696 bp, Homo sapiens
  misc_feature: GYAE6OF02I9B52.52.81.H04.1.454.CMB.1.raw
  modified_base (180)..(180): a, c, t, g, unknown or other
  misc_feature (180)..(180): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtggctaatttaaaggngtcagtgtgaggtgcagctgctgcaggtcgggggagcttggtacagcctggggggtcctgagctctcctgtgcagcctctggnttcnccgtttcgcgtctatgacntgagctgggtccgcaggcctcgaggagtggggntgggagtgggtctcgtaggttattaagtggtagggtacggaagtacgattagttacgatacggacgtcccggtaggaacgggtccgtccttaccacctactcctaccgaacgtaacgtaactaaacgttacccaaaacgtaaccactaaccgtattaacgtcctacgtaaccgtaaaattacggaaactaccggtaaccgtaggaacgggtaaccgacccgggtaaacggaacccgaaccgggtaaccccttaaccgttttacttttaaccgttaacgggttaaaaaccgtaaaacggtaaaccttaacccaaacgaaccgttaacgggaccgttaaacgggggaaacccggaaggggttaacccgaaaccccgggg

SEQ ID NO: 122547 - DNA, 612 bp, Homo sapiens
  misc_feature: GYAE6OF02JFYW6.52.81.H04.1.454.CMB.1.raw
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggaggcttggtacaggccgtggggggtccctgagactctcctgtgcagcctctggattcacctttcgcgtctatgacatgagcgtgggtcccgccaggcctccgaggaagtggggctgggagtgggtctcgaggttattaagtgtgggtggaagtacatattacgcagactcgtaggaagggcctcttcacctgtcctcgaagacgactaacttaccgaaacgaacactacttgtaactcgttacgactaaaatcgaaacgtacgcctaggacgtaacgcccggaaaggaacccgaccggaccctaccttacgttaccgtaaggttaaaccgaaaggtaaactaaccgtaaccaacgtacggtaccgtagggaacccggtaaggtaccgaaacccgg

SEQ ID NO: 122548 - DNA, 644 bp, Homo sapiens
  misc_feature: GYAE6OF02G1W2O.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctggggggtccctggagactctcctgtgcagcctctggattcacctttcgcgtctatgacatgagcgtgggtccgccgaggcctaccgaggaatggggctggaggtgggtctcgaggttattaagtagtggtaggaagtacatattacgcaagactccggtaggaacgggtccgctttaccaacctactcctacccgaaggacgtaaacctaacgttacccgaaagtaaccaacaacgttagtaacttcctaggaacctaaaattacggaaaccacggtacccttagggaacgaacgacccgggtaacggaaccgaccgggacccctaccgttaacttttaccgtaacggttaaacgaaaaggtaactaaccaaccgaacgacggtaccgtagggaaccgagggaacgaacccgg

SEQ ID NO: 122549 - DNA, 521 bp, Homo sapiens
  misc_feature: GYAE6OF02GHCRG.52.81.H04.1.454.CMB.1.raw
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaacccaccatggagtttgggctgagctggctttttcttgttactattttaaaaggtgtccagtgtgaggtgcagctgctgcagtcgggggagcttggtacagcctggggggtccctgagactctcctgtgcagcctctggattcacctttcgcgtctatgacatgagctgggtccgccaggctccaggaatggggctggagtgggtctcaggtattaatagtggtggaagtacatatacgnagactcgtgaagggccncttcaccatctccagagacaattccaaagaacacactgtactctnacaaatcgaacacgcctgagagccgaggacacggccacctattcngtaacgaaanaactacacacagctaggacgaggacgacccgaaggaccg

SEQ ID NO: 122550 - DNA, 517 bp, Homo sapiens
  misc_feature: GYAE6OF02FVG9T.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggcttttctgtggctattttaaaaggtgtccagtgtgaggtgcagctgctgcagtcggggggagcttggtacagcctggggggtccctgagactctcctgtgcagcctctggattcaccttttcgcgtctatgacatgagctgggtccgccaggctccagggaatgggggctgggagtggggtctcgagggtattaagtagtggtggaagtacatattacgcagactcgtgaaggccgcttcaccatctccagagacaatccaagaacacactgtatctgacaaatgaacagcctagagacgccgaggacacgccactattcgtgtaacgaaagactacacacagcgtaggacgaggagaacccg

SEQ ID NO: 122551 - DNA, 648 bp, Homo sapiens
  misc_feature: GYAE6OF02HUGX8.52.81.H04.1.454.CMB.1.raw
tcagcgcagtacgacacgaccggtgctcgatttagtagtgtagattcgcggggagctctgagagaggagcccagccctgggattttcaggtgtttcatttggtgatcaggactgaacagagagaactcacatggagtttgggctgagctggctttttctgtggctattttaaaaggtgtccagtgtgaggtgcagctgctgcaggtcggggggagcttggtacagccgtggggggtccctgagactctcctgtgcagcctcgtggacttcacctttcgcgtctatgacatgagctcgggtccgccgaggcctcgaggagtgggctgggagtggtctcgaggttaattaagtaggtggtaggaacgtacaattattacgcagtaaccgtccggtagggaacgggtcccgtcttaccgaacctacgtacctaccgaggtaacgaacctaactttacccgaaaagaaaccaacgtaactagttaacctacgtacggaacctaaagtacgaaacgtacgacctaggaacgacgaaccggaacggaaccgaccggaccctaccgttagttttaccgtaacggtaaacggaaacgtaaactaaccaacgtaacgacggaaccgtacgggaacggaacgggtacgaaaccccggg

SEQ ID NO: 122552 - DNA, 634 bp, Homo sapiens
  misc_feature: GYAE6OF02FFTRI.52.81.H04.1.454.CMB.1.raw
  modified_base (154)..(154): a, c, t, g, unknown or other
  misc_feature (154)..(154): n is a, c, g, or t
  modified_base (164)..(164): a, c, t, g, unknown or other
  misc_feature (164)..(164): n is a, c, g, or t
  modified_base (173)..(173): a, c, t, g, unknown or other
  misc_feature (173)..(173): n is a, c, g, or t
  modified_base (176)..(178): a, c, t, g, unknown or other
  misc_feature (176)..(178): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (188)..(189): a, c, t, g, unknown or other
  misc_feature (188)..(189): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtntgttctaggngcattaagncannngtncanctgnngcngngggancttgacngcctgggaccngnctctctgtagcagctgtgacttcactttcgntcatgacatgagtccgtggccacgtagtcctaccgaaggtagtggggtctgggaacctgggtcttaccggaagggttatttaaagcggtttgggacgaaacggtcaactttgaacggtcaaacggtaccctccggggttaagaacccgggggtccgaactttccgaaaccctttacgtacccgttaaccgaggtaaacgtaaccgttaaacgtaacccgaaagtacccaacgtttaacgttcgtaacctcgtaaaggaactaacgtaacgaacgacgtacgtacgtacgacgaccgacggaccgaccgtacccgtactacgtacgtaacgtaacgtaacgtaactaacaacacgacggtacgtacggacgtacggacgtaaccg

SEQ ID NO: 122553 - DNA, 534 bp, Homo sapiens
  misc_feature: GYAE6OF02GPBCV.52.81.H04.1.454.CMB.1.raw
  modified_base (301)..(301): a, c, t, g, unknown or other
  misc_feature (301)..(301): n is a, c, g, or t
  modified_base (460)..(460): a, c, t, g, unknown or other
  misc_feature (460)..(460): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctgggggtccctgagactctcctgtgcagcctctggattcacctttcgcgtctatgacatgagctgggtccnccaggctccaggatggggctgggagtgggtctcgaggttattaagtaggtggtaggaagtacatagttacgcagacgtccgtaggaacgggccgtcttacaccctatcctccgagacgactaacttaccaaagaacacactgtatctagacaatgaacngcctgagagccgagacacggaccactattctagtaacgaanaactacanacgagcgtaggacgaggacaaccgg

SEQ ID NO: 122554 - DNA, 583 bp, Homo sapiens
  misc_feature: GYAE6OF02I4U0T.52.81.H04.1.454.CMB.1.raw
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggcttttcttgtggctattttaaaggtgtccagtgtgaggtgcagctgctgcaggtcggggggaggcttggtacagccgtggggggtccctgagactctcctgtgcagcctctggattccacctttcgcgtctatgactatgacgtcgtgggtcccgccgaggcctccgaaggaagtcgggggctgggagtgggtctcgaggtatttaagtagtgggtaggtaagtacatacgttacgcagactccggtagaacgggtccgacttaccgaccactcctcgagtacgactaatacccaaagaccatactgtatctnacaatcgaancgactggacgacgacgacggacgacgaccaccttacttacgtacggtaaaccaaagtaacctaacgacgtaccacgtcgtaggaaccggaggaaccggtaacccgg

SEQ ID NO: 122555 - DNA, 655 bp, Homo sapiens
  misc_feature: GYAE6OF02F137T.52.81.H04.1.454.CMB.1.raw
  modified_base (178)..(178): a, c, t, g, unknown or other
  misc_feature (178)..(178): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtgtttctaggtggctatttaaaggngtcagtgtgagtgcagctgctgcaggtcgggggagtcgttggtacagtccgtgggggtccctggacgtactctccgtgtcgcacgcctcgtggtattcctaccgtttcgcgtctatgacagtgacgtcgtcgggtccgccgaggtcctaccgaggacgtgggctagggacgtggtctacgaggttattaagtaggttggtaggaaagttacgtattacgttacgacgtacgtacgtcgtaggaacgggtcctacgtttaccgacctatcctacgagaacgactaacgtaccaagtacctacgattcgaacttcgtacaactaagtacgaaactcgtaccgtagaacgaccgtacggaacgaccgtaacccgtccttaaccgtttgtttaaccgtaacggttaaacggtaaaactaaccgtaaccgaacgtaacggtacggtaccgtaacgggaccggaacggtacccgaaacccggg

SEQ ID NO: 122556 - DNA, 573 bp, Homo sapiens
  misc_feature: GYAE6OF02HISW2.52.81.H04.1.454.CMB.1.raw
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (456)..(456): a, c, t, g, unknown or other
  misc_feature (456)..(456): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctgcaggtcggggggagcttgggtacaggccgtggggggtccctggagactctcctgtgcagcctctggattcacctttcgcgtctatgacatgagctgggtcccnccgaggtccnccgaggaatggggctgggagtggtctcgaggtattaagtagtggtagaagtanatatacgcagactaccgtgaacgggccncttccactatccacagagacaattaccaaagaacacactagttactcgtagacaaanagaaacagaccgtagagacgacggacgaacgacggaccctacgttactttaccgtagtaaccgtaaaagtaactaaccaacgacacggtcgtaacgggaacggaggaacaaacccgg

SEQ ID NO: 122557 - DNA, 687 bp, Homo sapiens
  misc_feature: GYAE6OF02ILV2A.52.81.H04.1.454.CMB.1.raw
tcagcgcagtacgacacgaccggtgctcgatttagtagtgtagattcgcgggggagctctgagagaggagcccagccctgggattttcaggtgtttcatttggtgatcaggactgaacagagagaactcaccatggagtttgggctgagctggtctttttcttgtggctaattttaaaaggtgtccagtgtgaggtgcagctgctgcgaggtcggggggaggcttggtacaggccgtggggggtccctggagactctcctgtgcagcctctggattctacctttcgcgtctatgacatgagcgtcggggtccgccgaggcctaccgaggagtcggggctgggaggtgggtctgaggttattaagtaggttgggtaggtaaagtacgaattacgttacgcgtaacgtaccgtccggtagggaacgggtccgtacgttaccaacccgtattacccgtaccgaacggtaacgaacctaacttaacccgaaagtaaacctaactaaccgttagtaacttctacgaactaaaagtacgaaacgtacgtaccgtaggaacgacggacccggaacgggaacctacccgggaccctaaccgtttacgtttacgtaacggtaaaccgtaaagtaaacctaaccgaaaccaaccgaacggtaccggtacgggaaccggtacgggaacggaaccccgg

SEQ ID NO: 122558 - DNA, 552 bp, Homo sapiens
  misc_feature: GYAE6OF02GN9QR.52.81.H04.1.454.CMB.1.raw
  modified_base (397)..(397): a, c, t, g, unknown or other
  misc_feature (397)..(397): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaaggccgcttcaccatctccagagacaattccaagaacacactgtatctgcaaatgaacagcctgagagccgaggacacggccactattctgtacaaagatacacacagctggacgaggagccaacggcgactcttcttnactacgtcgggccacggacctggtcaccgtctcctcacgcctccaccacggccacgtccggtccttccccgtcggccctacccgtccctcccacgacgccgacccgtcgtcgggggccacgacggccggcccgtcgggccgtcgccgtggtaccg

SEQ ID NO: 122559 - DNA, 607 bp, Homo sapiens
  misc_feature: GYAE6OF02HU6UO.52.81.H04.1.454.CMB.1.raw
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (565)..(565): a, c, t, g, unknown or other
  misc_feature (565)..(565): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggaggcttggtacagccgtggggggtccctgagactctcctgtgcagcctctggacttctacctttcgcgtctatgacatgagcgtcggggtcccgccgagggcctaccgagggaagtcggggctgggaggtgggtctcgaagggttaattaagtaggtgggtaggaaagttactaataagttacgagacgtacctccggtaggaacggggccctcttccaaccacgtcctaccaggacaacctaattacccaaagaccaacacgtntaacnctagacaaagtcgaactacgcctaggacgacgccgaaggaccgacggaccctactttagttccgaagttaaaccgaaanaactaccaacaacgcggcctagggaaccgaggacgaacccgg

SEQ ID NO: 122560 - DNA, 717 bp, Homo sapiens
  misc_feature: GYAE6OF02GJXTC.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggagcttggtacagccgtggggggtccctgagactctcctgtgcagcctcgtggtattcctaccgtttcgcgttctatgacagtgagtcgtcgggtccgccgacggctccgaaggacgtgggctgggagtgggtctacgaggttaattaagtaggtggtaggaagtacagtatacgcagtacctcggtaggaacgggcctacgttaccaacccgtattcccgtaccgaaaggtaacgtaaactaaccgttaacccgaaaacgtaaacctaacctaacgtttacgtaacgttccgagaaacctaaaagttaaccgaaacgtacggtacccgttaagggaacggaaaccggtacccggaaacggaacccgtaaacccgggtaccctaaccgttttaacgtttaccggtaaacggtaaaaccggtaaaaagtaaaccgttaaaccgaaccgtaaaccgtaacggtaccggtaaggggaaaccgtaacggggaaccgtaaaccccgg

SEQ ID NO: 122561 - DNA, 572 bp, Homo sapiens
  misc_feature: GYAE6OF02HSXB1.52.81.H04.1.454.CMB.1.raw
  modified_base (265)..(265): a, c, t, g, unknown or other
  misc_feature (265)..(265): n is a, c, g, or t
  modified_base (367)..(367): a, c, t, g, unknown or other
  misc_feature (367)..(367): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccncttcaccatctccagagacaattccaagaacacactgtatctgacaaatgaacagcctgacgagccgaggaccacggacctacctattctagtaacgaaaanaatacaacacagactggacgagggacgaccgaacggcactacttcttcgactacgcgggccgacgggaccctggtccaccgtctcctcacgccctaccaccgaacggcccacgttccgtcccttccccgtcggccctacccctccacgacgcgaccacctccggcgggccacgacggccggtcccgtcggctcgtccgtggtacg

SEQ ID NO: 122562 - DNA, 532 bp, Homo sapiens
  misc_feature: GYAE6OF02FG4QF.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggagcttggtacagcctggggggtccctgagactctcctgtgcagcctctggattcaccttttcgcgtctatgacatgagctgggtccgccaggctccgaggaatggggctgggagtgggtctcgaggtattaatacggtgggtaggaagtacatattacgcagactccgtagaagggccgcttcaccatctccagagacaattccaagaacacactagtatctagacaaatgaactagacctagacgagccgaggacacggcctacctattcgtacgtaacgaaacgaactacacacagactaggacgaggagaaccg

SEQ ID NO: 122563 - DNA, 672 bp, Homo sapiens
  misc_feature: GYAE6OF02JFT1W.52.81.H04.1.454.CMB.1.raw
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctgcaggtcgggggagtcttggtacaggccgtggggggtccctgagacctctccgtgtgcngcctctggacttcacctttcgcgtctatgacatgagcgtcgggtccncgaggtcctcgaagggtagtcggggctgggaggtggggtctcgtaaggttattaagtaggttgggtagtaagtacaagtttacgtacgctaacggtaccgttacccggtagggaaccgggtcccgtacctttacccgaacctacttccgtaccgaagacgtaacctaaacttacccgaaaagaaccctaacgtaacgttacgtactcgtaacgactaaacgtcgaactacgaccgtaggacgacgtaccggacggaccgaccggtaccctacctttacgttaccggttaaggtaaaccgaaacgtaactaaccgacctacgaaccggtacgtaacgggaaccggagggaccgtaaaccccgg

SEQ ID NO: 122564 - DNA, 739 bp, Homo sapiens
  misc_feature: GYAE6OF02GRSEO.52.81.H04.1.454.CMB.1.raw
  modified_base (303)..(303): a, c, t, g, unknown or other
  misc_feature (303)..(303): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggcttttctgtggctattttaaaaggtgtccagtgtgaggtgcagctgctgcaggtcggggggagtcttggtacaggccgtgggggggtccctggacgacttctccgtgtgcaggcccctgtggtacttcctaccttcgcgtctagtgacntaggatcggtcggtccgcgaggcctccgaaggtaaggtcgggctagggtaggtggtcctaggtaaggttaataagttagggtgggtaaggtaacgtaactaagttactaacgtacacgtaaccggtcgtaacgggaaccgggtccggtactaccgaaccttacgttcccgtaaccgtaggaaaccgtaaactaacccgttaaccgaaaaccgtaacctaaccgtaacgttacgttaaccgtaacgtacgtaaaaacctaagtaaaccgaaccgtaaccgtacgttaacggaacgggttaaccgaccgggtaacgaaaccgccgggtaaccctacgttaactttccggtaaacgtaaaccggtaaacgtaaaccgaaccgtaacgtaaccggacgtaccggttaacgggaacggtaccgggaacgtaaacccccggg

SEQ ID NO: 122565 - DNA, 725 bp, Homo sapiens
  misc_feature: GYAE6OF02FGC01.52.81.H04.1.454.CMB.1.raw
  modified_base (182)..(182): a, c, t, g, unknown or other
  misc_feature (182)..(182): n is a, c, g, or t
  modified_base (270)..(270): a, c, t, g, unknown or other
  misc_feature (270)..(270): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtcgtggtttctaggtcggctatttaaaggngtcagtgtgagtgcagctgctgcagtcggggagcttggcagcctgggggccctgagtactctccgtgtgcacgcctcgtggtacttcncccttttcggacgtcctaattcggcctattgtaagcgttcgggtcccgcctaaggtcctaccgtaaggaagttggggcgttggaccgtaggggtactcgtaggttaattaagtaaggtttggtcggaaaagttccaagtaacttaacgggcacgtaacgttcccggtaaggaaccgggtcctattcccggaactagttcccgtaaccagggtaaccaacgtaacgtttaaccgaaactaaaccctacgttaacgttcgttaaacgtcgtacgaacgtaaacgtaacgaacgtaaccgtaccgtaacgtaacgtaaccggaaccggaaccggaccggacccggtacccgttaccgttaaccgttaccggttaaccggtaaccgtaaaccggtaaaccgtaaccgtaacccgtacgtacggtaccggtacggaacggtacggtaaccggtaacccgg

SEQ ID NO: 122566 - DNA, 687 bp, Homo sapiens
  misc_feature: GYAE6OF02JHTIQ.52.81.H04.1.454.CMB.1.raw
  modified_base (479)..(479): a, c, t, g, unknown or other
  misc_feature (479)..(479): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatcctcctgctcgtggaagctagcctaccaaactagttggactaaattaagttttgtcgttcctacggtaaccagacctaacctcccaaggccacaccgaccccccaaactccctactaatttacacgtaacaagtgaataacgccgaacccctaggaacgggtaactaacccgtacggaaccgtaactttccgtacgtcgtaccctacgtaacgttccgtacgggacctaaccggtcacccggtacccctaacccggngggtacctacgtacccgacccggtaccttaccgaggtaccggtcggggaaccgacggtacccgtaattacttaacgacggaccgaaacgtcgtagggactaacggacgtacgtaccgtaggtaggtcgtaacgtcggacggtaacgggggttgtacccgggacggggtaaccggaaccgtacggtaccgtacgggtacccgtaccggg

SEQ ID NO: 122567 - DNA, 666 bp, Homo sapiens
  misc_feature: GYAE6OF02I0BNS.52.81.H04.1.454.CMB.1.raw
  modified_base (156)..(156): a, c, t, g, unknown or other
  misc_feature (156)..(156): n is a, c, g, or t
  modified_base (234)..(234): a, c, t, g, unknown or other
  misc_feature (234)..(234): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (503)..(503): a, c, t, g, unknown or other
  misc_feature (503)..(503): n is a, c, g, or t
  modified_base (618)..(618): a, c, t, g, unknown or other
  misc_feature (618)..(618): n is a, c, g, or t
tcagcgcagtacgacacgaccggtgctcgatttagtagtgtagattcgcggggagctctgagagaggagcccacgcccgtgggtattttcgaggttgttttctagtttggtgatcgaggactgaacagagagaactcaccatggtagtttggctgngcgtggtcttttctgtgcttagtttaaagtgtcagtgtgaggtgcagctgctgcgaggtcgggggagtcttggtacgnggccgtggggggtccctggacgtactccgtccgtggtcgactacgcctgtggattctcctttcgcgtactntgcatgagcgtcggccgccgaggtcctccgaggaagtgggcgtggnggtggtctagaggtattaagtagtggtaggaactangttatacgnagacgtcgagaacggtccgtcttacacccgtatccgtaccgaagtacgactaacgtaccgaaacaaccaagtaccgtagtaacctcgtacgaactaaagtacaaacncggtaccctagggaaaccgacgacccgggtaaacgaaaccggaaccgtacccgttaacccgtttatttacccggtaaaggttaaaaccgaaaaccggttacttaaacccggtaanaacccgaaggtccgtacggggaaacggaccgggttaaaccaacccggg

SEQ ID NO: 122568 - DNA, 562 bp, Homo sapiens
  misc_feature: GYAE6OF02FTM8E.52.81.H04.1.454.CMB.1.raw
  modified_base (386)..(386): a, c, t, g, unknown or other
  misc_feature (386)..(386): n is a, c, g, or t
  modified_base (429)..(429): a, c, t, g, unknown or other
  misc_feature (429)..(429): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggagcttggtacagccgtggggggtccctgagactctcctgtgcagcctctggattcaccttttcgcgtctatgacatgagctggtccgcaggctccaggaatggggctggagtggggtctcgaggtattaatggtggtgaagtacatattacgcagactccgtgaagggccncgttcacctatcctccagacgacaattccaaagaaccacactntactctgtaccaaatacgaaacagccgttagagtacgacccgaaggaaccacgggcccaccttaactttcgtaacggtaacgaaacggtaacttaaccgaacaccagccgtagggacgagggtaacaacccgg

SEQ ID NO: 122569 - DNA, 515 bp, Homo sapiens
  misc_feature: GYAE6OF02JJN8G.52.81.H04.1.454.CMB.1.raw
  modified_base (456)..(456): a, c, t, g, unknown or other
  misc_feature (456)..(456): n is a, c, g, or t
  modified_base (490)..(490): a, c, t, g, unknown or other
  misc_feature (490)..(490): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcgggggaggcttggtacagcctggggggtccctgagactctcctgtgcagcctctggattcacctttcgcgtctatgacatgagcgtgggtcccgccgaggcctccgagggaatggggctgggagtggggtctcgaggtataagtgtggtggaagtacatattacgcagacgtccgtgaacgggccgcttcacatcctcagagacaattcccaagaacactactgtatctgacaaatgaacagctganacgcgagacgacgccacttatctagtacgaaganacacacagctaggacgagacgaccg

SEQ ID NO: 122570 - DNA, 658 bp, Homo sapiens
  misc_feature: GYAE6OF02J2ACT.52.81.H04.1.454.CMB.1.raw
  modified_base (316)..(316): a, c, t, g, unknown or other
  misc_feature (316)..(316): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtcttttttctgtggcttattttaaaaggtgtccagtgtgagtgcagctgctgcaggtcgggggagcttggtacagtccgtgggggtccctgagtacctcgtcctggtgcaggtcctgtggtacttcgacctttcggcgttctatgacatgagtcgtcggtccncgaggcctcgaggaacgtggggctgggacgttggtctcgtaaggtattaacgtaggtcggttaggaaagtacctagttaagttacgacgtacggtaaccgttacccggtaggaaccggggtccctaccgttaccgacctacgtctacccgaagtaacggaactaacgttaccaaagaaccacgaccttaggtactccgaggtaacaaacgttacggaaccaacggtaccctagggaacgaacggaccgaggaaccctaccgggacctacctaagtttaccgacgtaacgtaaagaaccttacaacgtacaacggtccgtaacgggacgacggaccgtaaccg

SEQ ID NO: 122571 - DNA, 539 bp, Homo sapiens
  misc_feature: GYAE6OF02HKT84.52.81.H04.1.454.CMB.1.raw
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (458)..(458): a, c, t, g, unknown or other
  misc_feature (458)..(458): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctgcaggtcggggggaggcttggtacagcctggggggtccctgagactctcctgtgcagcctctggattcacctttcgcgtctatgacatgagcgtgggtccgccaggcctaccgaggaagtggggctgggagtgggtctcgaggtattaagtagtggtaggaagtacagtattacgcagactccgtaggaacgggcctcttaccacctatccncaganacaattaccaagaacacatcgtatcagacaatcgaacngacctgagacgacgaggacacgaccacttatttcgtagtaacaagaactacaacacacgcgtaggaacgaggacgaaccgg

SEQ ID NO: 122572 - DNA, 765 bp, Homo sapiens
  misc_feature: GYAE6OF02JXMN2.52.81.H04.1.454.CMB.1.raw
  modified_base (204)..(204): a, c, t, g, unknown or other
  misc_feature (204)..(204): n is a, c, g, or t
tcagcgcagtacgacacgaccggtgctcgattagtagtgtagattcgcggggagctctgagagaggagcccagcccctgggagttttctaggtgttttctatttggtgatcaggactgaacagagagaactcaccaatggagtttgggctgagcgtggctttttctgtggctatttaaaaggtgtccagtgtgaggtgcagctnctgcgtaggcggggggagcttgggtacaggccgtggggggtccctgagactcgtcctgtgcagccgtctggacttcacctttcgcgttacgtatcggacagtacggagccggtcggtcccgacgacgggtctacccggaggaacggtcggggtcgtagggaggtcggggtcctcggtaaggtaattaacgtagggttacggtaggtaaaacggttcaaagtttaacgtacgtacggtagtacccggttacggtacggggtaaaccgggtcccgtacgtttacccgaacctaccgtaccgtacccgtaacggaacgtaaacttaaccgtaacctaaaaccggaaacgacctaaaccgtagttaaaccgtcgttataacgtaaattaaccgaaccggacgtacgtaagacgacggtaacccggaacgaaccggaccgtaccccgtaactttacgttttaacccggacggttaaacgtaaaaccggtaaccgtaaactacccgtaaaacggacccggttaacggtaaaccgggaaccgtaacggggaacctaaacccccggggg

SEQ ID NO: 122573 - DNA, 578 bp, Homo sapiens
  misc_feature: GYAE6OF02G2XQG.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcggggggagcttggtacaggcctggggggtccctgagactctcctgtgcagcctctggacttcacctttcgcgtctaatgacatgagctgggtccgccaggctccgaggagtgggctgggagtggtctcgaggttataataggtggtaggaagtacattagtaacgcaagactccggtaggaacgggccgcttaccaccactcctccagagaactaattaccaaagaacaactactagtatcgtagacaaactgaacacgtacctagaacgacggaccggaacggaaccgaccggaccctacgttactttacgtaacgtaacgaaagtaactacaacacgacgccgtaggaccggtagacgtaacccgg

SEQ ID NO: 122574 - DNA, 673 bp, Homo sapiens
  misc_feature: GYAE6OF02JXNUI.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcaggtcgggggagctggtacagccgtgggggtccctggagactctcctgtgccagcctcgtggattcacctttcgcgtctatcgacatggagcgtcggtccgccgaggcctccgaggagtggggactggaggtgggtctacgtaggtacttaagtaggtgggtaggtaagtactagttaacgttaccgctaaggtaacctccggtaggaacgggaccgtcgttaccacctatccgtaccgagaacgaactaacgtaccaaagaaccgtactacgtagttactctacgaacctaaagtcgaaaccgactaccgtagaacggaaccggtacccgggaaacggaacccgacccgggaaccctacccgtttacgtttaccgtaacgggtaaaccgtaaaacgtaaccttaacgaaacccgtaacgaacggtaaccggttacggaaaccgggtacggtaaccgaaaaccccggg

SEQ ID NO: 122575 - DNA, 596 bp, Homo sapiens
  misc_feature: GYAE6OF02IUV6R.52.81.H04.1.454.CMB.1.raw
  modified_base (401)..(401): a, c, t, g, unknown or other
  misc_feature (401)..(401): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggcgttttctggtggctattttaaaaggtgtccagtgtgaggtgcagctgctgcaggtcgggggagcttggtacagccgtggggggtccctggagactctccgtgtgcagcctctggattcacctttcgcgtctatgacagtgacgcgtgggtccgccaggcctccgaggaagtggggactgggagtggggtctcgaaggtattaagtagtggtggaagtacattattacgcagactcgtaggaggccncgttccacagtcctcgagagaacaacttccaaagtaacaactacgtagtactctagacaaatcgaaactcgacctaggagaacggcccggaaggaccgaaccgggaccctaccgttaactttcgtaacggtaacgtaaacggtaaactaaccgacgaacaacggtccgtaagggaacggtacggacgaaacccgg

SEQ ID NO: 122576 - DNA, 549 bp, Homo sapiens
  misc_feature: GYAE6OF02G5V05.52.81.H04.1.454.CMB.1.raw
  modified_base (457)..(457): a, c, t, g, unknown or other
  misc_feature (457)..(457): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcgggggagcgttggtacaggcctggggggtccctgagactctcctgtgcagcctctggattcgacctttcgcgtctatgacatgagctggtccgcaggctccgaggaatggggctggagtgggtctcgagtattaagtagtggtaggaagtacatacttacgcaagactccgtgaacgggcctacttcaccgtatcctacccagagactaattaccaaagaacaacgactgtatctgacaaatgaaacngcctagacgagaccgtaggaaccacggaccacgttacttcgagttaacgaaagaacttaaccgacacgagacgtcggacgtaggacaaccgg

SEQ ID NO: 122577 - DNA, 604 bp, Homo sapiens
  misc_feature: GYAE6OF02GMZQB.52.81.H04.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgtttctaggtggctatttaaaaggtgtcagtgtgaggcgcagctgctgcaggtcgggggagcttggtacagccgtgggggtccctgagctctcctgtgctagcctntaggnttcctaccgttttcgcgtctatgacatgagtcgtgggtccgaccaggcctacgaaggtaagtggggtctgggtagtcggggtctagaggttataagtggtggtagaagtacattagtacgctagacgtcgtaggaaggccgtacttacgaccattccaccgaggtaacacgtaaactaccgaaagaacctacgacttagaactcgtgaaccaaatacgaacacgcgtagaacgacgacccgaaggtaacctacggaccctaccgttattaccgaaggttaaccgaaagaactaaccacgaacacggtacggtaacggacgggtacggacgaaacccgg

SEQ ID NO: 122578 - DNA, 762 bp, Homo sapiens
  misc_feature: GYAE6OF02GLQTI.52.81.H04.1.454.CMB.1.raw
  modified_base (319)..(319): a, c, t, g, unknown or other
  misc_feature (319)..(319): n is a, c, g, or t
  modified_base (445)..(445): a, c, t, g, unknown or other
  misc_feature (445)..(445): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcggtgtgtttctaggtggctatttaaaggtgtcagtgtgaggtgcagctgctgcagtcgggggagtcgttggtacagccgtgggggtccctgacgtactctcctgtcgcacgtcctcgtggtacttcctaccgtttcgcgttctaatcgactatgacgcgttggggtccnccgaggtcctaccgaagggtaacgttcgggggcttgggagttcggggtaccgtacgtaacgggttaactttaaaggtaggttcgggttaaggggtaaacttaccgtaatttaacggtttaacccgngtaaacgtaacccggtttccggtaagggaaacgggtccccggtacgttttacccaacccgtaacttcccgtaacctaagggtaaacgaaaccctttaaaacgttaccccgaaaacggtaaaacccacggtaacctttaggttaccttacgtacggtaaccgaaaaagttaccgggaaactacggtacccgtaaggaacgggtaccggaaccgtacgggaacccgaaccgtcccgtaacgtttacgttacgtacggtaaaacgaaacgtaacaaccgtacgactacgtaccggtaggaacggtaggaaccgaacccgg

SEQ ID NO: 122579 - DNA, 714 bp, Homo sapiens
  misc_feature: GYAE6OF02JEGJT.52.81.H04.1.454.CMB.1.raw
  modified_base (177)..(177): a, c, t, g, unknown or other
  misc_feature (177)..(177): n is a, c, g, or t
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagcgtgtgttctaggtcgctaatttaaaggntcagtgtgaggtgcagctgctgcgagcggggganttaggcaggccgttgggggtcctaggagcctcgtctggtnacngcctgtagattccgtctttgccgttaatagcgtatagttgacgcggttaagggtcccaaccgttggtccctaactaaggggtacggttacggggcgttaagggtccggttaacggtcgttaaggtacgttaagttaacggttacggtagggtaaccgtaaagtacgtaagttacgtacggtaggtaaccgtaggttaccggtacgggaccggtccttcgttaacctaaacgtcgttccgaacgtacgtaacgtaacgtaacgtaaccgtaaacgtaaaccgttaacgtaacgttacgttacgtacgtacgtaacgtaacgtaacgtaacgacgtacgtaacgtaacggtaaccgaaccggtaacggtaaccgaccgtaccgtaccgttaacgttacgttaacgtaacgtaaacgtaacgtaccgaacgacgacgtacgtacggacggtacggaccgaacg

SEQ ID NO: 122580 - DNA, 731 bp, Homo sapiens
  misc_feature: GYAE6OF02JUQ5M.52.81.H04.1.454.CMB.1.raw
  modified_base (232)..(232): a, c, t, g, unknown or other
  misc_feature (232)..(232): n is a, c, g, or t
tcagcgcagtacgacacgaccggtgctcgatttagtagtgtagattcgcgggagctctgagagaggagcccagccctgggattttcaggtgttttctatttggtgatcaggactgaacagagagaactcaccatggagtttgggctgagcgtggtctttttcttgtggtcttattttaaaaggtgtccagtgtgaggtgcagctgctgcgaggtcgggggagcttggtacgnggccgtgggggtccctgacgtacttcctccgttgtgtcgacgtccgtcgtggtattccgtacgttttccgcgttccgtaatcggaactatcgaggtccgtcggggtcccaccgaggccttaccgaagggtacggtcgggggtcctgggggtcggtccgggtactaagggtagttaaattaggttaggggtacggttaggtaaacctacgtaagtttaacggtacgtaccgtacggttacccgtcggggtaacgggtaacccggtccgttaccgttaaccgtaccgtaaccgttacccgaaccgaaacgtaacgaaaccgtaccgttaaccgtaacgaaacctaacgtacgttaacgtacgttcgtaacaacgtaacgtaaacaagtaccgtaccgagtaacgacggtaacgacggaccgacgtaccgttcttacgtttcgaacggtaacaacgtaacaccgaacgtacgacgtagtacggaacggaagaccgtaaccgg

SEQ ID NO: 122581 - DNA, 672 bp, Homo sapiens
  misc_feature: GYAE6OF02IJZ0P.52.81.H04.1.454.CMB.1.raw
  modified_base (148)..(148): a, c, t, g, unknown or other
  misc_feature (148)..(148): n is a, c, g, or t
  modified_base (218)..(218): a, c, t, g, unknown or other
  misc_feature (218)..(218): n is a, c, g, or t
  modified_base (565)..(565): a, c, t, g, unknown or other
  misc_feature (565)..(565): n is a, c, g, or t
tcagcgcagtacgacacgaccggtgctcgatttagtagtgtagattcgcgggagctctgagagaggagccagccctgggagttttcaggtgttttcatttggtgatcaggactgaacagagagaactcaccatggagtttgggctganctggctttttcttgtggtctaagttttaaaaggtgtcagtgtgaggtgcagctgctgcaggtcgggggancttggacagtccgtgggggtccctggacgtactctccgttgcgtacgcgccttgacggtattccgtaccgtttcgcgttcctaagtcgactacgtgacgtcgtcggggttcccgccgtaagggtcccttaccgagggtaacgttcggggtaccgttgggaacggttggtaccgtacgtaggtactttaaagtcggtgggttaagaacgttaacgacgttaagttacgaccgaaggtactccggtaaggaacggtcccgtacgttccgactactcgtaccgagtacgtaacgtaacgttaccgaaagaccgtaacacgttacgtactagtacgactaaagacgtaaancgtaccgtagaacgacgaccggtagaccgaaccgactaccgttatttaccggcttaaacgaacgtaaatcccaaatacgtaacgcctaagggaacgcggaacaccgg

SEQ ID NO: 122582 - DNA, 546 bp, Homo sapiens
  misc_feature: GYAE6OF02FHH0A.52.81.H04.1.454.CMB.1.raw
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctattctgtacgaaagaatacacacagctggacgaggagccaaacggcgactactctttgactactggggccagggaccctggtcaccgtctcctcacgcctccaccaagggcccatccggtcttccccctgaccaccctccctccagacgccaccgtctcgggggcacgacgccggccctcgggcctcggccctggtaccgg

SEQ ID NO: 122583 - DNA, 665 bp, Homo sapiens
  misc_feature: GYAE6OF02I7YO8.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttatttaaaaggtgtccagtgtgaggtgcagctgctgcgaggtcggggggagtcgttggtacaggccgtgggggtccctgagctctctgtgcagtcctctggacttccaccttttcggcgttactagtgactgtagacgtccgttcgggtcccgccgacggtcctaccgaggtaacgtggggctgggagtcgggtcctgaggtattacgtaggtcggtaggaagtacaattagttacgcaagtccgtacggtagggtaacgggccctcgttaccactacgttacctaccgagacgtaacgaaattacccgaaagtaaaccacgtaacttacgtactacgtagaacctaaatacgaacacggacctaggaacgacgaccggaaggtaaccgaccgtaccgtaccgttacgttaccgtaaacgtaaaccggtaaacgtaaactaaccgtaaaccgacgaacgtaccggtaacggaaccggtaaggaccggtaaacccgg

SEQ ID NO: 122584 - DNA, 639 bp, Homo sapiens
  misc_feature: GYAE6OF02I2WYP.52.81.H04.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (501)..(501): a, c, t, g, unknown or other
  misc_feature (501)..(501): n is a, c, g, or t
  modified_base (514)..(514): a, c, t, g, unknown or other
  misc_feature (514)..(514): n is a, c, g, or t
  modified_base (626)..(626): a, c, t, g, unknown or other
  misc_feature (626)..(626): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagcgtgtgtttctaggtggctatttaaaggtgtcagtgtgaggtgcagctgctgccaggtgggggagcttggtacnggccgttggggggtccctgaggctctccgtgttgcacgccgtctggtattctacctttcggccgttacttactgaacngttagnggtcgttcggggtccgccgacggctaccgagggtagtgggctagggngggtcggtntacgtaggttatttaagtaggttgggtacggtaagtacagtttaagttacgactaggtacccttcggaggtaacgggcgtcttaccaccgtatacctcgagagaactaagttaacccaagaactaacacttagtacncgtacaacttaanacgaaaccgtagtaccgagtacgaacgaccgaacggaaccgaccgacccgtactacgtttaccgtacgtaaaccgtaaggaactaacgacactaacggacggtacgaacggnggtacgaacccgg

SEQ ID NO: 122585 - DNA, 582 bp, Homo sapiens
  misc_feature: GYAE6OF02GJLJ9.52.81.H04.1.454.CMB.1.raw
  modified_base (415)..(415): a, c, t, g, unknown or other
  misc_feature (415)..(415): n is a, c, g, or t
  modified_base (444)..(444): a, c, t, g, unknown or other
  misc_feature (444)..(444): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacaggcctggggggtccctgagactctcctgtgcagcctctggattcacctttcgcgtctatgacatgagctgggtccgccaggctccgaggaatggggctgggagtgggtctcgaggtattaagtagtggtaggaagtacatatacgcagacgtccgtggaacggccgcttaccaccgatcctacaganacaattcccaaagaacacactgtactctnacaaatcaacagtacctaggacgagaccggaggaaccaccgggaccaccgttatttaccgtacggtaaaaccgaaacggaaacttaaccaacgaccgtacgaccgttacggggaccgtaagggaccggtaaaccccgg

SEQ ID NO: 122586 - DNA, 704 bp, Homo sapiens
  misc_feature: GYAE6OF02JAT5N.52.81.H04.1.454.CMB.1.raw
  modified_base (176)..(176): a, c, t, g, unknown or other
  misc_feature (176)..(176): n is a, c, g, or t
  modified_base (600)..(600): a, c, t, g, unknown or other
  misc_feature (600)..(600): n is a, c, g, or t
  modified_base (666)..(666): a, c, t, g, unknown or other
  misc_feature (666)..(666): n is a, c, g, or t
  modified_base (682)..(682): a, c, t, g, unknown or other
  misc_feature (682)..(682): n is a, c, g, or t
tcagcgcagtacgacacgaccggtgctcgatttagtagtgtagattcgcggggagctctgagagaggagcccagccctgggatttcaggtgttttcatttggtgatcaggactgaacagagagaactcaccatggagtttgggctgagctggcttttctgtggctatttaaaggtntccagtgtgagtgcagctgctgtcaggtcgggggagcgttggtacagccgtggggggtcctgacgactcgtccgtgtgcacgtccttcgtggtacttccgtaaccctttcggccgttactagttcgactaagttacggtacgccggttacgggtcccgtccgtacggggtaccctacccggtagggtaacgttcgggggtaccgtagggtacgggttcggtacgttacggtaaggtttaatttaaacggaggggtttagggtaacgggtaaaaggtttacctaacgtttaaacgttacgacgaacggttaccgtaccgggttaaggaaccgggtaccgtccttaaccggactaacgtccttacgaacggagtaacctacgttaaccgaaataaccagtacccttagtacctgtacgtaccaaancgtaaactcggtacctagggtaacgacggtacccaaggccaggacctcgtattcggaactaacganaacctaacactagacncggtaaggccggagaagaccgg

SEQ ID NO: 122587 - DNA, 598 bp, Homo sapiens
  misc_feature: GYAE6OF02HGTBL.52.81.H04.1.454.CMB.1.raw
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
  modified_base (340)..(340): a, c, t, g, unknown or other
  misc_feature (340)..(340): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgctgcaggtcggggggaggcttggtacaggccgtggggggtccctgacgactctccgtgtgcngcctcgtggacttcacctttcgcgtctatgactatgacgcgtgggtccnccgaggctccgaggaagtggggctggngtggtctagtaggtatagtagtggtagaagtacatactacgcagacctcggagaacgggcctacgttccacctactcctaccagacgactaacttaccaaagaaccaactactacgtactctacgtaactaaagtcgaaaccgacgtaccgtaggaacgacgtaaccggacggaaccgaccggcctaccgttactttcgaacgtaaccgtaaagaactaccgaacacgtcgacgtaggaaccggtaggactaacccgg

SEQ ID NO: 122588 - DNA, 638 bp, Homo sapiens
  misc_feature: GYAE6OF02ITNAU.52.81.H04.1.454.CMB.1.raw
  modified_base (175)..(175): a, c, t, g, unknown or other
  misc_feature (175)..(175): n is a, c, g, or t
  modified_base (306)..(306): a, c, t, g, unknown or other
  misc_feature (306)..(306): n is a, c, g, or t
  modified_base (408)..(408): a, c, t, g, unknown or other
  misc_feature (408)..(408): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
  modified_base (532)..(532): a, c, t, g, unknown or other
  misc_feature (532)..(532): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggcttttctgtgctatttaaaggngtccagtgtgagtgcagctgctagcaggtcgggggagcttagggtacaggccgttgggggtccctaggacgacgtcctcgtggtgaccaggccctgtaggcttcctacctttcgacgttctaatcggaacngttagacgtcgttggtcccgctaacggctacccgaggaagttggggccttgggaggtcggggtttacacggtagtaatttaagaaggttcggagaaccgtanataacgtcgactagacgttcccgaggaccggccgtattcaacgtanctacagtacgaataactccaaagacgacacgttntaactgtacgaaacctaanaggaaaccncgtaccgagaacgtanaccgggaacgacgtaacgtcccctaagttacttccgttaaggaaccaaaaggaaccttacgaaactcccgtaaggaccgtaacggaacggaccggtagaaaccccg

SEQ ID NO: 122589 - DNA, 673 bp, Homo sapiens
  misc_feature: GYAE6OF02G562U.52.81.H04.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacaggtcctgggcccagtctgtgttgacgcacgccgccctnagtgtctgccggcccaggacagaacgtcactatctcctgcctgtggaacncagcctacaactagttaggactaaattaagttttcggtcgttaccgttaggtaacccaggtaccaaaccgttccccgaggtaccaaccaccggaacccccctaaaactcctactatttactacgaactaaatgaactaacgtcccgaaccctgacggtactacgcgaacctnttctcgtcgcctactacgtcagcacgtcacgccctaccgtggacctacgtaccgacccggtaactccgaacgtcggtacggggacgacggtctaacgttgttaccgtggaaccgtaacgtaggtacgggtaacacggtaccgaacggtaccgtagggtacgtacggtaaccggtcggaacccggttaagggggttaccggtttcggggaacgggtaaccgggtaaaccgtaacggtccgggttaccgtaccccggttaccggg

SEQ ID NO: 122590 - DNA, 646 bp, Homo sapiens
  misc_feature: GYAE6OF02GZLY0.52.81.H04.1.454.CMB.1.raw
  modified_base (609)..(609): a, c, t, g, unknown or other
  misc_feature (609)..(609): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgctgcagtcgggggagcttggtacaggcctggggggtccctgacgactctcctgtgcagcctcgtggtattcacctttcgcgtctatcgacatgagcgtgggtccgccaggcctaccgaggagtgggctgggacgtggctcgaggttaatagtaggtggtaggaagtactatacgttacgcgagtacctcggtaggaacggccgtacttaccgacctagtcctaccgaagggtaactaaccgtaaacgtttcccaaaacggtaacctaacgaccgttacggttaactccgttagaacctaaagtacgaaccgacgtacccgttagacggtacgtaccgaaaggaacccgaccggtacctaccgtttacgtttccgaacggttaaaccgaaagtacctactaaccggaacnggtaccgtacggggtaacgacgggtactaaaccccgg

SEQ ID NO: 122591 - DNA, 634 bp, Homo sapiens
  misc_feature: GYAE6OF02HH6WX.52.81.H04.1.454.CMB.1.raw
  modified_base (224)..(224): a, c, t, g, unknown or other
  misc_feature (224)..(224): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaanagtggtggaagtacatattacgcagactccgtgaagggccgcttcaccatctccagagacaattccaagaacaacactgtatctgacaaatgaacagccctgaagagccggaggacacggccacctatttctacgtacgaaaacgaataccacaacagctggacgaggacgaccaacggcgactactttcttgactacgtcgggaccacgggtaacccctgggtccacccggtccttcccgtaccacgaccctcccaacccgaaccgggaccccaacgttccggttaccctttcccccgtcgggacccctaccccgttacccgtacccgaacgacgtacccgtacccgtccggtccggggaccaaccgacgtaccggcccggtcgggccgtcggtcccgtcggtaaccgg

SEQ ID NO: 122592 - DNA, 625 bp, Homo sapiens
  misc_feature: GYAE6OF02GKEN9.52.81.H04.1.454.CMB.1.raw
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcgttttctggtggctaattttaaaaggtgtccagtgtgagtgcagctgctgcaggtcggggggagcttggtacacgccgtcggggggtccctgagactctcctgtgcagcctcgtggacttcacctttcgcgtactatgactatgacgcgtcgggtcccnccgtaggcctccgaggagtgggctaggngtggtctcgagtattagtagtcggtagaagtacagttactacgctagactccggtagaacgggcctacttccacgtactccaccgagtacgtaactaacttacccgaaagacctaacacttagtactacgtgaacctaaagtcgaaacctcgacgtacggaagacggccggtaaggaaccgaccggacctaccgtttatttaccggtaacggtaaacgtaaaacggtaacttaaccgaccgaactacggaccgtacgggaacgacggaaccggtaaacccgg

SEQ ID NO: 122593 - DNA, 785 bp, Homo sapiens
  misc_feature: GYAE6OF02GPWXG.52.81.H04.1.454.CMB.1.raw
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcgccccaggacagaaggtcaccatctcctgctctggaagcagctccaactattggactaattaattttgtcgtcctggtaacccagtaccaacctcccgaggccaaccgaccgaccccccaaaaccttccctactaattttacacgaactaaagttgaaacgttaaacgcccgtaaccccttacggaacggggaactttaacccgtacggtaacccgttacttttacccgtccgttaccgggtacccttaacccgtaaaggttccgtacgggaccctacccggttacccgaaccggtaccccctaaccccgggtggggaaccctaacggttaccccggaaaccccgggtaccttaccccgaagggtacccgggttaggggggaacccgaaccgggtacccggttaaattttaaccgttaacggtcggtaacccgggaaactagggttacggggaaacttacggaccgtacggtccgttaggacggttacggacgttaccggaccgggttaagggggtttaccggttccggggaacgggtaaccggggaaccctaagggtcccggtaccggtaaccccgggttacccggg

SEQ ID NO: 122594 - DNA, 718 bp, Homo sapiens
  misc_feature: GYAE6OF02JF1EX.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagctggtctttttcttgtggcttattttaaaaggtgtccagtgtgagtgcagctgctgcagggtcgggggagtcgttggtacacggccgtgggggtccctggacgtactctccgtgtcgcacgtcctcgtggactttccgtaccgttttcgacgttctagtcgaactagtgacgtccgtggtccgccgaggcctcgaaggagtcggggctgggagtgggtctacggagttaattaagtaggtggtaggtaacgtactagttaatcgactaacgtccgtaccggtaggaacggggtccctacgtttaccgaacctacgttacccgtacccgtaagaacgtaacgtaaacctttaacccgaaaacgtaacgtaacccgtaacgtttacgaacttaccgtagtaacctaaagtaccgtaaaacaccggtaaccgtaggaaccggaacgtacccgggaaaggaaccgacccggtaaccttaccgttagtttaccgtaaggtaaaaccgaaacgtaactaacccggaataccgtaacgggttacaacgggtaaccggaacgggtacgaaaccccggg

SEQ ID NO: 122595 - DNA, 654 bp, Homo sapiens
  misc_feature: GYAE6OF02GIO0G.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcgaggtcggggggagcgttggtacaggccgtggggggtccctggagactctcctgtgcgacgcctctggattcctacctttcgcgtactatgactatgagtcgtcggggtcccgccgacggcctaccgaggagtggggacgtgggtaggtcgggtctacgaggttaattaagtaggtggtaggaacgtatattattacgcgtacgacgtcgtaggaacgggcctacgtacacctactcctaccgagtacgaactaactaaccgaaagaaccacactagtactactacggaactaatacgaacacgtacgtaggaacgacgtaccgaacgggtaacaccgggtaccctacctttacgtttaccggtaaacggtaacggtaaaacgtaacgtaacctaaccgacgtaacggtaccggaagggtaaccgggtaacggacggaaaccccggg

SEQ ID NO: 122596 - DNA, 565 bp, Homo sapiens
  misc_feature: GYAE6OF02G3KDA.52.81.H04.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (446)..(446): a, c, t, g, unknown or other
  misc_feature (446)..(446): n is a, c, g, or t
  modified_base (506)..(506): a, c, t, g, unknown or other
  misc_feature (506)..(506): n is a, c, g, or t
  modified_base (546)..(546): a, c, t, g, unknown or other
  misc_feature (546)..(546): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaanagtggtggaagtacatattacgcagactccgtgaacgggccncttcaccatctccagagacaattccaagaacacactgtatctgacaaatgaacngctgagagccgaggacncggccactnttcagtacgaaagatacacacagctggacgagacgccgaacgcgactacttcttgactacgtcgggaccacgggacccgtggtaccaccgtctcctcacncccaccaccgacggccctacgtccgtccttccccgtcgcccaccctccctaccacgtccnccgaccgtccggtcggggaccaccggacgccggtcccggnggccgtcgccgtggtaccg

SEQ ID NO: 122597 - DNA, 628 bp, Homo sapiens
  misc_feature: GYAE6OF02HU0VT.52.81.H04.1.454.CMB.1.raw
  modified_base (337)..(337): a, c, t, g, unknown or other
  misc_feature (337)..(337): n is a, c, g, or t
tcagcgcagtacgacacgaccggtgctcgatttagtagtgtagattcgcgggcacgaccggtgctcgatttagtagtgtagattcggcgggggggaggcttggtacagcctggggggtccctgagactctcctgtgcagcctctggattcacctttcgcgtctatgacatgagctgggtccgccaggctccaggaagtggggctggagtgggtctcaggtattaatagtggtaggaagtacatattacgcagtactccgtaggaacgggccgcttcaaccatctccagagacaattccaaagaacacactgtaatctgacaaatgaacagcctgagngccgaggacacggcactattctagtaacgaaagaatacacacagctaggacgaggacgaccgaaacggcgaactacttacttgtactacgtacgggccgaacgggtaacccgtggtacctaccgtccttaccgtccacgtccctcctaaccgaacggcccacgtccggttcccttcccccgtcggcccaccccttccctacccgaacgacgaccacccgttaccggtacgggggtaccaccgacggacccgggtcccgtcggggtcccgtccggtcccgtcggtaacccgg

SEQ ID NO: 122598 - DNA, 546 bp, Homo sapiens
  misc_feature: GYAE6OF02GVUF7.52.81.H04.1.454.CMB.1.raw
  modified_base (303)..(303): a, c, t, g, unknown or other
  misc_feature (303)..(303): n is a, c, g, or t
  modified_base (500)..(500): a, c, t, g, unknown or other
  misc_feature (500)..(500): n is a, c, g, or t
tcagcgcagtacgacacgaccggtgctcgatttagtagtgtagattcgcgggggagcctctgagagaggagcccagccctgggattttcgaggtgttttcatttggtgatcaggactgaacagagagaactcaccatggagtttgggctgagctggctttttcttgtggctattttaaaggtgtccagtgtgaggtgcagctgctgcagtcggggggagcttggtacagcctggggggtccctgagactctcctgtgcagcctctggattcacctttcgcgtctatgacatgagctgggtccnccgaggctccgaggatggggctgggagtgggtctcgaggttattaagtaggtggttaggaagttacattacttacgcaacgactccgtaggaacgggccgtcttcaccatcctccgagacgtaactaattacccaaagaaccacactagtatctagacaaatgaacacgcctagagacgccaggacaccggccactnttacgtagtaacgaataactacacacagctaggacgaggacaaccg

SEQ ID NO: 122599 - DNA, 633 bp, Homo sapiens
  misc_feature: GYAE6OF02HV725.52.81.H04.1.454.CMB.1.raw
  modified_base (360)..(360): a, c, t, g, unknown or other
  misc_feature (360)..(360): n is a, c, g, or t
  modified_base (476)..(476): a, c, t, g, unknown or other
  misc_feature (476)..(476): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggctattttaaaggtgtccagtgtgaggtgcgagctgctgcgaggtcggggggagtcgttggacaggccgtggggggtcctgacgactctctgtcgcagtcctcgtggacttccgtacctttcgcgtctagtgactagtgacgtcgtcggggtccgaccgaggtcctaccgaggagtggggcgtggtaggtcggtncgtaggttattaagtaggtaggtaggaagtataattacgtacgactacggaccgtcggaggtacgggtcctactaccgactacttcgaccgtaagaacgtacctaactaccgaaanaaccactaacgtgttaactctacggaacctaaagtacgaacgtacgccttaaggagaccggtacgaaggaccgacggtacctacgttctttacgacgtaaacgtaacgaactacctaacgacgaacgcgtaacggaaggtaccggaacgtaacccgg

SEQ ID NO: 122600 - DNA, 553 bp, Homo sapiens
  misc_feature: GYAE6OF02GTYSD.52.81.H04.1.454.CMB.1.raw
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (438)..(438): a, c, t, g, unknown or other
  misc_feature (438)..(438): n is a, c, g, or t
tcagcgcagtacgacacgaccggtgctcgatttagtagtgtagattcgcggggagctctgagagaggagcccagccctgggattttcaggtgttttcatttggtgatcaggactgaacagagataactcaccatggagtttgggctgagctggctttttcttgtggctatttaaaaggtgtccagtgtgaggtgcagctgctgcagggtcggggggaggcttgggtacacggccgtgggggggtcccctgagacctctcctgtgcagcctctggattcacctttcgcgtctatcgacatgagcgtcgggtccgccgaggcctaccgagggaatcggggctggaggtgggtctcgaggtattagtaggtggtggaagtanatatacganagactcggngaacgggccncttacacctanctcagacgacaactaccaanaacacaccttgtactctagacaaatagaacagtcctagagcgaccgagaccgacgcaccttagttcagtaacgaagaaactacaacactacgacgtaggacggaggacgaacccg

SEQ ID NO: 122601 - DNA, 941 bp, Homo sapiens
  misc_feature: GYAE6OF02JHP80.52.81.H04.1.454.CMB.1.raw
  modified_base (179)..(179): a, c, t, g, unknown or other
  misc_feature (179)..(179): n is a, c, g, or t
tcagcgcagtacgacacgaccggtgctcgatttagtagtgtagattcgcggggagctctgagagaggagcccagccctgggatttcaggtgttttcatttggtgatcaggactgaacagagagaactcaccatggagttgggctgagctggctttttcttgtggtctatttaaaaggtntccagtgtgaggtgcagctgctgcgaggtcggggggaggtcgttgggtacaggtccgtggggggtcccctggacgtacgtctcctgtgcgagcctctggattcctacctttccgcgttctatgacatgacgtcgtcggggtcccgccgacggccttacccggaagggtaacgtcggggggtacctaggggtacggttcggggttaccgttaccgtaaggggttaacgttttaaaggtaacgggtttacggggttagggttaaaacggtttacgaacggttttaaacgtttaaacccggaccgttaaacgggtaccccgtttaacccgggttacggggaaacggggttacccccgggttacccgtttaaccccgtaaccccggttaattttaccccggttaacccccgggtaaagggtaaaccggtaaaccgtttaaaaccgtttaaccccgaaaacccggtaaaaccgtaacccgtaaaccgtttaacggttaaccttaacccgttaaccggtaaaccctaaaacgtttaaccggaaaacccggtaaccgggtaacccgtagggtaaaccgggtaacccgggtaacccggtaaaaccggggaacccccggtacccgggtaacccccgttaacccggttttaaacttttaccccgggtaaacggttaaaaccggttaaaacgtaaaccgttaaccgaaacccgtaaccgtaacgggtaacccgtacgggtaaaccggggaacggaacccggtaaaccccgggg

SEQ ID NO: 122602 - DNA, 720 bp, Homo sapiens
  misc_feature: GYAE6OF02GRJ2E.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggcttattttaaaggtgtccagtgtgaggtgcagctgctgcgaggtcgggggagcgttggtacaggtccgtggggggtccctggacgactctccgtgtcgcagcctcgtggtattcctaccgtttcgcgttactagtcgactagtgacgtcgtcgggtccgccgtacggcctaccgaggacgtggggacgtgggtaggtcgggtctcggtaaggttaactttaagtagggttgggtaacggtaaagttaccgtaagtttaacgttaaccggcgtaacgttaccgttaccgggtaagggaaaccgggtcccgttacgtttaccgaaacccgtacgttacccgtaccgaaaggtaacgtaaaccttaaccgttaaccgaaacgtaaaccaccgtacttacggttactacgttacgaactaaagtcgaaacgacgtactaggaacgacgaccgaagccgaacccgggtacctacctttacgttaccgtaacggaaaaccgaacgtaaacgtaccaacgtacgacgtaccggtaacggacggaacggtaccgaaacccgg

SEQ ID NO: 122603 - DNA, 567 bp, Homo sapiens
  misc_feature: GYAE6OF02FIWQY.52.81.H04.1.454.CMB.1.raw
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (437)..(437): a, c, t, g, unknown or other
  misc_feature (437)..(437): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatgtggtggaagtacatattacgcagactccgtgaagggccgcttcaccatctccagagacaattccaagaacacactgtatctagccaaatgaacancctganagccgaggacacggccacctattctgtacaaaagaatacacaacagctggacgaggagaccaaacggcgactacttctttgactacgtcggggccagggaaccctggtacncccgtctccctcacgtcctccaaccgaacggacccagtccggttccttacccccgtggtcccacccgtccctccacgacgccaacctcgcggggcacgacgccggcccgtcggctcgtccgtggtaacgg

SEQ ID NO: 122604 - DNA, 596 bp, Homo sapiens
  misc_feature: GYAE6OF02FH4YX.52.81.H04.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (322)..(322): a, c, t, g, unknown or other
  misc_feature (322)..(322): n is a, c, g, or t
  modified_base (424)..(424): a, c, t, g, unknown or other
  misc_feature (424)..(424): n is a, c, g, or t
  modified_base (465)..(465): a, c, t, g, unknown or other
  misc_feature (465)..(465): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagcgtgcgtttctagtggctatttaaaaggngtccagtgtgagtgcagctgctgcagtcggggagcttgacagccgtgggggtccctgacgactctcctgtcgcgngcctcgtggcttcnccttttcggcgttactatgaccattggacgtcgtggccgcacggcctcacggtaancggggtctggagtcggggtactacggtaggtattaaagtgtaggtcgggtaagtaccattacgtacacgtagaccgtccggtagacgggtcctacttcaacncgttcacccgagacacttaaactccaaagaccaactcgtanactctagaccttaagacactacgacgttagaacgacgaccgtacggactaccggaccctagtacttcgacgttaacgaaacgttaacaccgaacacgtaacggtctacggggaactacggaacgaacccgg

SEQ ID NO: 122605 - DNA, 690 bp, Homo sapiens
  misc_feature: GYAE6OF02F0YG8.52.81.H04.1.454.CMB.1.raw
  modified_base (564)..(564): a, c, t, g, unknown or other
  misc_feature (564)..(564): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctaggtggctaattttaaaaggtgtccagtgtgaggtgcagctgctgcgaggtcggggggagtcgttggtacaggccgtcggggggtccctggagactctcctgtcgcagcctctggacttccaccttttcgcgtctatgactagtgacgtcgttcgggtacccgccgacggcctaccgaaggtaacggtggggtcctagggcggttcgggggtctacggtaaggttaacttaagttagggttagggtacggtaaagtacgtaaagtttagttaaccgacgtaacgtaccgttacgggttaagggaacgggtcccgtaccttaccgaacctaactccctaaccgaagaacgtaacctaaacttacccgaaacgtaaaccacgtaacttagttaactccgttaanaactaaacgtacgaacacgtacgtagagacgaccggaacgaccgacgtacccttacgttacttacgtaacgtaaacgaaacgtaactacgacgacgtacgtacgacgggaacgacggaccgaaccg

SEQ ID NO: 122606 - DNA, 562 bp, Homo sapiens
  misc_feature: GYAE6OF02HGV5V.52.81.H04.1.454.CMB.1.raw
  modified_base (495)..(495): a, c, t, g, unknown or other
  misc_feature (495)..(495): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactcgtgaagggccgcttcaccatctccagagacaattccaagaacacactgtatctgcaaatgaacagcctgagacgccgaggacacggccacctattcagtacgaaagatacacacagctaggacgaggacgaccgaaacggcactacttcttcgactacgtcgggccgacgggacccgtggtccaccgtctcctcacgccctccaccgaacggcccacgtccggtccttccccgtcggtcccnccctccctaccacgacgtccgacctccgtcggggccacgcgccggccgtcggctcgtccgtgtaccg

SEQ ID NO: 122607 - DNA, 644 bp, Homo sapiens
  misc_feature: GYAE6OF02I1B2W.52.81.H04.1.454.CMB.1.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (274)..(274): a, c, t, g, unknown or other
  misc_feature (274)..(274): n is a, c, g, or t
  modified_base (517)..(517): a, c, t, g, unknown or other
  misc_feature (517)..(517): n is a, c, g, or t
  modified_base (549)..(549): a, c, t, g, unknown or other
  misc_feature (549)..(549): n is a, c, g, or t
tcagcgcagtacgacacgaccggtgctcgatttagtagtgtagattcgcggggagctctgcttcagctgtgagcgcagaaggcaggactcgggacaatcttcatcatgacctgcctcccctctcctcctcacccttctcattcactgcacagggtcctgggcccagtctgtgttgacgcagccgccctcagtcgtctgcggccccaggcagaaggtcaccatcnctgcnctggaancagctcaacatggactaataatttgtgtctaggtaccngacaactccagcacacgccccaaactcctacatttatgacaacttgaacttaacgccgtaaccctctaaggggaaccttaccgtacgtaacccggtattaccgtacgttaccgggtaccttaccccgtaaagtcccttacgggacctaccgtacgaaccgacccaacccggttaggacctataccacccggtaacctcgaacggtacgaggggaccgtaaggaccctaaagttactttaacgnggaccggtaaactacgtcgggaagtacggtanacgttaccgtagacgttagcgtttacgacggttaaggggttaccgttacgggaccggtaacggggaacccaaggtccgttacgacccggttaacg

SEQ ID NO: 122608 - DNA, 660 bp, Homo sapiens
  misc_feature: GYAE6OF02IWIJ8.52.81.H04.1.454.CMB.1.raw
  modified_base (477)..(477): a, c, t, g, unknown or other
  misc_feature (477)..(477): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagtttggctgagcgtgtcgtttctaggtcggacttaagtttaaaggtgtcagtgtgaggtgcagtctgtctgcgtagggtcggggggagtccttagggtacacggtccggtcgggggtccctgaacgtacctcgtccgtgtcgcgcgtcctacgtggtacttccttaccgtttcggcttactatcgactgtgacgtcggttcgggaccgcgacggtcctacggaggtacggtgggtctagggtggtggtactcgtaagttaattaagtggtagggtacgtaataacgtagttaagtaccgtacacggtacgtccggtaggaacgggtcctacttccaacgtntaccgtacgagtaacgacttaacctaaccgaaatacgaactacgttacgtactacgtacgaaactaagtacgaaacctcgtacgtagacgtaaccgacgaggtacctacgaccttagttacgtagtaacggtaaacgtaagaactacggataccggagtcgacggaacgtacggacgtaacgg

SEQ ID NO: 122609 - DNA, 938 bp, Homo sapiens
  misc_feature: GYAE6OF02ICQPB.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagcgtgtctttttcttgtggcttaatttttaaaaggtgtccagtgtgaggtgcagctgctgccgaggtcggggggagtcgttgggtaacacggtcccggttcgggggggttcccctggtaacggtaccttcccgtccgttggtcgaccgacggcccttcgtcggtaactttcccgtaaccgttttccggccgtttacttatacgtactaagttcgacggtcggttcggggtaccccgccgtgggtcctacccgaaggggtaaggttcgggggacgttaggggtcgggttcgggttaccgtacggtaaggttaaagtttaaggtagggttagggtaaggtaaacggtaacttaaacgttaaacgttacggtacctaacggttacccgtaaccgggttagggaaaccgggtcccgtaaccgtttaccggtaaaccctacgttacccgtacccgtaaaggtaaacgtaaaaccgttaaaaccgtttaaaccgaaaacccggtaaaacctaaaaccgttaaccgtttacgttaaaccgtttacgttaacgaaaaccgggtaaaactttaaaccgaaactacccggtaaaccgttaacgggaacggttaaacccggtcccgggaaaacccggaaccggtaacccgggtacccgttaaccggtttacctttttaaccggtaacggtaaaaccgttaaaaacgggtaacccctttaaaaccggaaccgtaaaccgggtacgtttaaacccggggacgggttaaacccgggtaaccgggtaacgggtaaaaccccccggg

SEQ ID NO: 122610 - DNA, 778 bp, Homo sapiens
  misc_feature: GYAE6OF02H6SC8.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagcgtgtcgtttctaggtcggcttaagtttaaaggtgtcagtgtgagtgcagctgctgcgaggtcgggggagtcgttggtacacggccgtggggggtccctggaacgtcgttcctccgtgtcgcacgtcctgtcggacttccgtaccgtttcgcgtctatcgtacagtggagtcgttcgggtaccgccgacggtcctaccggagggtaacggtcgggggcgtggggacgggttcgggtcctaggtaaggttaacgttaaaggttaggttggggtaacggtaaacgtaacgtaagttaacgttaccggactaacggtaccggttaccggtaagggtaacccggggtcctactttaacccgaaccgtaacgtttcccgtaacgaaggtaaaccgaaacctaaacgttaaccccgaaaacggtaaacctaaccgttaacgtacgttacgttaacgaccgaaattaaacgtacgaaacccgtcggtaccgaacgggaacgacccggaaccgggaacggtaacccgaaccgtacctaccgttttagtttacccggaaacgttaaacgtaaacgtaaccgtacgaaccgtacggacgtaccggtaaacgggaccggtaacggaacccggtaaccccgg

SEQ ID NO: 122611 - DNA, 747 bp, Homo sapiens
  misc_feature: GYAE6OF02HZNWI.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttcttgtggcttattttaaaaggtgtccagtgtgaggtgcagctgctgcaggtcggggggagtcttggtacagccgtggggggtccctggacgactctcctgtgcacgcctcgtggacttcctacctttcgcgtctagtgacatgacgtcgtcgggtcccgccgaggtcctaccgaagggtaacgtgggggtccgttggggagggttcggggtactacggtaagggtttaaactttaaggttaggggttgggtaagggtaaagttacgtaagttaacgttacgacgtaacggtacccgttccgggtagggaaccggggtcccgtacgtttaccaacccgtacgttacccgtaccgaaggaacgtaactaaacgtttacccgaaaagtaaacccaaccgtaacgttacgttaacttaccgtacgaaccgtaaagtaccggaaactaccggtaccgtaggaacgggaccgtaccgggaacggaaccgacccggtaccctaccgtttacttaccggtaacgttaaaccggaaagtaacctaaccgaccgaacgtacggtaccgtacgggaacggacgggtaccgaaacccggg

SEQ ID NO: 122612 - DNA, 755 bp, Homo sapiens
  misc_feature: GYAE6OF02JQ4HM.52.81.H04.1.454.CMB.1.raw
tcagcgcagtacgacacgaccggtgctcgatttagtagtgtagattcgcggggaggctctgagagaggagcccagccctgggattttctaggttgttttctatttggtgatcaggactgaacagagagaactcaccatggagttgggtctgagcgtggtctttttctgtggtcttaatttaaaggtgtcagtgtgaggtgcagctgctgacgaggtcggggggagtcgttggtacgagccgttgggggtccctggagactcctccgtgtacgccacgtcctcgtggactttcctaccgtttccgcgttctagtgactagtagtaggtcgttcgggccccgacgtacggtcctaccgaagggagtcggggtctgggtcgggttcgggtctacggaggttaacgttaagttagggtaggttaggaaacgttaccaagttacttacggcctaaacgtaccggttccggttagggaaccggtcccgtcgttacccgaacctacgtcctacgtacgaaacgtactaaccgtaacctaaaccggaacctacggtaacttacggttactaccgagtaaaccgttaaacgttcgaaaccgtacgtacccgtagtaaacggacgacccggtacgtaacccgaccgttaccccgtaccgtttaagtttaccggtaacgggtaaacttaaacgggaaacccttacgaaccgttaacgtaccgggtaaccgtaacgggaaccggttaccgggaacccgtaaacccgg

SEQ ID NO: 122613 - DNA, 828 bp, Homo sapiens
  misc_feature: GYAE6OF02IOV32.52.81.H04.1.454.CMB.1.raw
  modified_base (245)..(245): a, c, t, g, unknown or other
  misc_feature (245)..(245): n is a, c, g, or t
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttcttattcactgcacagggtcctgggcccagtctgtgttgacgcagccgccctcagttgtctcgccggcccctaggacagaaggtcaccatcctcctgctcgtagggaacncagcctaccaactattcgggactaaattaagttttgtcgtccgttacggtaacccaacgtccaaaccctccccggaaggtaccaacccgaaccggtaccccccaaaccttcccctaccttaacttttaacgtacgaaaccttaagtacggtaaacttaaaccggtacccgtaaccccgtacggtaaacggggtaccttaaacccgttacgtaaaccccggtttaactttacccgttaaccgtcgggtacccttacccgtaaacggtttccgtacgggtaacccgtaacccggtttacccgaaccggttacccccgtaaccccggtacgggggtaccctaaaccggttaccccggaaaccccgggtaaccccgttcccggtaaacggtacccggggttaccggggggaaaccgtaccggggacccgttaaagtttaacttaccggtacgggtacggtaaccgtacggttagggtaacttacggaccgtaggacccgttaggacggttagacggtcggtaccggtagggttcgttaccgggacgggtacggtaccgacggtcctacggtacccgtacggtaccgg

SEQ ID NO: 122614 - DNA, 801 bp, Homo sapiens
  misc_feature: GYAE6OF02IXLWK.52.81.H04.1.454.CMB.1.raw
  modified_base (154)..(154): a, c, t, g, unknown or other
  misc_feature (154)..(154): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggnttttcttgtggcttatttaaaggtgtccagtgtgaggtgcagctgctgcgaggtcggggggagcgttggtacgagccgttgggggtccctggacgaccgtctccgtgtgcgagccctgtcggtattcctccgtttcgccgttactagtcgacctagtgacgtcggtcgggtcccgccgtacggtcctaccgaaggtaacgtcgggggacctggggtacggtcggggtttccgtaccggtaaggtttaattaaaggtggtttagggggtagtaaacggtactaagtttaacgtttaaccggcgttaaacgcccggttaccgggtacggtaacggggtccccgttaacgttacccgtaaacccgtccgttacgtacccgaaggtaacgtaaaccgtaaacttaccgaaaccgtaaacctactaacgtcgtacgttactcgtaactaaagtacgtaaacgaccgtaccgttacgaacggaacgtaaccccggaacggtaacccgacccggttaccctaaacccgtttacgtttttacccggttaaaaccgtaaaacggtaaaaccgtaaacccgttaacgtaaaccggttacgtaaccggttaccggaacccggtaaagggggacccgtaaacccgggtaaaaccccggg

SEQ ID NO: 122615 - DNA, 887 bp, Homo sapiens
  misc_feature: GYAE6OF02I28PO.52.81.H04.1.454.CMB.1.raw
tcagcgcagtacgacacgaccggtgctcgatttagtagtgtagattcgcggggagcgtctcgagagaggagcccgagccccgtgggtattttcaggtgttttcatttggtgatcgaggactgaacgagagagaactcgaccagtggagtttggcgttgagtcgtggtcttttcgttggtggtcttaagttttaaaaggtcgtaccgtagtgtagtaggtgacgagtcgtggtctgcgaggtcggggaggcgttgacgagccggtggggtccctgagtaccgtcgtccgtgtcgcgagtcctcgaggtacttcgtacccgtttcgcttccgtagtcgacgtacgtgaacgcgttcgggtccgaccgaggtccgtaccggtagggtaacgtggggtaccgttagggtacggttcggttctacggtaaggttaagttaaagttcggttaagggttacgtaaacggttacgtagttaacgttaaccggacgtacggtaacccgttccgggtaacggacgggtaccgtacctttaccgacccgtacgtacccgtaccgtaacgtaccgtaaaccgtaaaccgtttaaccgaaaaccgtaaacccgttaacgtaaccgtttaccgttaacgttaaccgttacggaaacctaaacgttaaaccggtaaaaccggttacggaaccgttaacgggtacgaaaccgttacccgggtaaaacgaccccggtaaacccgggtaacccgtaacccgggttttaaaccggtttaaccggttaaagggttaaacccgggtaaaaacggtaaaaccgttaaacccgtaaaaccggttacccgtaaacgggtcccggtttaaacggggacccggggtaaaacggttacccggaaaacccccggg

SEQ ID NO: 122616 - DNA, 716 bp, Homo sapiens
  misc_feature: GYAE6OF02HC3HF.52.81.H04.1.454.CMB.1.raw
  modified_base (122)..(122): a, c, t, g, unknown or other
  misc_feature (122)..(122): n is a, c, g, or t
  modified_base (342)..(342): a, c, t, g, unknown or other
  misc_feature (342)..(342): n is a, c, g, or t
tcagcgcagtacgacacgaccggtgctcgatttagtagtgtagattcgcgggggagctctgcttcagctgtgagcgcagaaggcaggactcgggacaatcttcatcatgacctgctcccctntcctcctcacccttctcattcactgcacagggtcctgggcccagtctgtgttgacgcagccgccctcagtgtctgccggcccaggacagaacggtcaccatctcctgctcgtaggaagcaggcctaccaactagttggactaaattaattttgcgttcctaggtaccagactaacctccgaaggccaacgacgaccccccaaactcctacgtaactttangtaacctaagtacgtaataacgccgaaccctaggaacgggtactaaccgtacggtaacccgtatttcccgtcgtacgggtaccttaccgaaacgtttcgacggtacctaaccgggttaccgaacgtccccgtaacccgtcggggaacctaacgttaaccccggacccggtaaccgttacccaagggtaaccggttacgggggaaccggtaacggtaccgttaaagttaactttaaccggcggtaaccggtaaactaggttaacgggtaaactacgaccgtaacgccgttaggagtacgtacgtcgtacggtaggggttacgttccggggaacgggtacgggaaccgaaggtccgtacgggtacccgttaccggg

SEQ ID NO: 122617 - DNA, 766 bp, Homo sapiens
  misc_feature: GYAE6OF02HMLD7.52.81.H04.1.454.CMB.1.raw
  modified_base (266)..(266): a, c, t, g, unknown or other
  misc_feature (266)..(266): n is a, c, g, or t
tcagcgcagtacgacacgaccggtgctcgatttagtagtgtagattcgcgggcacgaccggtgctcgatttagtagtgtagattcgcgggggggagcttggtacagcctggggggtccctgagactctcctgtgcagcctctggattcacctttcgcgtctatgacatgagctgggtccgccaggctccaggaactggggctggagtgggtctcgaggtattaatgtggtcggaagtacatattacgcagactcgtgaacgggccncttcgaccatctccgagagacaattccaaagaacactactgtaatctagctaaaagtcgaaactagcccttggaacgtaggacccgtaaggaccaacgggccctaaccgtattttcgtaacgtaacggtaaaacgaacttaaccacgtaacacgtacgtagggaccgtaagggaacgaaccgaaaccgggaccgtaacgttaaccgttttacgtttacggtaaccgttacggttacggggacccgtaaccggggtaacccgtacgggttcctaaccccggttcttacccgtcgtaacggtaccccgtacccgaaccgtaaaccggggacccctacggttacccggttcccgttacccccgttccgggtccctaaccccgttacccgtaacccgtaacgtaccggtacccgtaccggttacccggtcgggggtaacctaaccgaccgggtacccgggtccccggtcgggtacccgttcggacccggttacggtaacccggg

SEQ ID NO: 122618 - DNA, 993 bp, Homo sapiens
  misc_feature: GYAE6OF02III5C.52.81.H04.1.454.CMB.1.raw
  modified_base (198)..(198): a, c, t, g, unknown or other
  misc_feature (198)..(198): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagcgtggtcttttcttgtggctaattttaaaggtgtcagtgtgaggtcgnagctgctgcgaggtcgggggagcgttggtacgagcgtggggggtcctgacgactctctgtagcagtccgtcgtggtacttcctacctttcgtacgttactatacgtacgtagtcggtacgtcggttcgggtacccggtccgtacgggtcccttaaaccggaacggggttaaaggttcggggggtaccgttagggtaacggggtttacggggtttcgtaacccggtaagggtttaaactttaacggttaggggttagggggttaaccgggtaaattaaccgtaaggtttaaacggttaacccacggtaaaccgggttaaccggtaccccggttaagggggaaaccccggggttccggttaaacccgtttacccgtaaaccccttaacggttacccgtaaccgggaaaccgttaaaacgggaaacccttaaacggttaaacccccgaaaaacggtaaacccaaacgtttaacccgttaaacggttaacccggtttaacgtaccgggtaaaactaaaaacgggtttaaccgaaaaccgggtaaccggttacccggttaaaccggaaacccgggttaaaccgggaaccccgggggttaaaacgggaccccccgggttaaaaccccgggtaccccgttaaaaccctttttaaccggttttacccggtttaaaaccgggtttaaaaaccgggaaaacgttaaaaccggttaaacccaaacccgggtaacgttaaacccggtaacccggggtttaaacgggaaacccggggtaaaccgggttaacccggtaaaacccccggg

SEQ ID NO: 122619 - DNA, 667 bp, Homo sapiens
  misc_feature: GYAE6OF02JHQB4.52.81.H04.1.454.CMB.1.raw
  modified_base (164)..(164): a, c, t, g, unknown or other
  misc_feature (164)..(164): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgcgtttctaggngctagtttaaaggtgtcagtgtgagtgcagctgctgcaggtcggggagcttggtacngccgtcgggggtcctgacgactctcctgtgcngccgtcgngtactctaccttgcgtctatcgactntcgagtcgtcggtccnccgtaggccttcggaaggtacgtgggtcgtaggnggtcgttcacgtaggtaattagtaggtcgtagaacgtanagtacgttaancgtacgcgtacggtacgggaaggtccctactaccgtacctagttaccaacccgagaacgaacctaaacgttaacccgaaaagaacctaccgtaagttcgttaacgttactaccgaaagtaaacgttacgaacgtaccgtagtccggtaaacgcggaccggtaacgaacccggagttaacccctacgtttacgttacccgggtaaagtaaaccgttaaacgaacttacccgaaccgtaagtacggccgttaacgggacggtaaccgccgaaaaccccgggg

SEQ ID NO: 122620 - DNA, 790 bp, Homo sapiens
  misc_feature: GYAE6OF02J2A35.52.81.H04.1.454.CMB.1.raw
tcagcgcagtacgacacgaccggtgctcgatttagtagtgtagattcgcgggcacgaccggtgctcgatttagtagtgtagattcgcggggggaggcttggtacagcctgggggtccctgagactctcctgtgcacgcctctggattctacctttcgcgtctatgacatgagcgtgggtccgccgacggctaccgaggtaagtggggcgtggaggttcgggtctacgtaaggttaattaagtaggtggtaggtaagttacattagttacgcacgacctccggtaggaacgggccgtcttaccgaccactacctccgaagaacgaactaaacgttaccgaaacgaaccgaacctacgttacgtactacgtaacgtaacaaaacgttacgaaaccgaacggtacctaggaacggaccggacccggtaaaccggaaccgtaaccggtaccctaaccgtttacgtttaccgtaaacgtaaaccggaaaacgtaaactaaccgacgaactacgacggtacggaaacggaacggacgaacccgaaagggttaccctaacgttttacgtttacgtacggtaccgtaaccgggtccgggtaaaccggtaacccgggttaaccgcggttaccgtacccgttcctaccgccgtaccgccctaaccgaaccgtaacgtccccgtcgttcccttcccgttcccgccgtaccacccgtccaaccgacgtcctaccgcccggttaggacggtacccaccggtcgtcccggtccggtacggcgtaccgtaccggttagtaacccg

SEQ ID NO: 122621 - DNA, 810 bp, Homo sapiens
  misc_feature: GYAE6OF02F8474.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttcttgtggctattttaaaaggtgtccagtgtgaggtgcagctgctgcagtcgggggaggcttggtacagccgtgggggtccctgagacctctcctgtacgcgagcctacgtggacttcaccttttcgccgttctagttacgactagtcgacgccggttcgggtaccccgccgtaagggcccttaccggaagggtaaacgtcgggggtccgttacgggaggtttccggggtcttaccgaaggtttaaatttaaggtaaggttggggtaaggtaaacggtttaacaaagttttaacgttaacgggtcctaacgggtaccgttacccgggttaacgggaaccgggggtccccgtacgtttacccaaccgtaccgtaccgttacccaaaggtacgaaaccctaaacgttaacccgaacgtaaactaacccgaactttacgtaaccgttcgtaacgtaacgtaaacgttacggaaaccgtacgtaacccgttcggaaacgtaaccggacccggaacggtaacccgaacggtcccctaaccgtttaacgtttacccgtaacggtaaaaccgtaaaacggttaaacccgttaacgaaacccgttaccgaacggtaaccgttacccgggaaacgggtacggaacccggtaaaccccgg

SEQ ID NO: 122622 - DNA, 755 bp, Homo sapiens
  misc_feature: GYAE6OF02FWJ3N.52.81.H04.1.454.CMB.1.raw
  modified_base (342)..(342): a, c, t, g, unknown or other
  misc_feature (342)..(342): n is a, c, g, or t
  modified_base (705)..(705): a, c, t, g, unknown or other
  misc_feature (705)..(705): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagttgggctgagcttggctttttcttgtggctattttaaaggtgtccagtgtgaggtgcagctgctgcaggtcggggggagcttggtacaggccgttggggggtccctggagacttcctccgtgtcgcagcctctggattcaccgttttcgcgttctatgaccatgagcgtcggtccgcgacgtcctaccgaaggtacgtcggggntcgggaggttacgggtcctacggaaggttacgtttaaagtcgggttagggtacggtaaacggtaacttaaggttacgttaaccgaccaaggtaacccttccgggttaaggaaccggggtcccggccgtttaccaaccgtacgtaccgtacccgtaacggaccgtaaactaaaccgttacccgaaaacgttaacccgtaacctaaccgttaccgttaacgtacgttacgaaccgtaaaagttacaaaccggtacggaccgtacggtaggaaacccggaccggaacggtaaccggacccgggtaaccttacccgttactttaccggttaacggtaaaccggtaaaaacgtaacgtaacccgtaanaaccgtaacgtaaccggacgggtaaccggaagggttacccaaacccgggg

SEQ ID NO: 122623 - DNA, 728 bp, Homo sapiens
  misc_feature: GYAE6OF02F79A5.52.81.H04.1.454.CMB.1.raw
  modified_base (193)..(193): a, c, t, g, unknown or other
  misc_feature (193)..(193): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (377)..(377): a, c, t, g, unknown or other
  misc_feature (377)..(377): n is a, c, g, or t
  modified_base (589)..(589): a, c, t, g, unknown or other
  misc_feature (589)..(589): n is a, c, g, or t
  modified_base (617)..(617): a, c, t, g, unknown or other
  misc_feature (617)..(617): n is a, c, g, or t
tcagcgcagtacgacacgaccggtgctcgatttagtagtgtagattcgcgggggaggctctggagagaggagcccagccctgggattttcaggttcgttttcattttgggtgagtcaggactgaacagagagaacctcaccatggaggtttggctggacgcggcgtgttttctaggtcggctatttaaacggngtcctagtcgtgaggtcgcgtcgcgtcgctgcgaggtcgggggacgtcttacggtcngccgtcgggggtaccagagtctctccggtgtcgggacactctcgtggctttccgtaccgtttcgcgttacctntacgaccgtagtcaacggtccgtaccgggtaaccgccaggtacctacgttaagnggtaaggtcgggtacgttcgggtacggtccggtcggttacgttaacggttaattaaggttggttacgggtagtaacgtaacgttacgttaacgttacgtacgacgttaaccgtcccgggtagtaaaccggggtcctaccctttacggaccccttaaggttcccacggtacgacgtaaacgtaacgtaacgaacggtaaccctagtacgtttnaaactcggtacgactaggactaaccgtntacgaaggtcacggcaagggtacccagtcccagtttcgttaacggtaacggaacggtaaacgtacgtactaacgtccgttaaagcccgggtagaaccgggtaccgaaccgg

SEQ ID NO: 122624 - DNA, 743 bp, Homo sapiens
  misc_feature: GYAE6OF02HI4H5.52.81.H04.1.454.CMB.1.raw
  modified_base (605)..(605): a, c, t, g, unknown or other
  misc_feature (605)..(605): n is a, c, g, or t
  modified_base (616)..(616): a, c, t, g, unknown or other
  misc_feature (616)..(616): n is a, c, g, or t
tcagcgcagtacgacacgaccggtgctcgatttagtagtgtagattcgcggggagctctgagagaggagcccagccctgggatttcaggtgttttcatttggtgatcaggactgaacagagagaactcaccatggagtttggctgagctggtctttttctgtggtcttaagttttaaaaggtgtccagtgtgaggtgcagctgctgcgaggtcgggggagtgttaggtacagtccggtacggggggtccctaggacgtacttccgtccgtgtggccaggtcctcgtcggtaacttcctaacccgtttcggtcggttacccgttaattggaacctaagttccggaacggtcggttaccggggtaccccgccggaacggttccgtacccgaaggggtaaacgtcgggggtaaccgttgggtaagggttcggggttacctacggtaacgggttaatttaaaggtagggtagggttacggaaaacgttaacgtaagtaacgttaaccgaacgaacgtaccgttacccggtaagggaaccgggtacaccgtttacaccgtactacaccgagtaacaacgtaactacccgaaagaaccactattatacgtnacgataagtanaacgacgacgtagaggacgacggacgtaccgacggccttaacgttacttccgtaaacgtaacggaaacgtaacgtaacccaagacgtaaccgtccgaacggggaacacgggaacccgtaaacccggg

SEQ ID NO: 122625 - DNA, 713 bp, Homo sapiens
  misc_feature: GYAE6OF02H4MOL.52.81.H04.1.454.CMB.1.raw
  modified_base (229)..(229): a, c, t, g, unknown or other
  misc_feature (229)..(229): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagcgcagtacgacacgaccggtgctcgatttagtagtgtagattcgcggggagctctgagagaggagcccagccctggattttcaggtgttttctatttggtgatcaggactgaacagagagaactcaccatggagtttgggctgagcgtggtcgttttctggtggctagttttaaaaggtgtcagtgtgaggtgcagctgctgcgaggtcgggggagcgttggacngccgtgggggtcctggagcgtctcgtgtgcagtccctgtggtattctaccgtttcgccgtntatgacaatgancgttggtccgcaggctacgaggagtcgggcgtggtagtcggtctacgaggttaattagttaggtggtaggtaaataccgagttaacttacggactaacggtaccgttaccggtggtaaaccggggccgttaccgttacgtacccgtaagtttaccctacccgaagtaaacggtaaccgtaaaccgtttacgaaaacgaaccgtaaccgttaacgttacgtactaccgtagtaacctaaagtaacgaaaccgtacgtcccgtaagacggtaacgacccggaacgtaccgaaccgtcccgtaaccgtttacgttaccggtaagttaaaccgggtaaactaaaccgttaacccgaacctacggtaaccgttaccggtaaccgggaaccggtaccgggaacgtaaaacccccggg

SEQ ID NO: 122626 - DNA, 763 bp, Homo sapiens
  misc_feature: GYAE6OF02HCJ07.52.81.H04.1.454.CMB.1.raw
tcagcgcagtacgacacgaccggtgctcgatttagtagtgtagattcgcggggagctctgagagaggagcccagccctgggattttcagttgttttcatttggtgatcaggactgaacagagagaactcacatggagtttgggctgagctggctttttcttgtggcttatttaaaaggtgtccagtgtgaggtgcagctgctgcaggtcggggggagcttgggtacagccgtggggggtccctgagactctccgtgtcgcagcctctggtacttcacctttcgcgttctatgacatgagcgtgggtccgccgaggtcctaccgaaggaagtcggggctgggaggtggggtctacgagggttaattaagtaggtgggtaggtaaagtactaattaacgttacgctaacggtaccgttaccgggtaggtaaaccggggtcccgtacgtttacccaacccgttaacgttacccgttaccccgaaagggtaaaccgtaaaccgtaaaaccgtttaacccgaaaaacggtaaacccaaaccgtaacccgttacggttaaacttccgtaacgaaccgtaaaagtaccgaaaaccgtacggtacccgttaaggaaccgggtaacggtacccgggaacggtaaacccgaccgggaaccttacccgtttacgttttacccggtaacggttaaaccggaaaaagtaaccttaaaccgaaccgtaaccaacggtaccgtaacggggaaccggtaacgggaaccgtaaaccccgg

SEQ ID NO: 122627 - DNA, 742 bp, Homo sapiens
  misc_feature: GYAE6OF02GUY6W.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagttggctgagctggtcttttctgtggctatttaaaaggtgtccagtgtgaggtgcagctgctgcgtagggtcggggggagtccgttaggtacgacggtcccggttcgggggggtcccctggacgtaccgttccgttcccgtggtagccgtacgtccgtccgtggtacttccgtaccgttttcggcgtactgtacgactagtgacgtcgtcgggtccgccgacggtcctaccggaggacggtcggggtcgtgggtaggtcggtctagaacgttagttaagtggttaggacggtaactacagttactacgacacgtaccgtaccggtaggaacgggtccgtccgttaccaccgtactacccgtacaacggaacgtaacctaaacgttacccgaaaacgtacctaacgtacgttacgttaaccgttactacgtacgaaagtaccgaacgtacgtccgaggtaccgacggaccgtaacggaaccgtaccgacccgttaccgtttaccgttacggtaaccgttaaaccggaaacgttaaaccgtaacccgtaagaaacccggtacggtacggtaaacccgggtacggaacgggtaacccgtaaacccggg

SEQ ID NO: 122628 - DNA, 834 bp, Homo sapiens
  misc_feature: GYAE6OF02JUQEB.52.81.H04.1.454.CMB.1.raw
  modified_base (201)..(201): a, c, t, g, unknown or other
  misc_feature (201)..(201): n is a, c, g, or t
tcagcgcagtacgacacgaccggtgctcgatttagtagtgtagattcgcgggcacgaccggtgctcgatttagtagtgtagattcgcggggggaggcgttggtacgagcctggggggtccctggagactctccgtgtgcagcctctggattcacctttcgcgtctatgacatgagctgggtccgccaggctccgaggtaangggggtctggagtggggtctcgagggtatttaactaggtgggtaggtaaagtacagtattacgctaagacttaccgagtaacgggcccgtcgttccaccacttacctccaagacgacctaacgttaccaaaggaaacaccacgtacgtaactcgtagtaccaaagtacggaaacctagacccgttagacgggtaacgccgggaacgggtaacccgacggacccaaccgtttaagtttaccgtagggttaaaccggaaaaaacggaacttaaaaacgacccttaaaccgaaagggtccgtaagggacggtaaacgggaccggtaacccgaaaccgggtaccggtaacccgttaacgtttaacctttaggtaacctacggtacgggccgtaaccgggacccgttacgtcggaacccttcgtacccctagaaccgcccgtacccgtacccgaaccggggacccctacgtacccggttccccggtttaccccgtccggtaccccgtaaccccggttcccttaaccccgaccggttaacgtaccccgtacccggttacggttaccgggggacccttaccggaccggacccggtttcccgggaggtacccgggtaccgtcccggttagggtaaccccgg

SEQ ID NO: 122629 - DNA, 689 bp, Homo sapiens
  misc_feature: GYAE6OF02IWX84.52.81.H04.1.454.CMB.1.raw
  modified_base (336)..(336): a, c, t, g, unknown or other
  misc_feature (336)..(336): n is a, c, g, or t
  modified_base (519)..(519): a, c, t, g, unknown or other
  misc_feature (519)..(519): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcacatggagtttgggctgagctggtctttttcttgtggctaattttaaaggtgtccagtgtgaggtgcagctgctgcagggtcggggggagtcgttgggtacaggccggtggggggtccctggacgtacctctcctggtgcacgtcctcgtggtacttcctaccgtttcgcgttctatcgactatggagtcgtcggggtcccgacgnggtccctaccgaagggaagtcgggggacgtgggtacggttggggtccgtagaacggtttaatttaagagggtttaggggtacggttaaagtacgtaagttaacgttacgacgtacggtacgttccggtaggaacgggtccctacgttccaacctactcgtccagtacgaactaactccgaaanaccgaactacttagtactacgtacgaactaaatcgaaacaccgtacgtagggaacgaccgggtaccggaccggaaccgtaccgacccttaccgtttaatttccgaaaggtaacgaaactaacgtaaccacaacggagtaccggtaggaaccggtaggaaccgtaacccgg

SEQ ID NO: 122630 - DNA, 722 bp, Homo sapiens
  misc_feature: GYAE6OF02HIO9M.52.81.H04.1.454.CMB.1.raw
tcagcgcagtacgacacgaccggtgctcgatttagtagtgtagattcgcggggagctctgcttcagctgtgagcgcagaaggcaggactcgggacaatcttcatcatgacctgctcccctctcctcctcacccttctcattcactgcacagggtcctgggcccagtctgtcttgaccgcacgcccgccctcgagtcgtctcggccggccccaggacaggaaggtcaccatctcctgctcgtggaacgcagcctaccaactagttcggactaatttaagttttgtcgttccgtacggtaaccacgactaaccgtcccgaggaccaacgacccgaccccctaaactccgtactatttacgacgaactaagtgaataacgccgtaccctaggaacggtacttacccgacgtaaccgtattccgtacgtcggtacctaccgtagtccgtcggaccgtaccgtaccgaccgtacccgtacccgtgggacctacgtacccgaacccggtacctacccgacggtacgggtaccggggaccggtaccgggtaccggttaactttacggttaccggtacgggtaccggtaaacgtacggtacgggtaagtacggacgtacggtccgtagtacggttcggtaaggtccggtaccgggtacggggttccgggttaccggggacggggtacgggtaccggtaacggcggttacccgggtaccggttaacccggg

SEQ ID NO: 122631 - DNA, 702 bp, Homo sapiens
  misc_feature: GYAE6OF02INEYZ.52.81.H04.1.454.CMB.1.raw
tcagcgcagtacgacacgaccggtgctcgatttagtagtgtagattcgcggggagctctgagagaggagcccagccctgggattttcaggtgtttcatttggtgatcaggactgaacagagagaactcacatggagttggctgagcgtggtctttttctggtggcttatttaaaggtcgtccagtgtgaggtgcagctgctgcgaggtcgggggagtcgttgggtaccaggccggttagggggtccctagacggtctcgtccgtgtacgcgagtcctcgtaggcttacgtccgtttcgcgttctagtgactagtcgtacgtcgttccggccgacgtaggtcctaccggacgggtaaagtcggggtcgtaggggacggttacggggcctaggtaggttaactttaaggtacggtagggttaacggtaaccgtagtaacgttacgtacgacgaagtaccggtacggtacgacgggtccgtacgtaccgtacctactaccgtaccgaagtacgaacgttaaccgaacgtaaacgacaacgtactagttacgtcgtagaaccaacgtaactaacgacgaacgtagaacggaacggccgaaaccggagtaacccgtactaaccccggttattaccgtaaacgtaaacgttaaaacgaaacgtaacacgaaccgtaggaccggtacggaacgtagggaacgaacccgg

SEQ ID NO: 122632 - DNA, 599 bp, Homo sapiens
  misc_feature: GYAE6OF02I8IQ7.52.81.H04.1.454.CMB.1.raw
  modified_base (251)..(251): a, c, t, g, unknown or other
  misc_feature (251)..(251): n is a, c, g, or t
  modified_base (373)..(373): a, c, t, g, unknown or other
  misc_feature (373)..(373): n is a, c, g, or t
tcagcgcagtacgacacgaccggtgctcgatttagtagtgtagattcgcggggagctctgagagaggagcccagccctgggattttcaggtgtttcatttggtgatcaggactgaacagagagaactcaccatggagtttgggctgagcgtggctttctagtggctatttaaaaggtgtccagtgtgaggtgcagctgctgcaggtcggggggagcttggtacagccgtggggggtccctgagactctccngtgcagcctctggacttcacctttcgcgtctatgactatgagctgggtaccgcctaggctccgaggaatggggctgggagtgggtctcgaggtattagagtggtggaagtacagtagtacgntaaggacctccggtaggaacgggccgtacttaccgaactataccgtaccaacggagtaaaccgtaacttaacccaaacgaaacgaaccaaccgttagacttacgtacgacctaaagtacgaacctagacctagaacgcgtaacggacgacgaccggacctacttagtacgtaaggtaaacgaaagtaacttacaactaacgcgacgtaggacggaggacaacccgg

SEQ ID NO: 122633 - DNA, 794 bp, Homo sapiens
  misc_feature: GYAE6OF02IZ17L.52.81.H04.1.454.CMB.1.raw
  modified_base (227)..(227): a, c, t, g, unknown or other
  misc_feature (227)..(227): n is a, c, g, or t
  modified_base (267)..(267): a, c, t, g, unknown or other
  misc_feature (267)..(267): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagctggtcttttcttgtggctattttaaaggtgtccagtgtgaggtgcagctgctgcaggtcgggggagtcgttaggtacncggccgtggggggtccctggacgacctcgtccgtggtgcncggtcctcgtggtattcctaccgtttcgcgttactagtcgtactagtaggtagtcgtcgggtcccgtccgacggtccctaccggtaagggtaacgtgggggtaccgtggggtaacggttcggggttacctacggtaaggtttaacgttaaaggttagggttacgggtaaggtaaacgttaaccgtaagttacggttaaccgcgtaaacgtaccgtaccggtacgggaaacgggtcccgtacgttaccgacctattcccgacgtaacggtaacgtaaaccttaaccgtacccgaaaagtaaccgaaccttacgttacggttactcgtacgtaacctaaaggttaaccgaacgtaccgtaccgttaacgaacgggacgaacccgggacggtaaaccgacccgggtaaccttacccgtttaacgtttaccggtaacggtaaaccgggtaaaaccttaaccttaaccggaaccgtaaccgtaccggtacgtaaaccggggtaaccggtaccgggaacggttaaacccccgg

SEQ ID NO: 122634 - DNA, 837 bp, Homo sapiens
  misc_feature: GYAE6OF02H37H2.52.81.H04.1.454.CMB.1.raw
  modified_base (210)..(210): a, c, t, g, unknown or other
  misc_feature (210)..(210): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagactcaccatggagtttgggctgagcgtggtctttttcttgtggcttaattttaaaaggtgtccagtgtgaggtgcagctgctgcgngggtcggggggaggcgttggtacaggccggtcggggggtccctggacgtacctcttccgtggtgctacgcctcgtggtacttcctaccgtttccgcgttctagtcgtacagtcgagtcgtcggggtccgccgacggtcctaccggagggtaacgtcgggggcgtgggtacggttcggggtctacggtaaggttaacgttaagttagggttacgggtaaggtaaacgtttaacgtaagtttaacggttaaccgacgtaacggtaaccggtttcccggtaaggggtaacccggggtcccgttaccgtttaccctaaaccccgtactttacccgtaaccgtaaacggtaaccggtaaaaccttaaaccgttaaccgaaaaaccggaaaacctaacccgttaacgttaacgttaaccttcgtaaacgaacctaaaacgtaccgaaacgtaccggtaccgttaaggaacgggaaaccgaccggggtaaacggaacccggtaaccggtaaccccgttaaccgtttaccggttttaaccgtaaacggttaaaccggaaaagttaaacccgtaaaccaacggtaaccgtacggtaaccggtaacgggaaccgggaacggaaccgtaaaccccggg

SEQ ID NO: 122635 - DNA, 607 bp, Homo sapiens
  misc_feature: GYAE6OF02FINLM.52.81.H04.1.454.CMB.1.raw
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
  modified_base (483)..(483): a, c, t, g, unknown or other
  misc_feature (483)..(483): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggctttttctgtggctattttaaaaggtgtccagtgtgaggtgcagctgctgcagtcggggggagcttggtacagcctggggggtccctgagactctccgtgtgcagcctctggacttcacctttcgcgtctangacatgagcttgggtcccncaggctccgaggaatggggctgggagtgggtctcgaaggttataaacgtgtggtggtaaacgtacagttacttacggcaagtaccctcggtagaacgggtccncgttcacctatcctaccganacgtaacaaacttccaaagtaaccaacacttcgtatacctgaccaaatcggaaacngacctggaacgacggacccggaaggaaccgaccgggaccctaaccttatttaccgtaaggtaaccgaaaagtaactaaccgaacaacgacggaccgtagggaaccggtacggaacgtaacccgg

SEQ ID NO: 122636 - DNA, 928 bp, Homo sapiens
  misc_feature: GYAE6OF02FHJ1U.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttctgtggctaattttaaaggtgtccagtgtgaggtgcagctgctgcgagggtcggggggagtcgtttagggtacgacggcccggttggggggtcccctggacgaccttccgttccgtggtcgtccacgtccttacgtggtaactttcctaccgttttccgcgttactagtgactagtacgagtccggtcgggtcccgaccgacggtcctaccgaagggtaacggtcgggggacgttagggacggttcgggtacgttcggtaaaggttaaacgtttaaaggttaggggtttacggggttaaagggtaaacggttaacgttaagtttaacgttaaacgacgtaacggtaccgttacccgggttagggaacccgggttcccgtaccgtttaaccgaacccttaccgttaccgtaacccgaagggtaacgaaaccgttaaaccgttaaacccgaaaaccggtaaaccttaacctaaccgtttacgtttaaccttacccggtaacgtaaacgtaaaacgttaaccggaaccgtaaccggtacccgttaacggtaacgggaacccgggaacccgggtaaccggaaccccggtaaaccccgggttaaccccgtttaacccggttttaacccttttaacccgggttaaaaccggttaaaaaccccgggtaaaaacgtaaaaccccggtttaaccctaaaccccggtaaccgtaacggggtaacccgggttaacgggggaaacccggtaaccggggaaacccgggtaaacccccggg

SEQ ID NO: 122637 - DNA, 720 bp, Homo sapiens
  misc_feature: GYAE6OF02JYEGU.52.81.H04.1.454.CMB.1.raw
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (566)..(566): a, c, t, g, unknown or other
  misc_feature (566)..(566): n is a, c, g, or t
  modified_base (576)..(576): a, c, t, g, unknown or other
  misc_feature (576)..(576): n is a, c, g, or t
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
  modified_base (677)..(677): a, c, t, g, unknown or other
  misc_feature (677)..(677): n is a, c, g, or t
tcagcgcagtacgacacgaccggtgctcgatttagtagtgtagattcgcggggagctctgagagaggagcccagccctgggattttcaggtgttttcagtttggtgatcaggactgaacagagagaactcaccatggagtttgggctgagctggtctttttctgtggcttatttaaaggngtcagtgtgagtgcagntgctgcgagggtcggggggatcgttaggtacaggccggtcggggggtccctaggacgtaccttccgtccgtggtcgaccgtacgtccgttcgtacggtacttacctacccggttttcgaccgttagtactaggaccagttacggacgtccggttcggggtcccgaccgaggtaccgtcgtaagggacgttggggtacgtgggtaggtcggggtcctacggtaaggttacgttaaggtggggtacggtggtaaaactacgtagttaacgttaccggacgtagtacccggttacgaggggtaccggtaccgtcgtacctacgtactcgtaaccgaggtactaactaaactaccgacaaacgttcaacgttntacagacaanaacacgtaanccgtacnggaacgttcgaacccgtagggaaccctaccggtaccgttaacttcggtttaacggaacgtaaaagggactaaacttacccgaanaacccggtagtaaccggtagaaccgggaggaaccctaacccgg

SEQ ID NO: 122638 - DNA, 809 bp, Homo sapiens
  misc_feature: GYAE6OF02IFJH1.52.81.H04.1.454.CMB.1.raw
  modified_base (185)..(185): a, c, t, g, unknown or other
  misc_feature (185)..(185): n is a, c, g, or t
  modified_base (286)..(286): a, c, t, g, unknown or other
  misc_feature (286)..(286): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagactcaccatggagtttgggctgagcgtggttctttttcttgtgtcttaatttttaaaggtntccagtgtgaggtgcagctgactgcgagggtcggggggagtcgttaggtacacggccggttcggggggtccctagacggtaccttccgtcgtgttcggacncggtcccttcggtggtactttaccgtaccctttcggtcgttcttagtacgactaagtgaacggtccgttaccggggtcccacggtacggccgtaccgaagggtacgggtcggggtacgtgggtaccggttagggtctacggtaaggtttaattaaggttagggtagggaggttaatacgtaatacggttaacgacgacggtacccgttaccggagggtaaccgggtccctacgtttaccaaaccggttcccttaaccggtacccgaaggttaacaaaaccgtttaaacttacccggaaaacgtaaaccctaaccgtaacttaagtaccggttactaacgaaacgttaaacgaccgttaacgccggtaacgaggtaacggaccgggttaaaccgaaccggaccggtaacccggtcccttaaccggtttaccgttacggttaaacccggaaaagtaaactaacaacccgaaacctaggttacccgacgggtaacgggtaacggaaccgggtaccggaaaacccgg

SEQ ID NO: 122639 - DNA, 833 bp, Homo sapiens
  misc_feature: GYAE6OF02HC9P3.52.81.H04.1.454.CMB.1.raw
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagctggtctttttcttgtggcttatttaaaaggtgtccagtgtgaggtgcagctgctgcgagggtcggggggagcgttgggtacgacggtccggtcgggggggtccctaggagtacctctccgtggtcgcacggtcctcgtggacttcctacctttcgcgttctagtgactagtcggacgtccggtcgggtcccgccgacggtcctaccggaagggtacggtcgggggcgttagggtacgggttggggtacctacggtaaggggtttaatttaaaggtacggggttggggttaacgggtaaaggtttaactaagtttaacgtttacccgggaaccgttaacgggtaacccttaccggggtacggggtaaacccggggggtccccttaaccggttttaccccaaacccgttaaccgtttaccccgtaacccggtaaacggtaaaccgtaaacccttaaaccgttaaccccgaaaaacgtaaccctaaacccgtaccgtttaagttaaccgttcgtaaacgtactaaaacgttacgaaaacgaccgtcgtaaggaacggtacggacccggaaacgaccggaacccgtaccctactttaccgtttaggtaaccggtaaaacgtaaacgtaactaaccgaacgtaacgtacggtacgtaacgggtaacggaccgggaacgtaaccccgg

SEQ ID NO: 122640 - DNA, 725 bp, Homo sapiens
  misc_feature: GYAE6OF02JKKDI.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgcgaggtcgggggagtcgttggtacacggtccggtcggggggtccctggacgtacctcctccgtggtcgcgacgtcctcgtaggcttcctaccgtttcggcgttctagtgacatggacgtcgtcgggtccgccgtacggcctaccgaaggaggtcggggctgggtaggtcgggtctacgtaggttaattaacgtaggttggtaggtaaacgtacgtaattagttacgacgtacgtacgtccggtacggaacgggtccgtaccttaccgaaccctatccgtaccgagtaacgaactaaacgttaccgaaacgaacctacgtacgttagtacgtactacggtaacaaagttacgaacgtacgtacgtacggaacggtccggaccggaaacggaacccgaaccggtacccctaaccttttacggttccgttaaacggtaaaacgtaaaacgtaaactaacccgtaaccgtaacgtaccgggccgttaaacggggaaaccggacgggtaacccggtaaacccgg

SEQ ID NO: 122641 - DNA, 583 bp, Homo sapiens
  misc_feature: GYAE6OF02HPY5U.52.81.H04.1.454.CMB.1.raw
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagctggtctttttcttgtggctattttaaaaggtgtccagtgtgaggtgcagctgctgcaggtcgggggagcgttggtacaggtccgtggggggtccctggagactctcctgtgcaggcctctggattcacctttcgcgtctatgacagtcgagcgtcgggtcccgcacggcctccgaggaacgtggggactgggtagtgggtctacgacggtattaagtagtgggtaggaagtatatatacgcagactcgtagaggccattccacgtactcaccgagaanacaactacaagaccacactagttanactanactaaatgaacacgtacctaggacgacgcggaacgccgaccggtaccctacgttactttccgaaggtaaccaaagtaaccaaccaaccacgagacccgttaagggacggtacggaacgtaacccgg

SEQ ID NO: 122642 - DNA, 631 bp, Homo sapiens
  misc_feature: GYAE6OF02GYF4V.52.81.H04.1.454.CMB.1.raw
  modified_base (251)..(251): a, c, t, g, unknown or other
  misc_feature (251)..(251): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtcccctgagactctcctgtgcagcctctggattcacctttcgcgtctatgacatgagctgggtccgccaggctccgaggaatggggctggagtgggtctcgaggtattaagtagtggtggaagtacatattacgnagacctcgtggaacgggccgcttcaccatcctccagagacaattccaagaacacactgtatctgacaaatcgaacagcctagagagaccgaggaccgacggccaccttatttcagtaacgaaaagtaatacaacaacgagcgtagggaacgaggacgacccgaaacggccgtaaccttactttacgtttacgaccgttacgtacggggccgaacgggaacccgtggtaccgaaccgttcctcctccacgaccctaccgacccgaacgggccctacgtccgttacccgttcccccgtcggtccctacccgtcctaccgacgtcgaccgtacctcggtcggggaccacgacggccggccgtcgggctcgtaccgtggtaccg

SEQ ID NO: 122643 - DNA, 872 bp, Homo sapiens
  misc_feature: GYAE6OF02IXQR5.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtcttttcttgtggctaatttaaagtgtccagtgtgaggtgcagctagctgcgaggtcggggggagtcgttaggtacacggccggttcggggggttcccctaggacgtaacccgttcgttacccgtggttacgcccgaacggtccccttccgttagggtactttacccttaccccgttttaccggccgtttacccttagttacgaacctagttacggaacggtccggttaccggggtcccgaccggtaccggacctccggtaagggaacggtcggggtacggtagggtacggttacggggtacctacggaacggtttaattaacggtaggttagggtacggtaaacgtacgttaacgtacgttaccgagaacgtaccctacgggtacggaacgggtcccttacccgtttaccgaaacccttagtaaccctaccgaagttaaacaaccgtaaacgttacccaaaacggaaaccttaccgtaacgtacgttaactaccgtacgtaacgaaacgttacgaaacgtaccggacgtaccgggggtaacccggggaacccggtaaacgggtaaccccggaaccgtaaccccgtaaccttttaacggttttaccggtaaacggtaaacccgggtaaaaacgtaaccgttaaccgaaaaccgtaccggtaaccgtacggttaaccgggaaacggaacccggggtaaaccccgaaggtaaaaccccggg

SEQ ID NO: 122644 - DNA, 779 bp, Homo sapiens
  misc_feature: GYAE6OF02GZDPW.52.81.H04.1.454.CMB.1.raw
  modified_base (234)..(234): a, c, t, g, unknown or other
  misc_feature (234)..(234): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttcttaggtggcttaattttaaaaggtgtccagtgtgaggtgcagctgctgcgaggtcgggggagtcttggtacngtccgtggggggtccctgagtactcgtcctgtcgcagcctntggattcctacctttcgcgtctatgactagtnaggctcgggtcccgccgaggcctccggaaggtaagtcggggcgtgggaggtcggggtctcgtaggttattaagtaggtggtaggtaacgtacgtataacgttacgcgaaagtccgtaccggtacggaaacggggtccgtaccgtttacccggtacctaacgttaccgtaaccctaagggaaacccgtaaaattaacccggttaaacccaaaacccggtaaaaccctacctaaaccggtttacgtaaccgttaccgttacaaaccgtaaaacgttaccggaaacctacggtacccttaaggaaccggaaccgacccgggaagtaacccgaacccggtacccctaccgttttaagtttacccgggttaaacgaaaccgggttaaaacgtaaaacccgtaaccgaaacccgtaaccgggtaaccgaccgggttaaacggaacccggggttaagggaccccgaaaaaaccccgggg

SEQ ID NO: 122645 - DNA, 932 bp, Homo sapiens
  misc_feature: GYAE6OF02IZXAK.52.81.H04.1.454.CMB.1.raw
  modified_base (178)..(178): a, c, t, g, unknown or other
  misc_feature (178)..(178): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagctggtcttttctgtggcttatttaaaggtntaccgagtgtgtaggtgcagtctgctgcgagggttcggggggagcgtttggtacgacggccggttcgggggtcccttaggacgtacgtccgtcgtcgttgccacgccttcgtggactttccgtacccgtttacgtccgttcttagtacggtacctagttacggtacggtccggttaccgggggtcccgtaccggtaccgggtacctacccggtaaggggaaacgggttcggggggtacccgggtttaggggtaggggtttacgggggttacccgttttaaccgggtaaagggttttaacggttttaaaggtttaacggggggttacgggttaaacggggtaaaggtttaaccgttaaacgttttaagtttaacccgggtacgtaaaccggttaaccggttacccggggttaggggtaacccgggggtacccgtcccgtttacccgtaaccggtaccgttacccgtaacccgtaacggaaacgttaacccgtaaaaccgtttaacccggaaaaccgaaaccgtaaacccgttacggtttaacgttaaccgttcccgttaacgttaaaccgaaacgttaacggaaacccttacgggtaccgtaacgggtaacggaaccggacccgggaaccggttaaccccgaccggtacccttaccgttaacttttaccggtaacggtaaaaccgtaacgtaaaccttaaccgaacgttaacgacggttaaccggacgggtaacggaacggtaccgaaacccggg

SEQ ID NO: 122646 - DNA, 701 bp, Homo sapiens
  misc_feature: GYAE6OF02H6FWK.52.81.H04.1.454.CMB.1.raw
  modified_base (138)..(138): a, c, t, g, unknown or other
  misc_feature (138)..(138): n is a, c, g, or t
  modified_base (301)..(301): a, c, t, g, unknown or other
  misc_feature (301)..(301): n is a, c, g, or t
  modified_base (524)..(524): a, c, t, g, unknown or other
  misc_feature (524)..(524): n is a, c, g, or t
tcagcgcagtacgacacgaccggtgctcgatttagtagtgtagattcgcggggagctctgagagaggagcccagcccctgggatttttcaggtgttttcatttggtgatcaggactgaacagagagaactcacatggngtttgggctgagctggtctttttctgtgctattttaaaaggtgtccagtgtgaggtgcagctgctgcagggtcggggggaggcttggtacaggccgtggggggtccctggagactcgtcctgtcgtacgcctcgtggacttctacctttcgcgtactatgacntgagccgtaggccgccgagtccgtacgaggaagtcgggcgtggaggtggtctcgtaaggtaattagtaggtggtagtaacggtactaagttacgtacgacgaacgtaccttcgggtacggaacgggtcccgtccgttaccgaaccctacgttcccaccgaagtaacgtaaactaacgttaaccaaagaaaccacttaacgtgttaactcgtacgactaaaacnggaaaccacggtcaagggacgaccggaccgtaacgggaaccgtacccgtaaaccgttacccgttacgttaccgttaacgggtaaaaccggtaaaataacccgtaaaccaaccgaaccgtaaggtaccggtaacgggaaacccgggaagggtaccccggaaaccgtaaaaccccgggg

SEQ ID NO: 122647 - DNA, 794 bp, Homo sapiens
  misc_feature: GYAE6OF02HSRHL.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggtagtttgggctgagctggtctttttctgtggcttaatttaaaggtgtcagtgtgaggtgcagctgactgcgagggtcggggggagtcttagggtacacggtccgtcgggggtccctgacgtactcctcctgtcgcagtcctgtaggtactccgttaccgttcgacgttactacgtcgaactacgtcgtacggtacgttcgggtacccggcccgtaagggcctaccgtaaagggtaacggtcggggtacgtagggtaaggttcgggtctacggtaaggttaacgtttaaagtagggttggtaaggtaacgttaaccgtaagtttaacgtaaccgtacgtaacgtaccggttacggtacgggtaaccgggtcccgtaccgtttacccgaaccgtttaccgtacgttaacccggagaaaccgtaaccgtaaccttaaccgtaaaacgaaaccctaaccgtaaaccgtgttaaccgtaccgtagtaaccctaaagttaacaaccgtacgtaccgtaggaaccgcggtaaccgaacggtaacccgtaaccgccttaacccgttaacggttaccgttaacggaaaccggttaaaacgtaaccgtaacccgtaccgaacgtacggtacccggtaagggaaacccgtaggaacccggtaaacccgg

SEQ ID NO: 122648 - DNA, 591 bp, Homo sapiens
  misc_feature: GYAE6OF02FKBB3.52.81.H04.1.454.CMB.1.raw
  modified_base (511)..(511): a, c, t, g, unknown or other
  misc_feature (511)..(511): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatggggctggagtgggtctcgaggtattaatagtggtggaagtacatattacgcagactccgtgaagggccgcttcaccatctccagagacaattccaaagaacacactgtatctagacaaatcgaaacagacctgagacgccgaggacacggcccaacttatttctagtaacgaaagaataacacacagcgtaggacgaggacgaccaacggcgacttacttcgttacgactacgtcgggaccgacgggaaccctggtcaccgttctcctcacgcctaccgaccgaacggccctaacgtccggttcccttccccgngtcccaccctcctacctagcgacccgtaccgtcgtcggggacaccgagcccggccgtcggccgtcggtccgtcggtacgg

SEQ ID NO: 122649 - DNA, 605 bp, Homo sapiens
  misc_feature: GYAE6OF02HNKSH.52.81.H04.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
  modified_base (501)..(501): a, c, t, g, unknown or other
  misc_feature (501)..(501): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggcttagttttaaaaggtgtccagtgtgaggtgcanctgctgcgagggtcgggggagcgttggtacnggccgtgggggtcctgacgactcctccgtgtcgcacgtcctgtggtacttcctacctttcgcgtctatcgacatgagcgtcggtcccgcacggctcgaaggagtcgggcgtggagttcggtntcgtagttatagtagtggtaggtaagtntaatntacgntagctcggtagacggtccnttacacactcaccgagacgaactaataccaaacgaacactacgtagtaactcgtacagtaaactagaaccgcgacgtacgacggtaaccncggaacggacgaccgaccttacgttattaccgtaacggtaacggaaacaagttaacccacgtacgtaaccggtaggtacgggaacgacgggtactaaaccccgg

SEQ ID NO: 122650 - DNA, 714 bp, Homo sapiens
  misc_feature: GYAE6OF02ITUYK.52.81.H04.1.454.CMB.1.raw
  modified_base (312)..(312): a, c, t, g, unknown or other
  misc_feature (312)..(312): n is a, c, g, or t
  modified_base (694)..(694): a, c, t, g, unknown or other
  misc_feature (694)..(694): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggagttgggctgagctggtctttttcttgtggctattttaaaggtgtccagtgtgaggtgcagctgctgcgtagggtcggggggagtcgttagggtacaggtccggttggggggtccctgagtacctctccgtgtacgcacgcctcgtggtacttccgtacccgtttcgccgttctagnactatagtcgcggttcgggtcccgcgacggtccctaccggaaggtacggcggggtcgtgggtacgggtcgggttcgtacggtaaggtttaacgttaaaggtttaggggtacgggtagggtaaacgttactaagttttaaccgtaacgtacgtaagttacccggtaccgggtagggtaacccggggtcccgttaccgtacctaacctacgttacccgtaacgaacggtaacgaaccgtaacttaacccgaaacgtaaccaacgtaacttacgttactcgtaacgaacctaagtaaccgtaacgacgtaccgtagacgtaccggacggacggaccgacgtaccgtacttagtacgtacgtaacgaaagtactacacgacgacgngaaggacgaggactaaccgg

SEQ ID NO: 122651 - DNA, 785 bp, Homo sapiens
  misc_feature: GYAE6OF02H0F0T.52.81.H04.1.454.CMB.1.raw
tcagcgcagtacgacacgaccggtgctcgatttagtagtgtagattcgcgggggagctctgagagaggagcccagccctgggattttcaggtgttttcatttggtgatcaggactgaacagagagaactcacatggagtttggctgagctggtctttttcttggtggcttagttttaaaaggtgtccagtgtgaggtgcagctgactgcgaggtcgggggagcgttggtacagccgtgggggtccctgagactcgtcctgtgcagcctcgtggtattccttaccgtttcggcgttactaagtcgactagtagacgtcgttcgggtccgacgtacggccttaccgagggtaacgtggggcgttagggtagtcgggttactacgtaaggttaagttaaagttaggggtcggtaacgggtaagttaaccgtaagttaagttaccggaactaacggtaaccgtttccgggaacgggtaccgggtaccgtccgtttaccggaaaccctcgttaccgtcccggaagaacggaacctaaacttaccgaaaacgtaaccctaacgtaacgtttacgtaaactcgttaaacgaacccgtaaaagttaccgaaacgaaccgggtaccaacggggaaccgtacggggaacccggtaaaccggaccggaaccccgggtacccttaccgttaacgttttacccgttaaaggtaaaccccgaaagtttaaacaaaccccgttaatacccgaacggggttcgtaacccggggaaacggttacgacccgggaaaaccccgg

SEQ ID NO: 122652 - DNA, 743 bp, Homo sapiens
  misc_feature: GYAE6OF02JHG2H.52.81.H04.1.454.CMB.1.raw
tcagcgcagtacgacacgaccggtgctcgatttagtagtgtagattcgcgggcacgaccggtgctcgatttagtagtgtagattcgcgggggggagcttggtacagcctggggggtccctgagactctcctgtgcagcctctggattcacctttcgcgtctatgacatgagctgggtccgccaggctccaggaagtggggctggagtgggtctcgaggttattaagtggtggtaggaaagtacattacgttacgcagtaacctccggtaggaacgggccgtcttacgacctatccctaccgaagacgtaacaagttacccaaacgaacctaacgaaccgttagtaacttccgtagaacctaaagtcgaaacgaccgtaccgtggaacggacgaccggagaaccgtaccggacctaactttattacgtaacgaacgaaaacgtagtaacacctagagtcggtaggaacggtagggaacgaccgaaaccggtaccgtaaccgtttactttacgttacggtaacgtaccggtacgggaacccgaaccgggtaacccgttacggtaccgtaccgttaccctaccgttacgtacccgtacccgtacccgtaacccggaaccgggtcccgtaccgttaccggtccccgttaccccgtcgacccgtacccgtaccctacgacgtaccgccgtaccgtcggtacgggacctacggacgccggtccgtcggaccgtcgtccggtacgtacgg

SEQ ID NO: 122653 - DNA, 734 bp, Homo sapiens
  misc_feature: GYAE6OF02F7MTU.52.81.H04.1.454.CMB.1.raw
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
  modified_base (540)..(540): a, c, t, g, unknown or other
  misc_feature (540)..(540): n is a, c, g, or t
tcagcgcagtacgacacgaccggtgctcgatttagtagtgtagattcgcggggagctctgcttcagctgtgagcgcagaaggcaggactcgggacaatcttcatcatgacctgcctcccctctcctcctcacccttctcattcactgcacagggtcctgggcccagtctgtcttgacgcagcccgccctcgagttgtcctggcccggccccaggaccagaacggtccacctatcctccgtgccttcgtggaacncgagcctaccaatagtggactaatttaatttgtcgttaccgtgtaaccngtaccaccgtcccgaggaccacgacccgaaccccctaagtccctacttatttacgaacgtacgtaataggtaacttaaccgccgtaaccgttacgaacgggtaacttacccgtcggtaaaccttacgttacctccggtaccgtccgtaacccgtaaggttccgtcggacctaaccggtacaccggtaccctaccggtcggaccctacgtacccgacccgtacgaccgaggtaccggngggaccgacggtaaccgttattacgtaacgccgtaacggaacgttagggtaacgtaacgtgaaccgtacgtaccggtagtacggacgttaacggtacccggccggtttaaccggggttacggttaacccggggacggggttaaccgggtaacccgaacgggtcccggttaaccgggttaccccggttaaccggg

SEQ ID NO: 122654 - DNA, 712 bp, Homo sapiens
  misc_feature: GYAE6OF02GRA9D.52.81.H04.1.454.CMB.1.raw
  modified_base (179)..(179): a, c, t, g, unknown or other
  misc_feature (179)..(179): n is a, c, g, or t
  modified_base (278)..(278): a, c, t, g, unknown or other
  misc_feature (278)..(278): n is a, c, g, or t
  modified_base (590)..(590): a, c, t, g, unknown or other
  misc_feature (590)..(590): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagcgtgtcgtttctagcgctaatttaaaggngtcagtagtgagtgcagctgctgcaggtcggggagcttaggaccagtccgtggggggtccctagaacggtacttccgtcctagttggaccagtacccgngttacggatttacctacccgttttacggcgttacctaacgttaggaaccgtacttaggaacggtcggttacggggttacccgaccggtaacggccgtttaccgaaacgggaatttccggggggaacttggggtaaacgggtcgggttaactaccggtaaggtttaacgttaaagtacggggttagtaggggtaaactaaacgtagtttaaccggtaatacgaacgtaccggtacgtagggaacgggtccattaccaatacgtccacgtacgaagtaactaactacgaacaacgtacaacgttatacctaganaacaagacaacgctaccgngaaccgngaaccggagtaacggaacctcctacttacgtaacgtaacggttaacgaaaactacgtaccgaagacgttacggaacgacggacggaacgacgaacg

SEQ ID NO: 122655 - DNA, 746 bp, Homo sapiens
  misc_feature: GYAE6OF02F7G6C.52.81.H04.1.454.CMB.1.raw
tcagcgcagtacgacacgaccggtgctcgatttagtagtgtagattcgcgggcgacgaccggtgctcgatttagtagtgtagattcgcggggggagcttggtacagcctgggggtccctgagactctcctgtgcagcctctggattcacctttcgcgtctatgacatgagcgtgggtcccgccaggcctccgaggtaagtggggctgggaggtcgggtctacgaggttattaagtaggtggtaggaagtaccatatacgcagtacgtccgtagaacgggccgcttcgaccatcctaccgagagacaattaccaagaaccactactgtatctgacaaagtcgaatacgcctagacggtacgccggaaggtacgaccggcctaaccgttatttaccgtaggtaaccgaaaagaactaaccgaacacgagtccgtagggaacgaggtaacgaccgaaccggacgtacgtacgttacgttacgtaaccgtacggtacgggtaccgtaacgggtaacccgttacggtaccgtaccgttccgtaccctacgacctacccgtacccaaccgaaccggacccgtaaccgttcccggttaccccgttcccccgttaccggtacccgtacccccgttaccctaccggtaacgaccgtaccggtaacccgttccgggtaccggggttacccgaccggtaacggccccgggtcccggtaccgggtacccgttccggtacccggtaccggtaacccggg

SEQ ID NO: 122656 - DNA, 840 bp, Homo sapiens
  misc_feature: GYAE6OF02H3YL0.52.81.H04.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (323)..(323): a, c, t, g, unknown or other
  misc_feature (323)..(323): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttggctgagcgtgtcttttctgtggcttaagtttaaaggtgtccagtgtgaggtgcgagtcngtctgacgagggtcgggggagtcgttggacncggccggtcgggggtaccctagggactactcctccgtgtcgcgacgtcctcgtaggtacttccgtacctttcggactctaagtcgacatgngtcgttcggacccgacgcggtcctaccgaggttaagcggggtctaggtacggttggtcctagtaaggttataaaggtacggttaggtacggtaacgttaacgtaacgttaactacggtaacgacgtacccggttacggtacgggtaaaccgggtccctacgtttaccccgaacttaccgtttaccgaccgtaaacggtaaccgtaaactaacccggttaaccgtaaaaccgaaccggaaccctttaaacgttcggttaaccctttagacccggtaaaggtaaaacttaacgaaacccgtaacggacccgttaaagggaacggaacccggaacggaaaccgggtttaaaccgaacccccggttacccttaaaggtttttacccggtttacccgtttaaaacgggaaaccggtttaaaaacgtaaaacccttaaacccgtaaaccggaaccgtacgggttaaaccgggtaacccgggggaaacgttaaccgggggaacccccgttaaaaaccccggggg

SEQ ID NO: 122657 - DNA, 716 bp, Homo sapiens
  misc_feature: GYAE6OF02GILQO.52.81.H04.1.454.CMB.1.raw
  modified_base (257)..(257): a, c, t, g, unknown or other
  misc_feature (257)..(257): n is a, c, g, or t
tcagcgcagtacgacacgaccggtgctcgatttagtagtgtagattcgcgggcacgaccggtgctcgatttagtagtgtagattcgcgggggggagcttggtacagcctggggggtccctgagactctcctgtgcagcctctggattcacctttcgcgtctatgacatgagcgtgggtccgccaggcctccgaaggaagtggggctgggagtgggtctcgaggtaattaataggtggtaggaagtacattattacgnagactccggtgaacgggccgcttcaacctatctaccagagaactaattccaagaaccactactgtatcctgaccaaatgaacacgcctagacggagccggaggaccgaccggacctaaccttattcgtagtaacgaaaagtaactaactaaccacgaagtacgtacggggaacgtaacgggacgaacccgaaaccgggactaacctttacgtttacgtttacgacgttacgggtacggggaccgaaccggggtaacccggtagtacccgccgttaccgtcccttacgacctacccgtacccgaaccgaaccgggaccctacggttcccgttacccgttccccgtacggtccctacccgtccgtaccgaacaccggaccgtacccggtacgggtccggggaaccaccggtaccggacccggtcccggtccgggtccgtccggtcccgtagggtaacccgg

SEQ ID NO: 122658 - DNA, 688 bp, Homo sapiens
  misc_feature: GYAE6OF02G1HZX.52.81.H04.1.454.CMB.1.raw
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (598)..(598): a, c, t, g, unknown or other
  misc_feature (598)..(598): n is a, c, g, or t
  modified_base (666)..(666): a, c, t, g, unknown or other
  misc_feature (666)..(666): n is a, c, g, or t
tcagcgcagtacgacacgaccggtgctcgatttagtagtgtagattcgcggggagctctgagagaggagcccagcccctgggattttcaggttgtttttacatttggtgatcaggactgaacagagagaactcacaatggtagtttgggctgagcgtgtctttctgnggatagtttaaaagtgtctagtgtgaggtcgnagctncgtgcgagggtcgggggagtcgttggaactcggccggtcggggggtaccctagacgtaccgtctccgttagcgcgactacctcgtgtactttctacctttcggtacttctatacgatggtatcgggtccgtcgggtccggtaccgtacggttccgaccgaaagggtacggtcgggtacggtaggtacgggttccggtcttacgtaaggttaattaaggtaggggttagggttaacggaaagttactaacgttaaacgttaacgagttaaccgtacgtccgtagggaaccgtccgtactcgtaccgtatccgtaaccgaagaccgtaaactaataaccgaaaacgtaaccacgtactagtacttactacgaagaatacaaactcgactaggaccncggtaacgacgacgacctacccgtattcttagtaacggaataaaccgaactaaccgaggataaccggnaaccggtaggagaccggtaacg

SEQ ID NO: 122659 - DNA, 606 bp, Homo sapiens
  misc_feature: GYAE6OF02IFKGV.52.81.H04.1.454.CMB.1.raw
  modified_base (211)..(211): a, c, t, g, unknown or other
  misc_feature (211)..(211): n is a, c, g, or t
  modified_base (374)..(374): a, c, t, g, unknown or other
  misc_feature (374)..(374): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
  modified_base (547)..(547): a, c, t, g, unknown or other
  misc_feature (547)..(547): n is a, c, g, or t
  modified_base (559)..(559): a, c, t, g, unknown or other
  misc_feature (559)..(559): n is a, c, g, or t
  modified_base (600)..(600): a, c, t, g, unknown or other
  misc_feature (600)..(600): n is a, c, g, or t
tcagcgcagtacgacacgaccggtgctcgatttagtagtgtagattcgcggggagctctgagagaggagcccagccctgggattttcaggtgttttcatttggtagatcaggactgaacagagagaactcacatggagtttgggctgagctggtctttttctgtggtacttaattttaaaaggtgtaccagttgtggtaggtgcagctgcngcgagggtcgggggagtcgttaggtacgacggtcggttcggggggtccctggacgacttccgtcgttagtcggactacgccgttgtaggacttccgtaccctttcggccgttatagtgactatgacgtcggtcgggtccacggacgcctacgaggagtggcgnggtggtggtcagtagtatagtaggtcggtagtaactatatacgtacgagtacacgtcggtacggacggtccgtactcaacgactccacgaagtacaactaactactaaacgactaactcgtagtacncgtanaactaanagtaacgancgtagacgacgcgtaagccgaacgntacttgttacgngtaaacaagtactacgatacgactagtacggagaccggtanaaccgg

SEQ ID NO: 122660 - DNA, 770 bp, Homo sapiens
  misc_feature: GYAE6OF02H009V.52.81.H04.1.454.CMB.1.raw
  modified_base (645)..(645): a, c, t, g, unknown or other
  misc_feature (645)..(645): n is a, c, g, or t
tcagcgcagtacgacacgaccggtgctcgatttagtagtgtagattcgcggggagctctgagagaggagcccagcccctgggattttcaggtgttttcatttggtgatcaggactgaacagagagaactcaccatggagtttgggctgagctgcttttctgtggctatttaaaggtgtccagtgtgaggtgcagctgctgcgaggcggggggagcgttggtacacggtccgtcggggggtccctgacgtactccgtccgtggtcgcgtacgcctcgttcggtacttccgtaccgtttccggcgttacttagtcgaacctaagttggacgtcgttccgggttccccggaccgacggtccctaccggaagggtaaacggtcgggggtaccgtgggtacgggttcggggttccgtaggttaacgggttaattaaggttagggtggggtaaggtaaacgtaacctaaagtttaacgtttacggactaacggtaccgttaccggtaagggaaccgggtcccgtacgtttaccgtaacccttacgttaccccgtaccgaacggtaacgtaaaccgtaaacgtttaaccgaaaccgaaacctaaccgtaacgtaggttaaccttacgtacgaaccgaaattaaccggaaacncgtacgtagaacggacgtaccggaagaacgacccgtactaaccgttactacggttaacgaacggtaaacaaacgtacctaacgaccgaacggtcgaacggtaacggaggtaaccgtaaacccggg

SEQ ID NO: 122661 - DNA, 785 bp, Homo sapiens
  misc_feature: GYAE6OF02GQ253.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcacatggagtttgggctgagctggtctttttcttggtggtcttaattttaaaaggtgtccagttgtggaggtgcacgctgctgcgagggtcgggggggaggtcgttaggtacacggccggtcgggggggtccctaggtacggaccttccgtccgtacggtcgaccgacgtcctcgtcggtacttccgtaccctttcgcgttactatgactagtgacgtcgtcgggtcccgccgacggcctacgagggtaaggtgggggactggggtacggttcggggtacctacgtaagggttaatttaacgtaggggtagggttaggaaacgtactaagtttacgttaacgacgtaacgaccgttaccgggagggtaccgggcccgtaccgttaccaaccgtacgtacctaccgaacgaaaccgtaactaaacttaacccgaaacgtaaccaacgtaacttaggtacttacgtaacgaacctaaacgtacgtaaccgaccgtaccgtaggaacgtaaccggtaaccgggaacggtaaaccggacccgtaaccccgttacgtttaacgtttaccgttaacgttaaaccgggtaaaactaacgtaacctaaccggtaacgtacggtacggtaaccgggtaacgggaccgggtaaccggtaaacccggg

SEQ ID NO: 122662 - DNA, 772 bp, Homo sapiens
  misc_feature: GYAE6OF02FHMW0.52.81.H04.1.454.CMB.1.raw
  modified_base (331)..(331): a, c, t, g, unknown or other
  misc_feature (331)..(331): n is a, c, g, or t
tcagcgcagtacgacacgaccggtgctcgatttagtagtgtagattcgcggggagctctgagagaggagcccagccctgggatttttcaggtgttttcatttggtgatcaggactgaacagagagaactcaccatggagtttggctgagctgctttttcttgtggctattttaaaaggtgtccagtgtgaggtgcagctgctgcaggtcggggggaggcgtttggtacaggccgtggggggtcccctgacgactctcctgtcgcagcctcgtggacttcaccgttttcgcgtctatgactatgagcgtggtccgccgagctccgaggaagnggggctgggacgtggggtactcgtaaggttattaaagtaggtaggtaggtaaagtacgtaagttaacgttacggtactaacggtaccgttacccgggttagaaacgggggtcccgtacctttaccggaaaccctacttacccgttacccgaaaggtaaccgtaaaccgtaaactttacccgaaaaacggtaaaccctaacctaaaccgtttaggttaaccttaccgtacggtaaaccgtaaaagttaccggaaaactaaccggacccgttaaggaacggtaccgggaacccggtaaacggaacccgaacccgggtaacccctttaccgttaacgttttaccggtaacggttaaaacccggaaaaagttaaaccgtaaccgaaccgtaaccgaacggtacccggttaagggaaccccgggaagggtacccggtaaaccccgg

SEQ ID NO: 122663 - DNA, 904 bp, Homo sapiens
  misc_feature: GYAE6OF02HAR9Q.52.81.H04.1.454.CMB.1.raw
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
tcagcgcagtacgacacgaccggtgctcgatttagtagtgtagattcgcggggagctcttgagagaggacgcccagcccgtgggtatttttcgaggttgtttttcatttggtgatcgaggactgaacagagagtaactcacagtggtagtttggctgagcgtgtctttcgtacgtgtacttaagtttaaaggtctacgtagtgtggtacgtcgcgagtctggcctagcgtagggtcgggggtatacgttggacncggtccgttcggggccttagctacttcgctgcgacncgtctacgtggtcttaccgttacgttcgtccgtacgttacgacgtaacttaggtcggacgttccgtttacgggggtacccctcggaacgttccgttaccgggaaagggtaggtcggggtacgtgggttaaccggttgttccgtaagggttaagtaacccttaagggtgggttaccggttaaggaaaacctttcggaatttaacggttacggtaaccgacgttaccggttccggaaggggtacccgttcggtacctttaccgaaccgttcggttacccaccgggttaaacacggtaaaccctttaacccggtaaaggtaccccgaaaaagtacctttaaaccgggtctttaaccggtacgttaaacctaaaccggaaacggttaaaccaaacccgggtttaaacggtccggtaaacgggaacgaccgggtttaaacccggacggaaacccgtaaccgggtacccttttaaccccgggttaagtttttaccccggggaaatttaaaccccgggaaaacgggttttaaaccaaccgtttaaaacccgacgggtaaaccccggttacggttaacgggaaaccgggtaaaccccggggtaaccggtaaaaccccccggg

SEQ ID NO: 122664 - DNA, 883 bp, Homo sapiens
  misc_feature: GYAE6OF02IRN64.52.81.H04.1.454.CMB.1.raw
tcagcgcagtacgacacgaccggtgctcgatttagtagtgtagattcgcgggggagctctgcttcagctgtgagcgcagaaggcaggactcgggacaatcttcatcatgacctgctcccctctcctcctcacccttctcattcactgcacgacggtcctgggccctagtctgtgttagacgtcacgccgccctcgagtcgtctcggccggcccaggacagacggtccacatcctcctgctcgtaggaacgcacgcctaccaacgtagttcggaactaaatttaagttttcggtacgttaccgttacgaaccgtaacggacctaaaccgttccgacggacctaaccgtacccgaacccccctaaaacttacccttacgtttaaacttttaacgacggtaaacctaaacgttacggaaacgttaaaccggacccgttaaccccgtacggaaaccggggttaaccctttaaccccggtaaacggttaaccccggtttacttttaacccgtacccggtttaaccggggacccctttaaaacccgggtaaacggtttccggtaccggggtaacccgttaaccggttacgtaaccccggtacccccggtaacgggttcccggggtaaactaacccggttaacccgggaacccggtaacccttaaccggaaccgggtaccgggttaaccgggggaacccggtaacggtacccggttattttaaccgggtaaccgtagggaaccggttaacgtaacgggttacgggtaaccgtacggaccgttacgaccgtaggtaaccggtacggtacggtaccgttcgggtaacggttccggggtacggaccggggtaacggtaaccgacgggtaaccgttccggaacccgttaaccgg

SEQ ID NO: 122665 - DNA, 754 bp, Homo sapiens
  misc_feature: GYAE6OF02HIKXD.52.81.H04.1.454.CMB.1.raw
  modified_base (293)..(293): a, c, t, g, unknown or other
  misc_feature (293)..(293): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagacgaactcaccatgggagtttcgggctgagcgtggtcttttcttggtggcttaatttaaaaggtcgtacctaggtgtgaggtgcagctgctggcgaggtcgggggaggtcgttggtacaggtccggtggggggtaccctggaacgccttcgtccgtgtcgcacgtccgtntggacttctacctttcgcgtcgtatgtaacattgacgtcgtcgggtacccgccgtaaggtcctaccggaggaaggtcgggcgtgggtagtggggtcctacggaaggttaacgttaagtaggttgggtaaacggtaagttaactaacgttaagttaccgtaacgggactaacccggttacccggttagggaacccggggtccctaccgttccgaaccctagtacccgtacgtaagaacgtaactaacgttaacaaacgtaaccaacgtacgttaacgtaacgtacgtacgaacaaacggttagaaacgtaccgaccgtaggaaccggtaacgggaaccggaacggaaccggtaccgtaaccgttaccttagtttacccgttaagaaaaccggtaaaccggtaaactaacccgaataccgtaaccggtacggtacgggaaccggtacggaaccggtaaaccgg

SEQ ID NO: 122666 - DNA, 768 bp, Homo sapiens
  misc_feature: GYAE6OF02G9XQ4.52.81.H04.1.454.CMB.1.raw
  modified_base (620)..(620): a, c, t, g, unknown or other
  misc_feature (620)..(620): n is a, c, g, or t
  modified_base (690)..(690): a, c, t, g, unknown or other
  misc_feature (690)..(690): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtcgttttcttgtggctagtttaaagtgtcagtgtgagtgcagctgctgcaggtcgggggagtcgttaggacgacggccgtcggggggtccctggaagtaccttcgtccgtagtcgcacggtccttcgtggtacttcgtaccgtttcggtacgttctagtacgtacagtagtacgtcgtcgggtcccgtaaccggtacggtacccgtaccggtaaggtaacgggtcggggtacgttacggggtaagggttccgggttaacccggttacggtaagggtttaaacgtttaagggtaggttacggggttacgggaaaccgttaactaaaaggtttcttaacggacgtaagtaccggtaccggtaggaaccgggtccgtaccgttacgaacctacgttccacccgtaaaggtagaacctaaaccgttaacggaaacctaaccgtaacggactttccggaaacttccggtanaacggttaacgacgaaaccgttcgaaacgttgacgtaccggtaccgagtacccgaccggtctaaccgttntttaacggtacgttaaacggaaacttaacgtaccctaagacctacggtaccggtacgacggtaaccggagaaacccgg

SEQ ID NO: 122667 - DNA, 1001 bp, Homo sapiens
  misc_feature: GYAE6OF02G0CT3.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccagtggtagttgggctgagcgtggtctttttctagtggtcttaagttttaaaaggtgtcctagtgtgagtgcagctgctgcgagggtcggggggagtcgttaggtacgacggccggttcggggggtaccctggtaacgtaccgttccgtccgttggtcgacctacggtcccttcgtaggtacctttaccgtaacccgttttcgtaccggttaccttaagtacgaaccgtaagtcgtaacggtccggttaccgggtacccggccgaaccgggtccctacccggaagggtaacgggttcggggaccgttaggggtacggttacggggttaccgtaacggtaaccggtttaaacgtttaaggtaaacgggtttaggggttaacggtaaaacggttaaacgttaaacgttaacgggtttaaacccggaaccggtttaaacggtaaccccggttacccggggtaaagggtaaacccggggttcccggtaccgtttaccccgaaacccgttaaccgttacccgtaacccgtaaacggtaaaccgggtaaactaaaacctttaacccgaaaaccgtaaaccgtaaccgttaaacgttaccggttaaaccttacgtaaccgaaaacgttaaacgtaacgaacccgtaacggtaaccgttaacggaaccggtaaccgggaacccgggaaacgggaaaccccggtaaccgggaaccccgtttaacccgtttaaacccgttttaccggtttaaaaaccggttaaaaccggtaaaaaccgggtaaacccttaaaacccgttaacccggaaaacgttaaccgggtaaacccgggtaaccggggtaaaccggtaaaccgggtaaccccgggtaaaaccccgggg

SEQ ID NO: 122668 - DNA, 855 bp, Homo sapiens
  misc_feature: GYAE6OF02FOFAX.52.81.H04.1.454.CMB.1.raw
tcagcgcagtacgacacgaccggtgctcgatttagtagtgtagattcgcgggcacgaccggtgctcgatttagtagtgtagattcggcggggggagcttggtacagcctgggggtccctgagactctcctgtgcagcctctggattcacctttcgcgttctatgacatgagcgtgggtccgccgaggcctcgaggaagtggggctggagtgggtctcgaaggttattaagtacggttgggtacgggaacgttacaagttaacgttacgacgtaacggtaccgttcccggtagggaaaccgggggtccccgtccttttaccgaacccgtaaattcccgttccgaaaggaacgtaactaaactttaccccgaaaaggaaaccaaccgtaacttaggttacttaccgtacggtaaccgtaaaattacgggaaaccaacgtcccgtaagggtaaggaccgggacccggtaaagggaacccgtacccgggtaccctaacctttaacgtttaccgtaacggtaaaaccgaaaaggtaaacttaacccgaacacgtaacgtcgtaacggggaacgaacgggacgaaacccggaaaccggaccgtaacgtttaacctttcgtttaacggtaccgttaaccgggtaccggggaaccggtaacccggggtaacccgttacgggtaaccgtaccccgttaccgttccccgtacaccgtaccccgtcccgaaacccgggtacgccccgtacgttcccggtccccttaccccgcggtccctacccgtcctacccgtagaccgtacccgtaccgtacggcggacaccgtacggccgtaccggtcggtcgtccggtacgtcggtaaccgg

SEQ ID NO: 122669 - DNA, 722 bp, Homo sapiens
  misc_feature: GYAE6OF02FJ6OG.52.81.H04.1.454.CMB.1.raw
  modified_base (292)..(292): a, c, t, g, unknown or other
  misc_feature (292)..(292): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggaggtttgggctgagctggtctttttcttgtggtctattttaaaaggtgtcagtgtgaggtgcagctgctgcgaggtacgggggggacgtacgttgggtaccgaggtcccgttcgggggggtccctaggacgtaccttcgtcccgttggtcggaccncgtccctcgtggtactttcctaccgttttccgccgttctatcgactagtggagtcgtcggggttcccgaccggaacggtcctccggaagggtacggtacggggcgttaacgggtggttcgggtaccgttacgtaaggtttaagttaaacggttacggggttagggttaggaaacggtttactaacgtttacgttaaggccgtaacgtaccggtcccggtagggtaacgggcccgtacgttccaaccgtaactctaccgtaagtaacgtaaacctaacgtttaaccgaacgaaacacctaacgttgtaactccgtacgaacgtaacgtaacgaactacgcgtaagacgcgacgtacggacgaccgcctacgtcttacgttaacgaactaagtaactacactacgacgacgacggacgacggacgaacccgg

SEQ ID NO: 122670 - DNA, 762 bp, Homo sapiens
  misc_feature: GYAE6OF02HR4CZ.52.81.H04.1.454.CMB.1.raw
  modified_base (507)..(507): a, c, t, g, unknown or other
  misc_feature (507)..(507): n is a, c, g, or t
  modified_base (546)..(546): a, c, t, g, unknown or other
  misc_feature (546)..(546): n is a, c, g, or t
  modified_base (592)..(592): a, c, t, g, unknown or other
  misc_feature (592)..(592): n is a, c, g, or t
tcagcgcagtacgacacgaccggtgctcgatttagtagtgtagattcgcggggagctctgagagagagcccagccctgggattttcgaggtgtttcgattggtgatcaggactgaacagagagtaactcaccatggagtttgggctgagctggtcttttcttgtggtacttaagttttaaaggtcgtaccgtagtggtgtaggtgtcagtcgtgctcgcgtagggtccgggggtagtcgttacggtaccgtacggccggttacggggggtcctaggtacgtaccgttcctccggtgtacgtcgtacgtccctaggtcggtaacttccgtaaccgttttcgccgtttacgtaacgtcggtacctagtccggtacggtccggttcgggtcccgtacggtacggtacctccggtaagggtacggtcgggtaccggtgggtaacggttccgggtgtaccgtaaggttacttaaggtacggtaggtaacgttacgtaccgtagttactcganacggttactacggtagaccggtccttacgtaccaccgtnttcgactgtaaaccgtactacgttaaccgaacgtaacctatacgtnttacgtacgtaccaacgtaagtcgtaaacgccgtaccgtaaggaccgacgggttaacccggagaacccgtacgtacccttaccgtaggttaccgtaaacggtaacggtaaataacccgtaacgaacgtacctagggttccgaacggttacggacgtaaccggtaacccgg

SEQ ID NO: 122671 - DNA, 867 bp, Homo sapiens
  misc_feature: GYAE6OF02HM38B.52.81.H04.1.454.CMB.1.raw
tcagcgcagtacgacacgaccggtgctcgatttagtagtgtagattcgcgggcacgaccggtgctcgatttagtagtgtagattcgcggggggaggcttggtacagcctgggggtccctgagactctccgtggtgcagcctcgtggattccacctttcgcgtctatgacatgagtcgtgggtacccgcgaggcctccgaggagtggggactggtaggttcggtcgtacgaaggttattaagtaggtggtagaaacgttactagtaacgttacgcgtaacgtacccgttacggtaacggaacggggtccctacgttaccaacccgtacgttccctacccggaaggtaaccgaaaccgttaaccgtttaacccgaaaacgtaaacctaaccgtaccgttaagtacgttacgtacgaacgtaaacgttacggaaacctccggtaccgtaggacggaccggaccggacggtaccgacccgtaccgtaaccttttagttaccgtaacgtaaacggtaaactaaacgtaaccgaactaacggaggtacgtacgggaacgacgggaacgaacccgaaacggttaccttacttacgtttaccgtaacgtaccggtacggttaaccgggaccggtaaaccgggtacccttacggtacccgtaacccgttcccgtaacccgtcgtaacccgtacccgttacccgaaaccggttaaccgggtccccgttacggttcccggtttacccgtccccggtagtaccccttacccccgtacgaaccgtccggtaaccgtacccgttaccggccgggtaaccggttaccgaccgtaaccggcccgtttaaccggcggttaccgtcggtccggtaccgtaaccgg

SEQ ID NO: 122672 - DNA, 843 bp, Homo sapiens
  misc_feature: GYAE6OF02G1T03.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttcttgtggtacttattttaaaaggtgtccagttgtgaggtgcagctgctgcgaggtcggggggaggtcgttagggtacacggtccggttcggggggtcccctggacggtacctcgttccgtgtgacctacgccttcgtacggtactttacctcccgtttcgccgttctatagtacagttaggacgtcggttccgggtccgccgacgggtcctacgacgggtaaggtggggtaccgtgggaggttcggggtacgtacggtaggtttaaagtttaacggttagggtttacggggtaaggttaaacgtaagttaacgttaacgttaccgacgtaacggttaccgttaccggtaacgggtaaccgggtcccgtacctttaccgaaccctaaccgttaccgttaacccggaagtaaccgtaacgttaaacgttacccgaaaacgaacctaaccgtaacgttagtacgttaccgtaacggtaacctaaacgttcggaaaaccaccggttcgaaggtaaccgaaccgggaccggtaaacggaaacccgtaacccggtacccgttaacttttaaccggttttaccgtaaaccgggttaaaaactaaaacggttaaacccttaaacgaaccgaaacgttaccgggtaaccgttaagggggaaacccggtaacgggaaacccgtaaacccgggg

SEQ ID NO: 122673 - DNA, 646 bp, Homo sapiens
  misc_feature: GYAE6OF02GYQHC.52.81.H04.1.454.CMB.1.raw
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
tcagcgcagtacgacacgaccggtgctcgatttagtagtgtagattcgcgggcacgaccggtgctcgatttagtagtgtagattcgcgggggggaggcttggtacagcctggggggtccctgagactctcctgtgcagcctctggattcacctttcgcgtctatgacatgagctgggtccgccaggctccaggaatgggggctggagtgggtctcaggtattaatagtggtggaagtacatattacgcagactccgtgaagggccgcttcaccatctccagagacaattccaagaacacactgtatctgacaaatgaacagctgagacgcgagacncggccactattctgtaacgaaanaatacacacagctggacgaggagaccgaacgccgactacttcttgacgtacgtcgggaccgacgggaccctcggtaccgtacccgtcctcctcacgtcccacccgtaaccgaaccgggtccccacgttccggtcccgtttccccccgtacgggtcccctacccccttccctaccccgaccgaccgtaccccgaacccggttaccgggttaccggggggaccctaaccgaccgggtcccgggtccccggttccggggcccgtttaccggcccgttacgggtaacccgg

SEQ ID NO: 122674 - DNA, 755 bp, Homo sapiens
  misc_feature: GYAE6OF02IF6CD.52.81.H04.1.454.CMB.1.raw
  modified_base (283)..(283): a, c, t, g, unknown or other
  misc_feature (283)..(283): n is a, c, g, or t
tcagcgcagtacgacacgaccggtgctcgatttagtagtgtagattcgcggggagctctgagagaggagcccagccctgggattttcaggtgttttcatttggtgatcaggactgaacaagagaagaactcaccatggtagtttgggctgagcgtgtctttttcttgtggtcttaagttttaaaaggtgtccgtagtggtgaggtgcagctgctgcgaggtcggggggagtcgttgtacgacggtccggtacgggggtccctgaacgtaccttcctccgttgngaccgacgtccttcgtaggtaccttccgtaccgtttccgtccgttactacgttacgacgtagttagtacggtaccgggtccggtacccgaccggtacggtacccgtacggaagggtacggtcgggtacgtagggtcggtcggtacgtagtagttaacgttaggtggttaggaagtactaagtacgttacgtaacgacgtacgttcggtacggtacgggtaccgtccgtaccgtacctaccgtacgtacctaacgtaacggactaaacgtaacctaactaaacgaacctaacgttacgtacgtaccttaccgtaagaaacctaagaaccgaaacgtacgtacgagtacgaccggaccgacggaaccgtaccgtaaccgttcgttaacgttaacggtaaacgtaaacgtaacgtaaaccttaacggaacaacggtacgtaccggaacgggaacggtacggaacccgtaacccgg

SEQ ID NO: 122675 - DNA, 736 bp, Homo sapiens
  misc_feature: GYAE6OF02G8CHN.52.81.H04.1.454.CMB.1.raw
tcagcgcagtacgacacgaccggtgctcgatttagtagtgtagattcgcggggagctctgagagaggagcccagccctgggattttcaggtgtttcatttggtgatcaggactgaacagagagaactcacatggagtttgggctgagctgtctttttcttgtggcttaattttaaaggtgtccagtgtgaggtgcagctgcgtgcgaggtcggggggagtcgttgggtacacggccggttcggggggtccctggacgtaccttccgtccgtgtcgcacgtcccgtcgtggtacttcctaccgtttccgccgttctaacgtcgaacagttcggacgtcggttccggggtcccgccgacgggtccctaccggaagggtaacggtcgggggcgttagggagggttcggggtacctacggtaggtttaatttaagtaaggttggggtagtaagtacgatttagtacgctaacgtacgtccggtaggacgggtcctacctaccacgtactcctaccgagaacgtacaaacttaccgaaatacctaagtaccgtagtactacgtacaactaaagtaacgaacgacgtacgacggaacgaccggtaccggaacggaacccgtacggtaccccttacgtttacgtttaaccggtaaccggtaaaacgtaaacgtaaaccgtaaccgaaccgaacgtaacgggtaccggtaacggggaaccggtaacggacccgggtaaacccgg

SEQ ID NO: 122676 - DNA, 630 bp, Homo sapiens
  misc_feature: GYAE6OF02GIH3K.52.81.H04.1.454.CMB.1.raw
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (402)..(402): a, c, t, g, unknown or other
  misc_feature (402)..(402): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatgggagtttgggctgagcggtcgtgtttctaggtcggctaattttaaaaggtgtccagtgtgaggtgctagctgctgcagtcgggggngcgttggacagcgtagggggtcctgagactctcctgtgcagcctcgtaggnttctaccgttgccttntactgacatgagcgtggtccaccgnggctaccgagggtaangggggtctggacgtaggggtcctacgaggttattaagtaggtaggtggtaaaacgtcaagttattacggacngtacctcggtagaacggtcacgttgacctagtctaccaagcgtaagtaactccaaacgacacgtaattacggtaccttagtacgtaacaatacgaacgacgtacgagtacgaacggacggacggtaaccgaaccgtacccgtaccgttacgttacgtaacgtaaacgtaaacgtaacgtaacgtaacgaaccgtaccgtaccggtacggtaacggacggaacgaaccg

SEQ ID NO: 122677 - DNA, 759 bp, Homo sapiens
  misc_feature: GYAE6OF02JEHZS.52.81.H04.1.454.CMB.1.raw
  modified_base (181)..(181): a, c, t, g, unknown or other
  misc_feature (181)..(181): n is a, c, g, or t
  modified_base (311)..(311): a, c, t, g, unknown or other
  misc_feature (311)..(311): n is a, c, g, or t
tcagcgcagtacgacacgaccggtgctcgatttagtagtgtagattcgcggggagctctgagagaggagcccagccctgggattttcaggtgtttcatttggtgatcaggactgaacagagagaactcaccatggagtttagggctgagctggcttttcttagtggctaattttaaaggtntccagtgtcgaggtgcagctgctgcaggtcgggggagcgttggactaggccgtgggggtcccttggacgtactcgtccgttagcgtacgcggtcctcgtggtactttctaaccgtttcgcgttacttacncggtacaattggaacgtccgtagggtccgacccgaggccttaccgaagggtaacgtcggggaccttggggacgttggggtcttacgtaacggttattaaacgtaggtacgggtaggtaacggtacaacgttacgttaacgacgtaacggttaccctccggtaaggtaacccgggtccgtaccgttaaccgacccggtataccccgttaccgaggtaacgtaacgtaaacgtttacccaaaacggacccttaaacgtacttaacggttacctagttaccggaactaaaccggttaataaacccgaccggtaacccgtaggagaacccggtcggaaacgtaacccgccgttaaccctacgttaacgtccgttaagaaacccggttaaaaataaccgttaccaacggtaccgtcggtaccggtaagggacccgtaaccggacgtaacccgg

SEQ ID NO: 122678 - DNA, 755 bp, Homo sapiens
  misc_feature: GYAE6OF02FI3GA.52.81.H04.1.454.CMB.1.raw
  modified_base (208)..(208): a, c, t, g, unknown or other
  misc_feature (208)..(208): n is a, c, g, or t
  modified_base (396)..(396): a, c, t, g, unknown or other
  misc_feature (396)..(396): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggtagtttgggctgagtctcggtctttttcgttgtggtcctaagttttaaaaggtgtccagtcgtgaggttcgngagtctgctgccgtagggtcggggggaggcggttcggacgcgtccggtcgggggtccctggacgtacgtctccgtgtcggcacgcctcgtaggtcttcctaccgttttcgaccgttacttatcgactatacggacgtcgttacggcccgtacgacggtcctacggaaggtacgtcgggcgttacgggnggttcggggtactagtaaggttacgtttaaggtaggtagggtagtaacgttactaagtttaacgtacgtagaaccgttaccgtaccggtaggaaccgggtccctaccggttaccaaacccttgttaccccggtacgtaacgtaaacccgaaccgttaaaccgttaaccgaaaacgtacctaaaactaccggttcgtaacttcgtaccgtaaataacgtaccgaactcccgtaaacgacggacggtaacgtaccggtaaagtcccgaacccgtaccgttacctacttacggtaacgtaaacgaaacgtaacaccgtaaccgacgtacgacggtaccggacggtaacggacctaacccggg

SEQ ID NO: 122679 - DNA, 768 bp, Homo sapiens
  misc_feature: GYAE6OF02GMC7B.52.81.H04.1.454.CMB.1.raw
  modified_base (187)..(187): a, c, t, g, unknown or other
  misc_feature (187)..(187): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgcttttcttagtggctattttaaaaggtgtcagtntgaggtgcagctgctgcagtcgggggagcttggtacagcctgggggtccctgacgtactctcctggtgcgagtcctctggcgttcacctttcgacgtctaagtcgcagtgagcttagggtccnccgtaacgtcgaccgtaggaacgtcggggtaccngggtaacgtcggggttaccgacgttagggtaacgtttaaagtacggttacgggtaggtaaacggttacaaggttaactttaaccggacgtaaccggtaacctttacccggtacgggttaacggggacccgtacgtttaccgtaacccgtacgtaccgtaccgtaacgacgttaccgaaacgttacccgaaaggtaacctaaccgtaaccgttacgtttaacctaccgtaaggtaacccgtaaagttacccgggtaaataacccgtccggttaagaaccggttacgaacccgggaccggttaaccgtaacccggtacccgtactttaaccgttacgttacggtaaaccggtaaaacgtaaccgtttaaaccaaccgttaaccggacgacccggtttaggaacccggagggaccgtaaaccccggg

SEQ ID NO: 122680 - DNA, 891 bp, Homo sapiens
  misc_feature: GYAE6OF02JNA7C.52.81.H04.1.454.CMB.1.raw
  modified_base (187)..(187): a, c, t, g, unknown or other
  misc_feature (187)..(187): n is a, c, g, or t
  modified_base (248)..(248): a, c, t, g, unknown or other
  misc_feature (248)..(248): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
tcagcgcagtacgacacgaccggtgctcgatttagtagtgtagattcgcgggcacgaccggtgctcgatttagtagtgtagattcggcgggggggaggcttaggtacagccggtaacgggggtcctgagactgtcctgtgcagtcctgtggtacttcctaccgttttcgccgtactagtcggaaccncgggtaaaccggctcgggggtcccgcccagggcctccggaggaaggtgggggaaccgtggngtgggttcacccgtaagggttaagttaagtacgggtcgttttaaagactattattacgcgagactaccgtggaaggggccgtcttccaccactctcctagagacggtaaccttaccaagaacacactagttactatccccaaatcgtcgaaattggacctggacgagaccggacggaccacggtacnccggttaacttactntacgtaccgaaagtaactaccgaaccgaaacggtaccgtacggtaaccggacgggaaacggaccgtaaacccggtaaccgggtacgtaaccgttaaccgtttaccggtaacgggtaacccgttacggggtacccggtacgggtaacccggttaacccggtccgtaacccgtccgttccctacccgtaccggacccgtaccgacccccgtaaaccgggttcccccggtaaccttaccccggtaccgttaccccccgtttacccccggttccgggaaaccccttccccgaaaccccggttaacccgttaaaccgggggacccgtaaccccggtacccttcccgggggtgggaaacccccttaaggggaccgggtacccggccccggttaccgggggtttaccaacccgggttaccggttacccggttaccccggtaaaccggg

SEQ ID NO: 122681 - DNA, 859 bp, Homo sapiens
  misc_feature: GYAE6OF02JCKWF.52.81.H04.1.454.CMB.1.raw
  modified_base (166)..(166): a, c, t, g, unknown or other
  misc_feature (166)..(166): n is a, c, g, or t
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (500)..(500): a, c, t, g, unknown or other
  misc_feature (500)..(500): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctggagcggtgtgttctaggnggctatttaaaggntcagtgtgaggtgcagctgctgcagtcgggggagtcgttggacnggtccgtggggggtccctggacgacctgtccngtcgccgagtccctgtgggtaacttacctaccgttttcggaaccgttccgtaattcggaaccgtattacgaggtccgttcgggttcccgtacgacggttacctaccgaacgggtaaggttacgggggtccttaagggtaccgggttgggggtttacccaggttaagggttaacccgttttaaagtacgggggtttacgggttaacggggaaggtaaacccttaagttaaccggttaaacccggngtaaaccgggtccgtttccggggaaacgggtaacgggtcccggtaacctttaccgaacccttacgttaaccccggtaccaagggtaactacccttaaacgggtaacccaaaacggttaaaccctagaaaccggttaccgttaattacccgaggtaaaccttaacgggttaaccaaacgccggttaaccgtaaggtaaccgtacccgggaaggttaaccgggacccaaccgggtttacctaccccgggttttaatttcccgggtaaacgtaaaccggtaaaattaaccccgaaggttaaaccccgaacgttccccggttaaggtaacggtaaacccgggttacggacccgtaaacccggg

SEQ ID NO: 122682 - DNA, 992 bp, Homo sapiens
  misc_feature: GYAE6OF02HWWTO.52.81.H04.1.454.CMB.1.raw
tcagcgcagtacgacacgaccggtgctcgatttagtagtgtagattcgcggggagctctgagagaggagccccagcccctgggattttcaggtgttttcatttggtgatcaggactgaacagagagaactcaccatggagtttggctgagctggtctttttctgtggtcttattttaaaggtcgtcagtgtgaggtgcagtctgcgtcgcgtagggtcggggggacgtcgttagggtaccgacggtccggttcggggggtaccccgtggtaacggtaccttccctccgtggtcggtccgaacggtcccttacggtacggtcgttcccgtaccgtttccgtccgttactaagtcgaactacgtacggtacgtcggttcgggtaccccgacggacggtcccgttaccgaacgggtaaacggttcgggggaccgttaggggtacgggtttacggggttccgtacgggtaaacgggtttaactttaaacgggttaacggggtttaggggtaacgggttaaaaccggttaaccgtaaagttttaacgttaacccgggagttaaacccggtaccgttttacccggggacgggtaaacccgggttacccgtccgtttacccgtaaccggttccgttaacccgttaacccggaaggttaaaccggtaacctaaaccgtttaacccgggaaaactaaacccggtaaacctttacccgggttaattaacccggtttaaacgttaccggtaaaacgtaaaccgttaaaccggtaaaaccgtaaccggtacccggtttaacgggaacccggtaaccggggtaacccgggttaaacccggaaaccgggtttaccccgaaccgtttaacccgttaccgtttttaaccggtaaaccgggttaaaccggtaaaaccgtaaacccgtttaaacgaaccccggtaacgttaaccgggtacccggttaacggggaaaccggttaaccggggacccgtaaaaacccccgggg

SEQ ID NO: 122683 - DNA, 653 bp, Homo sapiens
  misc_feature: GYAE6OF02FWBSM.52.81.H04.1.454.CMB.1.raw
  modified_base (452)..(452): a, c, t, g, unknown or other
  misc_feature (452)..(452): n is a, c, g, or t
tcagcgcagtacgacacgaccggtgctcgatttagtagtgtagattcgcgggggagctctgagagaggagcccagccctgggattttcaggtgttttcatttggtgatcaggactgaacagagagaactcaccatggagtttgggctgagcgtggtctttttctgtggcttagttttaaaggtgtcagtgtgaggtgcagctgctgcaggtcgggggagtcgttggtacagccgtgggggtccctgacgtacgtctccgtgtcgcagcctcgtggacttccaccttttcgccgttctatgacagtgacgtcgtcgggtccgccgaggcctccgaaggacgtgggctggaggttggtctcgtaaggttacttaaagtggttaggtaggtaaagttacgtattagttacgactaacgtaccgtccggtagggaacggtccgtactaccgacctntccgtacgagactaacctacgtaccaaacgtaacaacctacgtacgtctacgtacgaactaacgtacgaacacgtactacggagaccggaccggtaaggaccaccggtacctaccgtttacgtttacggtacggtaaaccgaaataaccgtaaccgaaccgtaacgacggttaaccgaggaccggtacggtacgaacccgg

SEQ ID NO: 122684 - DNA, 708 bp, Homo sapiens
  misc_feature: GYAE6OF02F4BSO.52.81.H04.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (350)..(350): a, c, t, g, unknown or other
  misc_feature (350)..(350): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccataggtacgtttgggctgagcctggtcttttctgtgacttatttaaaggnttcagtgtgaggtgnagctgngtgcgaggtccgggggagtgtttaggactacggccggttcgggggtcccttaggagaccttcgtaccgtgtcgcgacgtctcgttaggtacttcgtaccgtttcgctcgtatcgactgtacgtacgtcggttccggtccgaaccggnggtacccgtcgggtaaaccggtaggttcgggaggttacggtggttaccgggtactggacggtttaagttacgtggtggtaagtacgtactagttactacgacgtaggtccgttacgggacgggtacgtccgtaccgttacaccgtacgtactaccgtaacgaacgttaacgaactttacccgaacgaactaccgtagttcttaacggtacctaagacgttaacgaacgtaccgtacgacgttccgaagtaccggtaaccgacggaaccaccggtaccttacgtacgttacgtaacgttaaccgaaacgtaacgtacgacgtaacgtcggttaagaccggacacggggttacaacccgg

SEQ ID NO: 122685 - DNA, 748 bp, Homo sapiens
  misc_feature: GYAE6OF02GC5SB.52.81.H04.1.454.CMB.1.raw
  modified_base (223)..(223): a, c, t, g, unknown or other
  misc_feature (223)..(223): n is a, c, g, or t
  modified_base (334)..(334): a, c, t, g, unknown or other
  misc_feature (334)..(334): n is a, c, g, or t
  modified_base (532)..(532): a, c, t, g, unknown or other
  misc_feature (532)..(532): n is a, c, g, or t
  modified_base (550)..(550): a, c, t, g, unknown or other
  misc_feature (550)..(550): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggtagttggctgagcgtggtctttttcgtgtggtacttaattttaaaaggtgtcagtggtgaggtgcagctggctgacgaggtcgggggngtcgtttacggtacgacggccggtcgggggtccgtggaacgtactccgttcgttgcgacgtacgccttcgtaggtacttaccttaccgttttcgctttcgtatggtaaccnggtagaggtccggtccggggtcccgtccggaggtaaccctcggaaacgggtagggtcggggcgttggggtacggttcgggggttacttacgggtaacggtttaagttaaagtgggggtttaaggtaacgggttaaacgaagtttactaacgttaacggtaacgacggttaaccggtcgggtaacggacgggtcccttntaacccactgtcccgtanacgaagttaacccaaaggttacccaaaaccgtactaaaccgtacgtttacgtaactaccggtactaaacgaaacgtcggaaacttaccgtacgaggacaacggccgaacgaccaacgacccgtttatacgtttacgacggtaaaccaagtaaccaactcaacggacgtaccgacgggtacgaacggtagtaaacccgg

SEQ ID NO: 122686 - DNA, 687 bp, Homo sapiens
  misc_feature: GYAE6OF02GG0T7.52.81.H04.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (630)..(630): a, c, t, g, unknown or other
  misc_feature (630)..(630): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcacatggtagttggctgagctggtcttttctgtggtacttaattttaaaaggtgtaccagtgtgaggtncagntgctgcgagggtcgggggagtcgttaggtacaggccggtcgggggtccctggacggtacctcgtccgtgtcgccgtacgcctcgtggtacttccgtacctttcgcgttctatcgactagtggacgtcggtcggtccgacgagtcctacgagggaacgtggggcgtaggaggttggtcctaggtaagttaattaaggttaggtacggtaaggtaagtaactatttacgtacgaccgtaagtccgtaccggtaggaacgggtcctacttacccacgtacgttcccacgtaaggaacaactaacgtacccaaagtacctacctagttctatacgtacgaaataaactacgaactacgtacgaggtaacaacggacccggtaaagcccgtaaccgaccctttaactacggtttaaccgaagtaaaacgtaaanaaccttaaacacgaacggcggtaaccgtagggaacggtaccggaaccgtaaacccgg

SEQ ID NO: 122687 - DNA, 695 bp, Homo sapiens
  misc_feature: GYAE6OF02I2RG4.52.81.H04.1.454.CMB.1.raw
tcagcgcagtacgacacgaccggtgctcgatttagtagtgtagattcgcggggagctctgagagaggagcccagccctgggatttcaggtgtttcatttggtgatctaggactgaacagagagaactcaccatggtagtttgggctgagcgtcggtacgttttcgtaggtggtcttaagtttaaaggtgtccagtgtgaggtgcagctgctgcgacggtgggggacgcgttgggtaccaggtccggtcgggggtaccctggtaacgctccgtccgtagttcgaccgtcgccgtacgtggtaccgttcgtaccctttcgtcgtctacgttcgactagtcgagtcgtacggttccgcgtacgccgtccgtaggtacggtagggtcgtaggtacggtggttaccgtggtaacgttagtaacgttggtaggtaggtaactaacggggtattacgttaccgagtccgtacgtccgtaacggtcggtaccgtccgtaccgaccgtacgtcctacgacggaacggtaactaaccgttacgtaaaccgactaaccgtacgtcgttacgtcttagacctaagtacctaagtccgtacgtgtaacgacgaccggaaacggaccgtacaccgtacctagttactacggtaacaaccggtactaaccacgtaccgaggttaccgaggaccggtacgtacgaacccgg

SEQ ID NO: 122688 - DNA, 670 bp, Homo sapiens
  misc_feature: GYAE6OF02JQII8.52.81.H04.1.454.CMB.1.raw
  modified_base (176)..(176): a, c, t, g, unknown or other
  misc_feature (176)..(176): n is a, c, g, or t
tcagcgcagtacgacacgaccggtgctcgatttagtagtgtagattcgcggggagctctgagagaggagcccagccctgggattttcaggtgtttcattggtgatcaggactgaacagagagaactcacatggagttggctgagcgtggtcttttctgtggcttaagtttaaaggngtaccagtgtgaggtgcgagctgctgacgaggtcgggggagtcgtaggtacgacggtccggtcgggggtccctagacgtcctccgtcgtgtcgcgacgtctcgtggtacttccgtaccgttccgacgtctatgacctgtacgcgtcgtcggtccgacgcggtcaccgaaggtacgtggtacgtggtacggttcggtacctggtaaggttaattaaggtggttagggtaacgtaagtacgtaacgtacgttaccgacgtaacggtccgtaccggtaggacgtcccgtacgtacaccgcgttaccaccgtagtaaactaccgtaacgtaccaacgaactacgtagttactagtcgtacactaaagtcgaacgtaacgcgtaaggacgaaccggtaacgaccggtaaccgccgttaccctaggtttactcgtaaggtaaacgagtaacacgtaaccgacggtacgaccgtaaggaacccggtagtaacccgaaccgg

SEQ ID NO: 122689 - DNA, 751 bp, Homo sapiens
  misc_feature: GYAE6OF02HXZ3V.52.81.H04.1.454.CMB.1.raw
tcagcgcagtacgacacgaccggtgctcgatttagtagtgtagattcgcggggagctctgagagaggagcccagcccctgggattttcaggttgttttcatttggtgatcaggactgaacagagagaactcaccatggtagtttgggctgagctggtctttttcttgtggcttaattttaaaaggtgtccagtggtgtaggtgcgagtctggtctgcgagggtcggggggaggtcttgggtaaccgacggtccggttcggggggtcccctggacgtacttcctccgtgtcgcgacgtccttctgtacttccgtaccgttcgtcgttctattgaactgtagacgtcgtcgggtccgccgtcggccgtaccgagggaaggtcgggtcgtgggtaggtcggtactacgtaggttaacttaagttacggtagggtaggtaaggttaaactacgttaacgttaccgacgtaacggtaacccgttaccgggttaacgggacgggtacccgttccgtttaccgtacccgttaaacttccgtaccgaacggtaacgaaactaaccgttaaccgtaaaacggaacctaaccgacgtttacgacttcacgtaacaaagttacgaacctagtaccgtggaaccgtacggacccgaacggaacgtacccgaccgttaccgttaacgttacgtaacgtaaacggaaactaacgtaaccgaaccgtacgacgtaaccgtcgggaaacgacggacgtaaccccggg

SEQ ID NO: 122690 - DNA, 711 bp, Homo sapiens
  misc_feature: GYAE6OF02GWAKU.52.81.H04.1.454.CMB.1.raw
  modified_base (229)..(229): a, c, t, g, unknown or other
  misc_feature (229)..(229): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (655)..(655): a, c, t, g, unknown or other
  misc_feature (655)..(655): n is a, c, g, or t
tcagcgcagtacgacacgaccggtgctcgatttagtagtgtagattcgcgggcacgaccggtgctcgatttagtagtgtagattcgcgggggggaggcttggtacagcctgggggtccctgagactctcctgtgcagcctctggattcacctttcgcgtctatgacatgagcgtcgggtcccgccaggcctccaggaagtggggctggagtgggtctcgaggtattaanggtggtggaagtacattaacttacgcagtactccggttagaacgggccgtcttcaccatctacagagaactaattaccgaagaaccacctactagtacgtcgttanccaaanacgtaaccagacctggaaacgaccgaccggaacggacgaacggacccaaccgtttacttacggtacggtaaaccgaaaagtaactaaaccgtacaacgaagactacgggacgaacgggacgaacccgaaacgggccgtaacccggttactttacgttcccggttacgttccggacgggtacccgtacggaacccgtcgttaccgtaccgttaccgtaccgtcaaccggtccctaccgaccgaaccggtccgacgttcccgtaccgtccccgtaccgccgtaccccaccgttccaacgtcctaccgacccggtcnccggggtccgaaccgcggacccgtcccggtccggtcgcgtacccggtagtaaccgg

SEQ ID NO: 122691 - DNA, 623 bp, Homo sapiens
  misc_feature: GYAE6OF02F3WTL.52.81.H04.1.454.CMB.1.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (456)..(456): a, c, t, g, unknown or other
  misc_feature (456)..(456): n is a, c, g, or t
  modified_base (602)..(602): a, c, t, g, unknown or other
  misc_feature (602)..(602): n is a, c, g, or t
tcagcgcagtacgacacgaccggtgctcgatttagtagtgtagattcgcgggcacgaccggtgctcgatttagtagtgtagattcgcggggggagcttggtacagcctgggggtccctgagactctcctgtgcagcctctggacttcacctttcgcgtctatgacatgagctgggtccgcaggctccaggaatggggctggagtcgggtncaggtattaataggtggtaggagtacatattacgcagactccgtgaacgggccgnttcaccatctccagacgacaattaccaagacacactgtatctgacaaatgaacagcctagacgacgccgaaggacgaccgccctaccttatttaccgtagtaacgaaagaactacaacacagctggacgaggacaccgaaacggacgacttacttcttagactacgtgggaccgacggtaccctggtaccnccgtacctcctacaccgtcctacccgtaccgaaccggtcccacgttcccgttcccgttaccccgtacgtacccctacccctccacccgtagaccgaccgtccgtaccggtccgggacctaaccgcggacccgccggtaccgggtcnccggtaccgtcggtaacccgg

SEQ ID NO: 122692 - DNA, 845 bp, Homo sapiens
  misc_feature: GYAE6OF02F55VN.52.81.H04.1.454.CMB.1.raw
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtggtctttttcttgtggtcttaattttaaaaggtgtccagtgtgaggtgcagctgcgtgcgaggttacgggggggaggtctttagggtacaacggtcccggtagggggggtacccctgacgtacctcctccgttgtcggctaacgccgtacgtagggtacttaccgtaaccgttttaccgccgtttaccgtaattacggaacctaataggtaaccggtccggttcggggtaaccccggtacccgaacggggtacccgttaccccggtaaaggtaaaccggtggggggtaaccctaggggtaaacgggttcgggggttacctacgggtaaaacgggtttaatttaaaacggtaggtttgggggtaacggtaaaacggttaaccgtaagtttaacgttaacgtaaccgaacggttaaccgtaccggttaacggaaccgggtaccgtaccgtttaaccaaccgtaacttcccgtaccgaaacgacgtaaacaaccgttaaccgaaacgaaccgtaacaacgtacgtaattcgtactaaaccaaagtaagaaacgacggaccttaaggaaggacgaaccggtaacgaacgaaccgtaaccgtaccgttactttacggaaacgttaaacggaaaacgaaacgtaacctaaccgaacgtacggaaccttaacgggaacggtaacggaaccgtaaacccgg

SEQ ID NO: 122693 - DNA, 801 bp, Homo sapiens
  misc_feature: GYAE6OF02JJL5Z.52.81.H04.1.454.CMB.1.raw
  modified_base (182)..(182): a, c, t, g, unknown or other
  misc_feature (182)..(182): n is a, c, g, or t
tcagcgcagtacgacacgaccggtgctcgatttagtagtgtagattcgcgggcacgaccggtgctcgatttagtagtgtagattcgcggggggagcttggtacagccgtgggggtccctgagactctcctgtgcagcctctggattcaccttttcgcgtactatgacatgagcgtgggtccnccgaggctaccaggtaagtggggctggagtgggtctcgagttattaagacggtggtaggaatacactagtacgacgagtacctccggtgaacggccgcttcgaccagtctccgtagagacaacttccaacgaacactactcgtaatctagacctaaagtacggaacaacgtacgtagaacggacgaccggtacggaaccacgggtaccctaaccgttactttacttacggtaaacgtaaacgaactaaccaccaacgaacgtaccgtaggaaccggtacggaaccggaccgaaacggacccgtaaccgtttaacttacgttttcgaaccttaccgtacggggtaaccggaacccggggtaacccgttacgggttacgtaccccgttaccgttacccgtacctaccgtacccttacccgtaacccggaaccggaaccccgtacgtacccgggttcccgtttaacccccgttccggacccgttaacccccgtaccctaacccgtaccgaccggtacccgtaaccccgttccggtacgggggtccccgtaaccgtaccggaccccgggttacccggttacccgggtaccgttacccgggttaccgttccgggttaaccccgg

SEQ ID NO: 122694 - DNA, 703 bp, Homo sapiens
  misc_feature: GYAE6OF02HARAO.52.81.H04.1.454.CMB.1.raw
  modified_base (266)..(266): a, c, t, g, unknown or other
  misc_feature (266)..(266): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagtttgggctgagctggtctttttctgtggactattttaaaaggtgtccagtgtgaggtgcagctgctgcgaggtcggggggagcgttggtacgaggccgtggggggtccctggagctctccgtgtgacncgtcctcgtggtacttccgtacctttcggcgttactagtacgactatcggtaggtccgttcgggtccgtaccgacggtcctacccggaaggtaagggtccggggtacgtcggggtaggttcggggtacctacgtaaggttaactttaaggtagggtttaggtacgggaaagtttaaccgatttaacgttaaccggcgtaacgtacgtccggtagggaacgggtccctacgttacccgactacgtccctacggaaagtacgtaaacccgtaattaaccgaaacggaacttaacgtaccgtgtaacctacgtacgaaacaagttagaaacctgaccgttagaacgtaccgcggtaaacggaccgaccgcctaccgttagtttaccgagttaaccgaaactaacgtaccagaccaggccggtagacggaggaccgtaacg

SEQ ID NO: 122695 - DNA, 691 bp, Homo sapiens
  misc_feature: GYAE6OF02JF4DA.52.81.H04.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
tcagcgcagtacgacacgaccggtgctcgatttagtagtgtagattcgcggggagctctgagagaggagcccagccctgggattttcaggtgttttcatttggtgatcaggactgaacagagagaactcaccatggagttggctgagctggtcttttcttggtggtcttaatttaaaggtgtcctagtgtgaggtncgngctgctgcgtacgggtcgggggngtcgttggtacgcggccggttcggggtaccnggaactctccgtccgtgtcgcgccgtctcgtgtacttcgtccgtttcgccgttatcgtacgactagtggacgtcggtcggtacccgccgcggacctaccggaggtacggtcgggtcggtaggtcgggtcgtcgtacgtaggttaattaaggtaagggtcgtaaggtaacgttacgaattacgtacgtaccgtagtaccgtacgtacgggacgtccgtccgttacccacgacttcgaccgaaagaccgtaaactacgttaaccgaaacaacctaaccgtattaccgttataccgtactaacgtaagtaaccgtacaccgtaccacggaagaaccggaccgacgttaaacccggcgtaaccttaccgttaactacgtaacccggaaaagtaaactcgaacaccgtagacgtcggtacggaacgtacgggaacctaacggg

SEQ ID NO: 122696 - DNA, 761 bp, Homo sapiens
  misc_feature: GYAE6OF02JMMN2.52.81.H04.1.454.CMB.1.raw
  modified_base (233)..(233): a, c, t, g, unknown or other
  misc_feature (233)..(233): n is a, c, g, or t
tcagcgcagtacgacacgaccggtgctcgatttagtagtgtagattcgcgggcacgaccggtgctcgatttagtagtgtagattcgcggggggaggcttggtacagcctgggggtccctgagactctcctgtgcagcctctggattcacctttcgcgttcatgacagtgagtctgggtccgccaggcctccgaggaagttggggactggagtgggtctacgtaggtattaaanaggtggtaggaaagttacattaagttaccgcagtacgtaccggttggaaaacgggtcccgaccgtttacaaccctaatccgtaccctaaacggaacgtaacctaaagtttaccccgaaaaggtaaaccaacgtaaaccttagggttaaactccgttaacggacctaaaagttacggaaaacacggtacccgttagaaggagccggtaacggaaccgacggacccacgttactttacgagttaaaccggaaaagtaacttaaccgaacgaactacgcttagggaaacgacgggtaagcccgaaacgtccgtaactacttacgtttgaactagtcgggaccgaggtaacccgtggttacaccgttcaccgtcacgtcctacaaccgacggaccgacgttccggtacccgttccccgtacggtaccgaaccttccgtaaccacggtacgacccgtccgttaccgtacgggggacctaccgacggtacccggtaccccggtacgggtacctttacggccgttacggtaaccg

SEQ ID NO: 122697 - DNA, 676 bp, Homo sapiens
  misc_feature: GYAE6OF02HEFJD.52.81.H04.1.454.CMB.1.raw
  modified_base (137)..(137): a, c, t, g, unknown or other
  misc_feature (137)..(137): n is a, c, g, or t
  modified_base (239)..(239): a, c, t, g, unknown or other
  misc_feature (239)..(239): n is a, c, g, or t
  modified_base (299)..(299): a, c, t, g, unknown or other
  misc_feature (299)..(299): n is a, c, g, or t
  modified_base (472)..(472): a, c, t, g, unknown or other
  misc_feature (472)..(472): n is a, c, g, or t
tcagcgcagtacgacacgaccggtgctcgatttagtagtgtagattcgcggggagctctgcttcagctgtgagcgcagaaggcaggactcgggacaatcttcatcatgacctgctccctctcctcctcaccctttcncattcactgcacagggtcctgggcccagtctgtgttgacgcagcccgcctcagtgtctgcggccccaggacagaaggtcaccatctcctgctcgtgggaacnctagcctccgaactagtttcggactaattaacgttttgtacggttccctagggttaaccngaccgaaaccttccccgaggccaaccaccggacccccctaaaacttcccttactaagttttacaggtaacaacgttgaactaacggacccgtaccctacgtacggggtactacccgtacgaccgttaacttcctacgtacggccttacccgaagtccgttcggactacgtacncgtacccgaccgtcggctacgacgtaccggactaccgacgtacggtacggggaacgacgggactaacggttaactaccgtcgggtaaccggaacgtaggtaacgggtacttacggacctacgtccgtagtaccggtagccgtacgtcggtagggtcggtcgggacgggtaaccggacgtaacggtccgtacggtaccctacggg

SEQ ID NO: 122698 - DNA, 789 bp, Homo sapiens
  misc_feature: GYAE6OF02IE0FS.52.81.H04.1.454.CMB.1.raw
  modified_base (144)..(144): a, c, t, g, unknown or other
  misc_feature (144)..(144): n is a, c, g, or t
  modified_base (207)..(207): a, c, t, g, unknown or other
  misc_feature (207)..(207): n is a, c, g, or t
  modified_base (644)..(644): a, c, t, g, unknown or other
  misc_feature (644)..(644): n is a, c, g, or t
  modified_base (679)..(679): a, c, t, g, unknown or other
  misc_feature (679)..(679): n is a, c, g, or t
tcagcgcagtacgacacgaccggtgctcgatttagtagtgtagattcgcgggagctctgagagaggagcccagccctgggagttttcaggtgttttcatttgggtgatcaggactgaacagagagactcacatggagtttgggntcgagcgtcgttcttttctaggtcggacttaattttaaaaggtgtacagtggtacggtggttnacgaggcttgcgtcacggacgggttcggggggacgttcgttggtaactacggtcggtcggggttaccgtagacgtacttctcgttaggtgacttcgcctgttacgtcttcgttcgtttcgaccgttagtgttaacacgtagtacgtggttccggtcgggtcccgaccggtaaccggttcgtaaacccggaagggttaacccgggtcggggtaaacgttacggggggtacggtttacccgggttggtaacccggttaaagggtaaacctttttaaggggaccgggtaaggggttaaccggtataaacgtacgttaacggttacgaacgtacgttaccgttacggacgggttcccgtacgtcctaacccgttacacgtaccgtaacgaagtaaccgaacttaacgtaaaccgaagaaaccgacggtttacgtattaacnccgtagaaccaaggttaccacggtcacggtacganaccggaccgttaaacgcctaacgtaccttactacggttacctaacgtaaaccggaaacgttaacaaccgaagaccctaggaacccgtggaacggtaccggacgtaaccgg

SEQ ID NO: 122699 - DNA, 215 bp, Homo sapiens
  misc_feature: GYAE6OF01BWC09.25.2.A02.1.454.CMB.1.raw
  modified_base (213)..(215): a, c, t, g, unknown or other
  misc_feature (213)..(215): n is a, c, g, or t
tcagactgtacagtcacgaccggtgctcgatttagactcatctacaggggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnn

SEQ ID NO: 122700 - DNA, 216 bp, Homo sapiens
  misc_feature: GYAE6OF01D1K5L.25.2.A02.1.454.CMB.1.raw
  modified_base (213)..(216): a, c, t, g, unknown or other
  misc_feature (213)..(216): n is a, c, g, or t
tcagactgtacagtcacgaccggtgctcgatttagactcatctacaggggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnn

SEQ ID NO: 122701 - DNA, 216 bp, Homo sapiens
  misc_feature: GYAE6OF01A8VOU.25.2.A02.1.454.CMB.1.raw
  modified_base (212)..(216): a, c, t, g, unknown or other
  misc_feature (212)..(216): n is a, c, g, or t
tcagactgtacagtcacgaccggtgctcgatttagactcatctacagggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnnn

SEQ ID NO: 122702 - DNA, 276 bp, Homo sapiens
  misc_feature: GYAE6OF01DA1S0.25.2.A02.1.454.CMB.1.raw
  modified_base (275)..(276): a, c, t, g, unknown or other
  misc_feature (275)..(276): n is a, c, g, or t
tcagactgtacagtcacgaccggtgctcgatttagactcatctacagggggaagaccgatggaccttccgccattgtgatttctactactactacgttatggacgtctggggccaagggaccacggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 122703 - DNA, 214 bp, Homo sapiens
  misc_feature: GYAE6OF01E46NC.25.2.A02.1.454.CMB.1.raw
  modified_base (213)..(214): a, c, t, g, unknown or other
  misc_feature (213)..(214): n is a, c, g, or t
tcagactgtacagtcacgaccggtgctcgatttagactcatctacaggggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 122704 - DNA, 214 bp, Homo sapiens; identical to SEQ ID NO: 122703
  misc_feature: GYAE6OF01BUITQ.25.2.A02.1.454.CMB.1.raw
  modified_base (213)..(214): a, c, t, g, unknown or other
  misc_feature (213)..(214): n is a, c, g, or t

SEQ ID NO: 122705 - DNA, 344 bp, Homo sapiens
  misc_feature: GYAE6OF01ELL4Y.25.2.A02.1.454.CMB.1.raw
  modified_base (339)..(344): a, c, t, g, unknown or other
  misc_feature (339)..(344): n is a, c, g, or t
tcagactgtacagtcacgaccggtgctcgatttagactcatctacagggacaattccaagagaaccctctatctgcaaatgaacaacttgagagtcgaggatacggccgtttattactgtgcgacctcaggagtggctggaaaaagtcgtagtctcattcccgtcgacctctggggccagggcaccctggtcaccgtctcctcagcttccaccaagggcccatcggtcttcccctgacgccctgctccaggagcacctctgggggcacagcggccctgggctgcctggtcaaggactacttccactgtacagtctgagcgggctggcaaggcgcatagnnnnnn

SEQ ID NO: 122706 - DNA, 358 bp, Homo sapiens
  misc_feature: GYAE6OF01BFSN2.25.2.A02.1.454.CMB.1.raw
  modified_base (348)..(358): a, c, t, g, unknown or other
  misc_feature (348)..(358): n is a, c, g, or t
tcagactgtacagtcacgaccggtgctcgatttagactcatctacagggacaattccaagagaaccctctatctgcaaatgaacaacttgagagtcgaggatacggccgtttattactgtgcgacctcaggagtggctggaaaaagtcgtagtctcattcccgtcgacctctggggccagggcaccctggtcaccgtctcctcagcttccaccaaggcccatcggtcttcccctggccgccctgcctccaggacgccacctcgtgggggcacgagccggccctggggctgcctggtcaaggactacttccactgtacagtctgacgcgggctggcaaggcgcagtagnnnnnnnnnnn

SEQ ID NO: 122707 - DNA, 218 bp, Homo sapiens
  misc_feature: GYAE6OF01C8ATV.25.2.A02.1.454.CMB.1.raw
  modified_base (214)..(218): a, c, t, g, unknown or other
  misc_feature (214)..(218): n is a, c, g, or t
tcagactgtacagtcacgaccggtgctcgatttagactcatctacaggggccagggttccctggtcaccgtctcctcagcctccaccaagggcccatcggtcttccccctggcgccctgctccaggagcacctccgagagcacagcggccctgggctgcctggtcaaggactacttccactgtacagtctgagcgggctggcaaggcgcatagnnnnn

SEQ ID NO: 122708 - DNA, 344 bp, Homo sapiens
  misc_feature: GYAE6OF01DD3KK.25.2.A02.1.454.CMB.1.raw
  modified_base (337)..(344): a, c, t, g, unknown or other
  misc_feature (337)..(344): n is a, c, g, or t
tcagactgtacagtcacgaccggtgctcgatttagactcatctacagggacaattccaagagaaccctctatctgcaaatgaacaacttgagagtcgaggatacggccgtttattactgtgcgacctcaggagtggctggaaaagtcgtagtctcattcccgtcgacctctggggccagggcaccctggtcaccgtctcctcagcttccaccaagggcccatcggtctcccctggcgccctgctccaggagcacctctgggggcacagcggccctgggctgcctggtcaaggactacttccactgtacagtctgagcgggctggcaaggcgcatagnnnnnnnn

SEQ ID NO: 122709 - DNA, 467 bp, Homo sapiens
  misc_feature: GYAE6OF01B7SE4.25.2.A02.1.454.CMB.1.raw
  modified_base (423)..(439): a, c, t, g, unknown or other
  misc_feature (423)..(439): n is a, c, g, or t
  modified_base (446)..(467): a, c, t, g, unknown or other
  misc_feature (446)..(467): n is a, c, g, or t
tcagactgtacagtcacgaccggtgctcgatttagactcatctacagggacaattccaagagaaccctctatctgcaaatgaacaacttgagagtcgaggatacggccgtttattactgtgcgacctcaggagtggctggaaaaagtcgtagtctcattcccgtcgacctcgtggggccagggcacccgtggtcaccgtctcctcagccttccaccgaacgggccccagtccggtccttcccccgtggcccgccccttgcctccgagggacgccgacccgtcggtggggggaccacgacggccggcccgtcgggccgtcggtccgtacggtacgaacggtaccggggttaccttaccgtacgtacgtacgtacgtcgtcggacgggccgggcggtacggaccggaacgggacgacgtagtagnnnnnnnnnnnnnnnnnccccccnnnnnnnnnnnnnnnnnnnnnn

SEQ ID NO: 122710 - DNA, 511 bp, Homo sapiens
  misc_feature: GYAE6OF01CE3FB.25.2.A02.1.454.CMB.1.raw
  modified_base (444)..(445): a, c, t, g, unknown or other
  misc_feature (444)..(445): n is a, c, g, or t
  modified_base (448)..(448): a, c, t, g, unknown or other
  misc_feature (448)..(448): n is a, c, g, or t
  modified_base (452)..(457): a, c, t, g, unknown or other
  misc_feature (452)..(457): n is a, c, g, or t
  modified_base (459)..(461): a, c, t, g, unknown or other
  misc_feature (459)..(461): n is a, c, g, or t
  modified_base (463)..(511): a, c, t, g, unknown or other
  misc_feature (463)..(511): n is a, c, g, or t
tcagactgtacagtcacgaccggtgctcgatttagactcatctacagggacaattccaagagaacccctctatctgcaaatgaacaacttgagagtcgaggatacggccgtttattactgtgcgacctcaggagtggctaggaaaaagtcgtagtctcattcccgtcgaccctcgtggggccagggcaccccgtggtccacccgtctcctcacgcttccaccaagggcccagtccggtccttccccctgggcccgcccctcgcctcccgagggacgcctaccctcggtcggggggccacgacggccgggccccgtggggcctggtcccgttggggtccaaacgggaccttacccgtttcccctaaaccgtcgttaaccgtaacgtttccgtgggaacgggccggggtaccgttggggaccaaacggggccaccgtaagtagganncgntcgnnnnnngnnncnnnnnnnnnnnnnnnnnnnnnnnnnnnnnnnnnnnnnnnnnnnnnnnnn

SEQ ID NO: 122711 - DNA, 339 bp, Homo sapiens
  misc_feature: GYAE6OF02G3UNV.25.2.A02.1.454.CMB.1.raw
  modified_base (335)..(339): a, c, t, g, unknown or other
  misc_feature (335)..(339): n is a, c, g, or t
tcagactgtacagtcacgaccggtgctcgatttagactcatctacagggacaattccaagagaaccctctatctgcaaatgaacaacttgagagtcgaggatacggccgttattactgtgcgacctcaggagtggctggaaaagtcgtagtctcattcccgtcgacctctggggccagggcaccctggtcaccgtctcctcagcttccaccaagggcccatcggtcttcccctggcgccctgctccaggagcacctctggggcacagcggccctgggctgcctggtcaaggactacttccactgtacagtctgagcggctggcaaggcgcatagnnnnn

SEQ ID NO: 122712 - DNA, 213 bp, Homo sapiens
  misc_feature: GYAE6OF02GBZH9.25.2.A02.1.454.CMB.1.raw
  modified_base (212)..(213): a, c, t, g, unknown or other
  misc_feature (212)..(213): n is a, c, g, or t
tcagactgtacagtcacgaccggtgctcgatttagactcatctacagggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnn

SEQ ID NO: 122713 - DNA, 390 bp, Homo sapiens
  misc_feature: GYAE6OF02F29JU.25.2.A02.1.454.CMB.1.raw
  modified_base (264)..(264): a, c, t, g, unknown or other
  misc_feature (264)..(264): n is a, c, g, or t
  modified_base (352)..(390): a, c, t, g, unknown or other
  misc_feature (352)..(390): n is a, c, g, or t
tcagactgtacagtcacgaccggtgctcgatttagactcatctacaggggtacgaattcccaagagaaccctctaatctgcaaatgaacaactttgagagtcgaggatacggccgtttattactgtgcgacctcaggagtggctggaaaaagtcgtagtctcattcccgtcgacctctggggccagggcaccctggtcacccgtctcctcagcttccaccaagggcccatccggtcttccccctgacgccctgctccagggacncgacctcgtggggccacgaggcggccctgggctgcctggtcaaggctacttccactgtacagtctgagcggctggcaaggcgcatagnnnnnnnnnnnnnnnnnnnnnnnnnnnnnnnnnnnnnnn

SEQ ID NO: 122714 - DNA, 247 bp, Homo sapiens
  misc_feature: GYAE6OF02GR35N.25.2.A02.1.454.CMB.1.raw
  modified_base (216)..(247): a, c, t, g, unknown or other
  misc_feature (216)..(247): n is a, c, g, or t
tcagactgtacagtcacgaccggtgctcgatttagactcatctacgaggggaccgagggttccctggtcaccgtctcctcagcctccaccaacgggcccatcggtccttcccctggcgccctgcgtccaggagcacctccgagagcacagcggcctgggctgcctggtcaaggactacttccactgtacagtctgagcggctggcaggcgcatagnnnnnnnnnnnnnnnnnnnnnnnnnnnnnnnn

SEQ ID NO: 122715 - DNA, 279 bp, Homo sapiens
  misc_feature: GYAE6OF02IFJUU.25.2.A02.1.454.CMB.1.raw
  modified_base (276)..(279): a, c, t, g, unknown or other
  misc_feature (276)..(279): n is a, c, g, or t
tcagactgtacagtcacgaccggtgctcgatttagactcatctacagggggaagaccgatggaccttccgccattgtgatttctactactactacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccactgtacagtctgagcgggctggcaaggcgcatagnnnn

SEQ ID NO: 122716 - DNA, 224 bp, Homo sapiens
  misc_feature: GYAE6OF02I7951.25.2.A02.1.454.CMB.1.raw
  modified_base (214)..(224): a, c, t, g, unknown or other
  misc_feature (214)..(224): n is a, c, g, or t
tcagactgtacagtcacgaccggtgctcgatttagactcatctacaggggccaggggttccctggtcaccgtctcctcagcctccaccaagggcccatcggtcttcccctggcgccctgctccaggagcacctccgagagcacagcggctctgggctgcctggtcaaggactacttccactgtacagtctgagcgggctggcaaggcgcatagnnnnnnnnnnn

SEQ ID NO: 122717 - DNA, 277 bp, Homo sapiens
  misc_feature: GYAE6OF02G7ZI8.25.2.A02.1.454.CMB.1.raw
  modified_base (276)..(277): a, c, t, g, unknown or other
  misc_feature (276)..(277): n is a, c, g, or t
tcagactgtacagtcacgaccggtgctcgatttagactcatctacagggggaagaccgatggaccttccgccattgtgatttctactactactacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccactgtacagtctgagcgggctggcaaggcgcatagnn

SEQ ID NO: 122718 - DNA, 344 bp, Homo sapiens
  misc_feature: GYAE6OF02ISSLE.25.2.A02.1.454.CMB.1.raw
  modified_base (338)..(344): a, c, t, g, unknown or other
  misc_feature (338)..(344): n is a, c, g, or t
tcagactgtacagtcacgaccggtgctcgatttagactcatctacagggacaattccaagagaaccctctatctgcaaatgaacaacttgagagtcgaggatacggccgtttattactgtgcgacctcaggagtggctggaaaaagtcgtagtctcattcccgtcgacctctggggccagggcaccctggtcaccgtctcctcagcttccaccaagggcccatcggtcttcccctgacgccctgctccaggagcacctctggggcacagcggccctgggctgcctggtcaaggactacttccactgtacagtctgagcgggctggcaaggcgcatagnnnnnnn

SEQ ID NO: 122719 - DNA, 221 bp, Homo sapiens
  misc_feature: GYAE6OF02GYOWA.25.2.A02.1.454.CMB.1.raw
  modified_base (184)..(184): a, c, t, g, unknown or other
  misc_feature (184)..(184): n is a, c, g, or t
  modified_base (212)..(221): a, c, t, g, unknown or other
  misc_feature (212)..(221): n is a, c, g, or t
tcagactgtacagtcacgaccggtgctcgatttagactcatctacaggggccagggttccctggtcaccgtctcctcagcctccaccaagggcccatcggtcttcccctggcgccctgctccaggagcacctccgagagcacagcggccctgggctgcctggtcaaggctacttccactgtacngtctgagcgggctggcaaggcgcatagnnnnnnnnnn

SEQ ID NO: 122720 - DNA, 278 bp, Homo sapiens
  misc_feature: GYAE6OF02G9IM7.25.2.A02.1.454.CMB.1.raw
  modified_base (276)..(278): a, c, t, g, unknown or other
  misc_feature (276)..(278): n is a, c, g, or t
tcagactgtacagtcacgaccggtgctcgatttagactcatctacagggggaagaccgatggaccttccgccattgtgatttctactactactacgttatggacgtctggggccaagggaccacggtcaccgtctcctcagcctccaccaagggcccatcggtcttccccctggcgccctgctccaggagcacctccgagagcacagcggccctgggctgcctggtcaaggactacttccactgtacagtctgagcgggctggcaaggcgcatagnnn

SEQ ID NO: 122721 - DNA, 238 bp, Homo sapiens
  misc_feature: GYAE6OF02HN9P6.25.2.A02.1.454.CMB.1.raw
  modified_base (212)..(238): a, c, t, g, unknown or other
  misc_feature (212)..(238): n is a, c, g, or t
tcagactgtacagtcacgaccggtgctcgatttagactcatctacaggggccagggttccctggtcaccgtctcctcagcctccaccaagggcccatcggtcttcccctggcgccctgctccaggagcacctccgagagcacagcggccctgggctgcctggtcaaggctacttccactgtacagtctgagcgggctggcaaggcgcatagnnnnnnnnnnnnnnnnnnnnnnnnnnn

SEQ ID NO: 122722 - DNA, 502 bp, Homo sapiens
  misc_feature: GYAE6OF01AG7O8.19.82.H05.1.454.CMB.1.raw
  modified_base (410)..(410): a, c, t, g, unknown or other
  misc_feature (410)..(410): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttccccttccaaattttgatatcaattgggtgcgacaggccacgtggacaagggctcgagtggatgggatggatgaacggtaaagtggaaacacaggctatgcggagagattccagggcagagtcaccatgacgtggggacccctgtgtcggcacagcctanagtggagctgagaagtctgaccaccgtgaggaccacggcctctattacgtgtgcgagcgccgagatatgagtgacggagagtggtacttcgg

SEQ ID NO: 122723 - DNA, 506 bp, Homo sapiens
  misc_feature: GYAE6OF01E069Y.19.82.H05.1.454.CMB.1.raw
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttccccttccaaaattttgatatcaattgggtgcgacaggccactggacaagggctcgagtggatgggatggatgaacggtaaaagtggaaaacacgaggctatgcggagagattccgagggcagagtcaccagtgaccgtcggggaccccctctggtcggcacgagccctaacagtggagctgagaagtctgacacctgacgacacggcgtntattactgtgcgagcgccgcgaatngaagtgcggagntggattcg

SEQ ID NO: 122724 - DNA, 775 bp, Homo sapiens
  misc_feature: GYAE6OF01AH4R5.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctggaggtgaaggacggccgtggggcctcgaggtggaacggtcctccgtgacaagtaccttcgttcgggtttaccccttactaaaattttgaattactactaagttggggtcgaccgacgacggccctacgtacggacgaagggtctacggaggtggagtgggtagtagggtaagtaagggaaaacggtaaaaggtaggaaaacacgtaagggtacgtaggtacggacgggtaaggtaaggtaacgtttacccggaaggggtacgaaggacgtaccgaaccgtagtacggtacccggtaccgggggtacccccttcgggtaccggtaccggacctaaccggtacggtacccgttaacgacggttacgggacgtaccggtaaggaacggtaacggttccgtaacggaacccgtaccggtacgggaaccgggtaaccgtacccgggtacccgttaccgttaacgtttaccggtggtaccggtaccggaacgggtccgggtacccgggaaggtaacgttacgggtaaggtaacgggtacgggtacgggtaaaggttacggttacgggttaaccgtttccggg

SEQ ID NO: 122725 - DNA, 672 bp, Homo sapiens
  misc_feature: GYAE6OF01C4QXX.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctgaggtgaagaggccgtggggcctcgagtgaaggtctctgcagcttcgtcggttccctactaaatttgatatctaagttgggtgcgacgacggccacgtggacaagggctcgagtggagtgggatggagtaggaacggtaaaagtggaaacacgaggactagtggacggagagacgttacgagggtacaggtacgtacaccgtagtacggtaccggtaccggggtaacccccgtcgtacggttccgggaccaaccgtaacgggaccccttaacggacggttacgggacggtacgttacggtaacggaacggttcgttaacggaaccgtacccggttaagggaaccgggaacccgtaccgggtacccgttacgttaacgttacgtggtacggacggtacggaccggtaccggaacggtaacttaacggtaggaagggtacggacggggtagtacggttgggttaccgtttaccggg

SEQ ID NO: 122726 - DNA, 732 bp, Homo sapiens
  misc_feature: GYAE6OF01DIHYA.19.82.H05.1.454.CMB.1.raw
  modified_base (173)..(173): a, c, t, g, unknown or other
  misc_feature (173)..(173): n is a, c, g, or t
  modified_base (197)..(197): a, c, t, g, unknown or other
  misc_feature (197)..(197): n is a, c, g, or t
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (715)..(715): a, c, t, g, unknown or other
  misc_feature (715)..(715): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccaccctcgngtcactcgtgcgctgtggcggcgnggtaggtaagaaggcggtcggtccgggtctacgtaggtaggtacgtcctcgngacgtacgtcttcggttcccggtttacccctaacttaagtttntattacgtaacgttaggttgggacgaccggtaccggacggtaccgtacggtacgggaacgggaacggtccgtaagggtgggtaggtagggtgggtaaggtaaggtaacggtaaaacggggtaaaaacgggtaaaggtaaaccggaacgaacggtacgttacgtaaggtacgggaacgggtaagaccgttaaccgtcgggacggagaaggtacctaccgaacgtacgggtaaccggtcccggggttaaccccggtccttacggtccgggtcccgaccgtaaacgcccgttaaccagtcggaggtacgtacgtaagaacggtacttggaaccacgttacgagggtaaccgcggtaccggttaccttataccgtacgtggacgacggtaacggccgacggataaagtgtaggaggtcggaacggtnacgggttgtttcgtccg

SEQ ID NO: 122727 - DNA, 696 bp, Homo sapiens
  misc_feature: GYAE6OF01B18Y9.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtcgcccactcccaggtgctacgtggtgcagtcgtggggctggagggtgaagcgggccgtggggcctcgagtggaaggtctccgtgacaagtacttcgttcgggtttccccttacgtaaaattttcgattatcgtaagttgggtcgaccgacgacggtcctacgtaggaacgacgggtctacggaggtggagtgggtagtaggtaagtaggtaaaacggttaaaaggtacggaaacaacggaggtactaggtacgggacggaagtacgacgttaccgggaacgggacgtaaggacttaccaaccggtacgtacgggtaccgggtaccggggtacccccttacggtcggtaccgggacgaaccggaccggtacccgttaacgagggtacggtacgcgttacgaacggtaacgtccgaacgtaaccgtaccggaggtaccggaaccgtacccgggtcttacgtacgttacgtggtcggacggaacgcggacccgaggtactaggtagacggtcgggacgtagtgttccggtgttaccgg

SEQ ID NO: 122728 - DNA, 733 bp, Homo sapiens
  misc_feature: GYAE6OF01C73J6.19.82.H05.1.454.CMB.1.raw
  modified_base (193)..(193): a, c, t, g, unknown or other
  misc_feature (193)..(193): n is a, c, g, or t
  modified_base (709)..(709): a, c, t, g, unknown or other
  misc_feature (709)..(709): n is a, c, g, or t
  modified_base (717)..(717): a, c, t, g, unknown or other
  misc_feature (717)..(717): n is a, c, g, or t
tcagtactctcgtgcacgaccggtgctcgatttagtcgagctctctcgcgggggcatcactcaacaaccacatctgtcctctagagaaaaccctgtgagcacagctccctcaccatggactgggccgtggaggactccctccttcgttggtggcagcagctacaagtcgcccactccgaggtgctacgtggtncgtagtcggtgggctggaggtagaaggcggccggtcggggccctgaggtagtaacggtcctacccgtgacgtaacggttactttccggttcccgggttttacccccttaactaaaaagttttttcgaacttactaccgttaagttggggtacaccgtacgaccggtacctaacggtacgggaacgaacgggtctacgggaggttaggacgtagggagtaggaagtaacggaaaacggttaaaagcgaaaacgacgacggtaatacggaggaacggaagaacgttacggtacggacgggagaacggtaagaccaacgtacgtaaccggtaccgggtaccccgggtaaccccgtcgtacgggtacccggaaccgaaaccgtccgtaaccgtaacgtacggtacggagtacgtagaacgtacgtacgtacgaccgacgacgggtacggaccgaccgttaccgtacgtaacgttccggtagccggtacggacgacgtacgtaacagtaggaagttacggnggtaacgngttacgtgttgtaccg

SEQ ID NO: 122729 - DNA, 566 bp, Homo sapiens
  misc_feature: GYAE6OF01EKUYS.19.82.H05.1.454.CMB.1.raw
  modified_base (300)..(300): a, c, t, g, unknown or other
  misc_feature (300)..(300): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactggcctggaggatcctcctcttggtggcagcagctacaagtgcccactcccaggtgctactggtgcagtcgtggggctgaggtgaaggaggccgtggggcctcgagtgaaggtcctccgtgacaagtactttcgtcgggttcccccttactaaaattttgatatactaattgggtgcgagnggccacgtggacgaagggctcggagtggatgggatggatagaaacggtaaagtaggaaacacgaggactagtggacggagagactccgagggcaagagtcacgagtcgacgtcgggcccctgtgtcgacacgagcctagagtggagtcgtagagagtcgtagaccacgtagacggaccacggtcctactagtcgtaggtcgacgaggaccgaccggtagaagtacgtaggtaaggtcggaacgggagtaggttcggttcgttacgg

SEQ ID NO: 122730 - DNA, 610 bp, Homo sapiens
  misc_feature: GYAE6OF01B5OBQ.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctggaggtgaaggacggccgtggggcctcgagtggaaggtcctcctgacaagtcttcgtcgggttccccttactaaaattttgatatctaagttgggtgcgacgaggccacgtgggacgaagggctacggaggtggagtgggatggagtaggaaacgggtaaaagtacgggaaacagaggtactagtggacggagagtacgttaccggagggacaggacgtaccaccgtagtggaccgtccggggacccctcgtcggtccggcacgaccgcctacgagtcggagtcgtagaacgtacgttcgacgacctaccggaggaaccggaccgaccggtccgttacttagttacgtgcggacgtacggacgtccggacgtagtagtacggtagtcggacggtagtggtggttcgttcggg

SEQ ID NO: 122731 - DNA, 860 bp, Homo sapiens
  misc_feature: GYAE6OF01DIZYY.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggacgtgggcctggaggactcctccgttcgttggtggcagcacgctacaagtcgcccactcccgaggtgcttacgtggtgccgtaggtcgtcggggacttgggaagggtaggaaacggcgggtcccggttcgggggcccttacggaggttacggtaacggttcctccgtaggactaaacggtaccgttttccgttaccgggtttacccccttaaccgttaaaattttcggaacttacgtacgttaaggttcggggtacgacggtacgacggaccgtacggtaacgggacggtaacggggtctacggaggtaggacggttgggagtagggtaacgtaacggtaaaacgggtaaaaggtacggaaaacgtacggtaagtacgtaagtacgggtaacggtaaggtaacggtacggttaccgggagggaacggaagtaaccgtaccgaacgtaggtccgggtaaccgggtacccgggtaccccttgggtaccggttaccgaccgtaacgaccggtacccgtagtacggacgggtactcgtaaggacgttaaacggttcggaacgttaacccggacggttacgggaaccggaccggttacccgggttaccgttacgtttaaccggttaaccggtcggtacgggaaccggtaacgggtacccaacggggttaacctaaaaggttagggtaccgggtaaagggtcccggaagggttaaggttacgggttaacgggtttcggtttaccccggg

SEQ ID NO: 122732 - DNA, 663 bp, Homo sapiens
  misc_feature: GYAE6OF01AF318.19.82.H05.1.454.CMB.1.raw
  modified_base (507)..(507): a, c, t, g, unknown or other
  misc_feature (507)..(507): n is a, c, g, or t
  modified_base (566)..(566): a, c, t, g, unknown or other
  misc_feature (566)..(566): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtcgcccactcccgaggtcgctacgtggtgcagtcgtgggctgaggtgaagacggccgtgggcctcgaggtgacggtctcgtgcaagcttcgtcggttccctactaaatttgatatactaagttggtgcgacgacggcctacgtggacgaaggtctacggtaggtggtagtgggagtggaagtaggaaaacggtaaaggacggaaactacgaggtctagcggaggaagtagtacgttaccggaggacgagtacgtccaacgtgttacggaccggtcggggtaccccctttggtaccggtaccggactaccggacgttccgtaacgaggtacggacgtgtaacgggtanaacgttcgaacgtaaccgacggtacggacgacggtaccgttaccgtactaacggttcgngggtaccggacggaacgggtacccgacggttaaggtaacggttataacgggacggttcgggacgggttaatacgggtttacggttaccggttcccgg

SEQ ID NO: 122733 - DNA, 807 bp, Homo sapiens
  misc_feature: GYAE6OF01CE9YW.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtcgcccactcccgaggtgctacgtggtgcgagtcgtggggctggaggtagaaggacggccgtggggcctacgaggtacgaacggtcctccgtggactaacgtacgtttcgttaccgggttacccccttaacgttaaaattttgaacttactacgtaaaggtttcggggacgtaccggaaccgtacgggacccgtacggtacgggaaccggtaaacggggccgtccgggtaagggttcgggaggtaggggtaagtgggtaagtaacggggtaaaaaccgggtaaaaaggtaacggaaacgtaacggaggtacgttaggtacggtaggaagtacgtacgttacggagggaacgacgtacgtaccaacgtacgtacggtaccggtccgggtacccctgtcggtacggacctacgaccgtacctacgtacgtacgggacgtacgtaagggtaacggtaacgtagtacccgtaacccgtaccggtacggggaacggtaccccggtacccggttaccgttaaccgttaccggtttaccggtacggaccgggtaaccggtaggtacccgggtaccccgtaaggttaaacgttaggtaacgggtaaggtaccggtaagggggttactaacgggtttccggttacgggttccccgg

SEQ ID NO: 122734 - DNA, 665 bp, Homo sapiens
  misc_feature: GYAE6OF01CDW14.19.82.H05.1.454.CMB.1.raw
  modified_base (515)..(515): a, c, t, g, unknown or other
  misc_feature (515)..(515): n is a, c, g, or t
  modified_base (532)..(532): a, c, t, g, unknown or other
  misc_feature (532)..(532): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcgttggtgcagcagctacaagtcgcccactcccaggtgctacgtggtgcagtcgtgggctggaggtgaagaggcgtgggcctcgagtaggaacggtctccgtgacgaacgtacgtttcgttccgggtttaccccctttaccgttaaaaatttttgtaacttaagtacttaaggttcggggtgtaccgtacggacggaccgacggtacgggaacgaacggggtctcggaggttagggacgttgggagtaggaacgtaaggaaacgggtaaaaggtaacggaacgacgaaggtactaagtgggacggaggacgtacgtccgaagggcgaagacgtacacgacgtacggacggtccgggacccctgtcggtcgacgacncgacctacgagtgacgntcggaatacgtcgtagaccacggtagacgaccgacgttccgtgtaacgttcgtgtacggtcggacggtcggtaccggtaacgtagttacgaggttaaggtacggaggtaggtacttcgggttagtttacccgg

SEQ ID NO: 122735 - DNA, 804 bp, Homo sapiens
  misc_feature: GYAE6OF01AL7CV.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactggggcctgggaggactccctccttcgttgggtggcagcagctaacaagtcgcccacctcccgaggtgcctacgtgggtgcgtagtcggtggggtcctaggtagggtagaacgggacggtcccggttcgggggcccttacggtaggtacggtaaccggttccgtccgtacggacgtaaacgttccgtttacccggtttcccgggtttaaccccctttaaccttaaaagtttttcggtaactttaacttaccgttaaggtttcgggtacggaccggaaccgtaccggacccgtacggtaacggaaccgtaaggggtccgtacgggtagggtaggacggttaggggaagtagggtaacgtaagggtaaaaccgggttaaaaggtaaccggtaaaacgacggaacggttcgtaacggtacgggacgggaaggtaccgttacgtacggagggacgtacgacgtccacgtacgtcggaccggtccggtaccctcgtccggtacgaccacgtcggtaccctaaggtcgaggtacggtactaggaacggtaacgtccgaacgtaccaccggaggaccggaccgtacgtccgttacgtaacgttcgtaggtcggaccggagtaccggacgggtaactaaggtaagtagggaggtacgggtacggtaaggtacggttaggtttcccggttacgg

SEQ ID NO: 122736 - DNA, 703 bp, Homo sapiens
  misc_feature: GYAE6OF01A74RO.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtcgcccactcccaggtcgctactggtgcagtcgtggggctgaggtgaagaggccgtgggcctcgagtggaacgtctcctgacaagtacttcgttcggttccccttaactaaacttttgacttaatactaagtttgggtagtcgaccgtacggccacggtaggaccggtaacgggcgtacgggtacgtggaggtagggagtagggtagtaaggaaacgggtaaaaggtaggaaaaccgtacggacgtacgtagtaggacgggaagtaggtacgtttaccgaggggaccgaaggtaccgtaccaaccgtaacgtacgtacccgggtacccggggtacccccgtacggttcggtacccggtacgaccgaccggtaccctaacggtacggtagggtacgtggtacggaaggtacgtacgtaacgacccaccggtaggacggaccgtaccggtaccggttacctacgtttacgtcggacgtaggacggcggacgtacggtaagtaagtaggaaggtacggacgggtaggtacgttgggtcgttaccgg

SEQ ID NO: 122737 - DNA, 853 bp, Homo sapiens
  misc_feature: GYAE6OF01AN4J1.19.82.H05.1.454.CMB.1.raw
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggactcctcctcgttggtggcagcagctacagtcgcccactcccgaggtnctactggtnctagtcggtggggctaggaggtaggaacggacgggtcccggtgggggtcctcgtaggtacggtaacggttcctccgtaggaccgtaaacggttacccgttttccggttccccggggttttaacccccctttaaaccggtttaaaaactttttacgtaaacgtttaattaccgttaaaggttcggggtacggacccgaaccgtaaccgggacccgtaccggttaacgggaaccggtaacggggtaccgttacgggtaaagggtgggtaacgggttaggggtaacggttaagggtaacgttaaacggggttaaaaacgggttaaaacgaacgggtaaaaccaacgggtaacgtacgtaaggtacgggaacggaaggtaacgtacgttaaccgggagggtacctaacggaccggtacaaccggtaacggccgggtaaccgggttaccggggtcccccgttagggtacccggtaccgggaccgtaacgtaacccgtaccgttaacggacgtagggacgtacggtacgaacggtactacgtacgaccgtacgtacgggtaacgcgtaccggtccgttactacgttcgcggtagaccggagaccgggtaccgtaagtaaggtcgtaggaaacgggtcggaacgggtagtaaccggttcgttaacggttacg

SEQ ID NO: 122738 - DNA, 990 bp, Homo sapiens
  misc_feature: GYAE6OF01DD3KC.19.82.H05.1.454.CMB.1.raw
tcagtactctcgtgcacgaccggtgctcgatttagtcgagctctctcgcggggcatcactcaacaaccacatctgtcctctagaacgaaaaccctgtgagcacagctcctccaccatggacgtgggccgtggaggtactccctccttcgttggtggcagcagtacctaacgaagtcgacccctacctcccgagggttcgacctttacggttgggtacgccgtacggttcgggttcgggggtcgttagggtaaggggttacgggaaaacgggaccggggttcccgggtccggggggtccctttaccgggaagggttacgggtaaccgggtttccccgttcccggttaggaaccgttaaaccgggttacccgttttttccccggttttaccccggggttttacccccctttttaaaaccttttaaaaaggtttttttacgtaaagttttaacttaaccggtttaaaggggttttcggggtaccggaaccggtaaccccggggttaccggaaccccggtaaccggttacgggaaaccgggtaacgggtaccgggtttacgggacgggggttaggggtagggttaacggggttaggtaacggggttaaaggttaaaaccggggttaaaaaaccgggttaaaagggttaaaccgggaaaacggtaaccggggtaacggtaacggtaacggtggggtaaaccggggtaaggtaaccggttaccgggttaccgggaaaggggtccgtaaaggtaccgtacccgtaaccgtacggtacccgggtaaccggtccccggggtaccctcggtaccggtcgactacgccgtaacgtgaggtacgcgtacggaagtaaccggtatacgtaacgtacccggacgtaccgggacgggacccgttacggtacccgttagtttacggttcctagggacgtcggaacgtaccggacgtaagtacgaggttaggtggacgggtatagtaacggttgttcgtttcccggg

SEQ ID NO: 122739 - DNA, 529 bp, Homo sapiens
  misc_feature: GYAE6OF02HC85A.19.82.H05.1.454.CMB.1.raw
  modified_base (207)..(207): a, c, t, g, unknown or other
  misc_feature (207)..(207): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagnggcctggggcctcagtgaaggtctcctgcaagacttctgggttccccttccaaaattttgatatcaattgggtgcgacaggccactggacaagggctcgagtggatgggatggatgaaacggtaaaagtggaaacacgaggctagtggcggagagattccgagggcagagtcaccatgacgtcggggacccctgtcggtcggcacgacgcctacagtggagctagagagtctgacaccgtgacggacacggccgtctaattacgtgtcgacgaggacggaccgacggaatagtaggaaggtggacggagagtggtacttcgg

SEQ ID NO: 122740 - DNA, 559 bp, Homo sapiens
  misc_feature: GYAE6OF02G0SQQ.19.82.H05.1.454.CMB.1.raw
  modified_base (439)..(439): a, c, t, g, unknown or other
  misc_feature (439)..(439): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctcgggttccccttcaaaattttgatatcaagttgggtgcgacaggccactggacaagggctcggagtggagtgggatggataggaaacggtaaaagtggaaacacgaggctagtggacggagagtactcgagggcagagtcaccagtcgacgtcgggacccctgtggtccggacacgacgcctacgagtgggacncgtagagtaagtctagaccgaccgtgaacggaccgacggtccgttcttaacgttactggtgacggtagacggcccgagtaatagtaggtaaggtcgggacggagtagttggtaccttcgg

SEQ ID NO: 122741 - DNA, 542 bp, Homo sapiens
  misc_feature: GYAE6OF02GIME3.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttccccttacctaaaattttgattatcaattgggtgcgacaggccactggacaagggctcgagtggatgggatggatggaaacggtaaaagtggaaacacgaggctatggacggagagattccgagggcagagtcaccatgacgtcggggacccctgtgtcggcacgacgcctacagtggacgcgtagagtaagtcgtagaccacgtgagacgaccggtcctacgttatacgtggtgacggagacgaccggagaattagaggtaaggtcggacgggagtaggttggtacttcgg

SEQ ID NO: 122742 - DNA, 541 bp, Homo sapiens
  misc_feature: GYAE6OF02HB42R.19.82.H05.1.454.CMB.1.raw
  modified_base (346)..(346): a, c, t, g, unknown or other
  misc_feature (346)..(346): n is a, c, g, or t
  modified_base (430)..(430): a, c, t, g, unknown or other
  misc_feature (430)..(430): n is a, c, g, or t
  modified_base (484)..(484): a, c, t, g, unknown or other
  misc_feature (484)..(484): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggccgtggggcctcagtgaaggtctcctgcaagacttctgggttccccttccaaaattttgatatcaattgggtgtgacaggccactggacaagggctcggagtggatgggatggatagaacggtaaaagtggaaacanaggactatggacggagagattccgagggtcagagtcaccagtgacgtcggggacccctgtcgtcggcacgacgcctacagtggngcctgaacgtagtctagaccaccgtgacggacacggtccgttactagttactgngcggagcggaccgacgtaatagtaggagtcggacggaaggagttacggtactttcgg

SEQ ID NO: 122743 - DNA, 581 bp, Homo sapiens
  misc_feature: GYAE6OF02GS29A.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttcccctcaaaattttgatatcaattgggtgcgacaggccactggacaaggggctcgagtggatgggatggagtggaacggtaaaagtggaaacacgaggctatgcggagagatcgagggcagacgtcacatgacgtcgggacccctcgtgtccggcacgacgccctaagacgtgggacgccgtaggagtaacgtcgtacggacctaccgtaggacggaaccgaccgggtacccgttacttacgttaccgtggtcggacggacggtacggcccggtacgtaaagttacgtaggtaaggttcggaccgggtagaacggttcggttacgttccgg

SEQ ID NO: 122744 - DNA, 593 bp, Homo sapiens
  misc_feature: GYAE6OF02H4IJO.19.82.H05.1.454.CMB.1.raw
  modified_base (375)..(375): a, c, t, g, unknown or other
  misc_feature (375)..(375): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctgaggtgaagaggccgtggggcctcgagtgaaggtctcctgcaagacttcgtcgggtttccccttacctaaaattttgatatcaagttgggtgcgacaggcccagtggacgaagggctcggagtgggagtgggagtgggataggtaaacggtaaaaggtaggaaacacgaggtctagnggacggagagtatccgagggcagagtcacagtcgaccgtcggggacccctcgtggtcgacacgacgcctacagtggagcgtagaagacgttcgtagaccgaccgtaggaacggacctaccgggtccgtacgttaagttacgtggtcgacggaggacggacccggagtaacgtagttagggaacggtgggacgggtaagtagttacgggttacttcggg

SEQ ID NO: 122745 - DNA, 649 bp, Homo sapiens
  misc_feature: GYAE6OF02GREW7.19.82.H05.1.454.CMB.1.raw
  modified_base (389)..(389): a, c, t, g, unknown or other
  misc_feature (389)..(389): n is a, c, g, or t
tcagtactctcgtgcacgaccggtgctcgatttagtcgagctctctcgcgggggcatcactcaacaaccacatctgtcctctagagaaaaccctgtgagcacagctccctcaccatggacgtgggccgtggaggactccctcctcttggtggcagcagctaacaagtcgcccacctcccgaggtgctacgtggtgctagtcgtggggctggagggtagaaggacggccgtggggcctcgagtgaaggtctcctgacaagtcttcgtcggttccccttactaaatttgatatctaagttggtgcgacgacggaccacgtcggaacgaagggcctacggagtggagtgggagtggataggaaacggtaaagaggaaacagacggtactagnggacggagagtacgttacggagggacgaagtacgtaccaacgagtacggtaccggtaccgggaccccttggtacggtccggaccgtacgacgtccctaacgagtacgggagtacgtaggaacggtacgtcgtcgaaccgtacgtaggaacggccggtaccggcccgttataaccgttcgtgtcggacggacggccggtaccggaacgtaagtaggtaggtaacggtcgggaccggtaaggtcgttacggttacgttccgg

SEQ ID NO: 122746 - DNA, 573 bp, Homo sapiens
  misc_feature: GYAE6OF02I7GKT.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctggaggtgaagaggcctggggcctcagtgaaggtctctgcaagacttctgggttccccttccaaaattttgatatcaattgggtgcgacaggccactgggacaagggctcgagtggatgggatggataggaacggtaaaagtggaaacacgaggctagtggacggagagattccgagggcagacgtcacatggacgtcgggggaccccctgtcggtccggcacgacgcctaacagttgggagtcgtaggaagtaacgtcgtagaaccaccgtaggaggaaccgaccgggccgttactagttacgtggtcgcggtaaggcggacccggagtaacgtagtaggaaggtcgggacggaaggtacgttacggtacgttcgg

SEQ ID NO: 122747 - DNA, 674 bp, Homo sapiens
  misc_feature: GYAE6OF02JB93F.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggccgtgggcctcgagtgaggtctcctgcaagacttcgtcgggttccccttacctaaaattttgattactactaagttgggtgacgacgacggccaacgtggacgaagggctcggagtggagtgggatggataggaaacggtaaagtaggaaacacgaggactagtaggacggagagtacttaccgagggcaaggtagtaccaccgaagtcggtaaccggtacggggtaacccccctggttcggtaccgggacctaacggaccgtacccttaacgacggttcgggaacggtcgtaacggaacgtaaacgttccgtaacgaacccgtaccgtagggaaccggtaaccgacccgggttaccgtactttaagttaccgtgggtacgaccggacggacggtaccggaacgtaaacgttagttaagggaaggttcggaacggtacgtaacgggttacggttacgtttaccgg

SEQ ID NO: 122748 - DNA, 573 bp, Homo sapiens
  misc_feature: GYAE6OF02IQH9W.19.82.H05.1.454.CMB.1.raw
  modified_base (406)..(406): a, c, t, g, unknown or other
  misc_feature (406)..(406): n is a, c, g, or t
  modified_base (515)..(515): a, c, t, g, unknown or other
  misc_feature (515)..(515): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatccctccttcttggtggcagcagctacaagtgcccactcccaggtgctactggtgcagtcgtggggctggaggtgaaggaggccgtggggcctcgagtgaaggtcctcctgacaagacttcgtcggttaccccttactaaatttgaatatacgtaagttgggtagcgacgacgacctacgtggaacgagggctacggaggtggagtgggagtggagtaggtaaacggtaaaagtggaaacagaggtactagtggacggagaacgtactcgaggnagagcacagcgacgtcgggaccctgtcgtcggcacgacgacctagagtaggacgtgtaggagtaacggtctagacctacgtaggacgacgaccgtcgtactagttacgngcgagacggaccgaccgtagaagttacgaggtacgtggacggagtagttagtcttcgg

SEQ ID NO: 122749 - DNA, 674 bp, Homo sapiens
  misc_feature: GYAE6OF02J0RN5.19.82.H05.1.454.CMB.1.raw
tcagtactctcgtgcacgaccggtgctcgatttagtcgagctctctcgcgggcatcactcaacaaccacatctgtcctctagagaaaaccctgtgagcacagctcctcaccatggactgggcctggaggatccctcctcttggtggcagcagctacaagtcgccccacctcccaggtgctactggtgcagtcgtggggctggaggtgaaggacggtccgtcggggcctcgaggtaggtaacggtcctcctgacaaacgtctttcgttccggtttacccctaacttaaaagttttgaattattacgttaaggttgggtcgacgacgacggaccacggttacggaacggtaacgggctaccgggtaggttgggaagtgggagtaggaagtaaacgggtaaaaggtaaaaggtacggtaaaacgacgtagtactaagtcgggaggaagagtacgtacgagggcgagacacgtaccgagtaccgacggtcccggtacccgtgtacggtccgtacacgtacgtaccgtaagagtcggatacggagtaaacggtactcgtaagaaccctacgtaacggacggtaccgacgttcccgttaaagttcgttagcggtcgacgaggtaacggcgaagtacgtagtaggaacgtggacggtaagttaggttcgttaccggtttcg

SEQ ID NO: 122750 - DNA, 664 bp, Homo sapiens
  misc_feature: GYAE6OF02G1B7M.19.82.H05.1.454.CMB.1.raw
  modified_base (411)..(411): a, c, t, g, unknown or other
  misc_feature (411)..(411): n is a, c, g, or t
  modified_base (598)..(598): a, c, t, g, unknown or other
  misc_feature (598)..(598): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtagctactcggtcgcacgtcgtggggctggaggtagaaggacggccgtcggggacctacgaatggaaggttcctccgtgacaagactttcggtcggtttccccttactaaaagttttgattatactaagttgggtacgcgactacggaccctagttcggaacgaagggtcctacggaggtaggagttggggaagtggaagtagggtaaaacggtaaaaggtaggaaacacgaaggtntagaggacgaaggagtagtccggaaggccgagtacgaccacgagtcggaccggtaccgggggacccccttgtcggtacggacaacgtaccgtacctaacgtacggtacggacgtccgtaggtaaacgtacgttacacgaacctaccgagggaccggtacgtacccgggtaccttacgtaacgttcgnggtcggtaccggaggtccggaccgagtaacttagtagacggtcggcggtaatacgtggttcttcgg

SEQ ID NO: 122751 - DNA, 594 bp, Homo sapiens
  misc_feature: GYAE6OF02FZILS.19.82.H05.1.454.CMB.1.raw
  modified_base (283)..(283): a, c, t, g, unknown or other
  misc_feature (283)..(283): n is a, c, g, or t
  modified_base (452)..(452): a, c, t, g, unknown or other
  misc_feature (452)..(452): n is a, c, g, or t
  modified_base (517)..(517): a, c, t, g, unknown or other
  misc_feature (517)..(517): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctgaggtgaagaggccgtggggcctcagtgaggtctcgtgcaagcttcgtcggttccccttactaaattttgatatctaagttgggngcgacaggaccacgtggacgaagggctcggaggtggagtgggatggagtaggaaacggtaaaagtaggaaacacgacggtatacgtggacggaagtagtacgtaccgaggcgaagacgtacacagtacgacgtccgggacccctgtgtccgacacgtagcctaatacgnggacgtgtagagtacgtcacggactaccgaggacggaccgaccgggtccttacgttacgttacgngtacggacgaggaccggaccgacggtaaagttcgaggtaaggtcgggaccggaggtacggttaggtacctttcccgg

SEQ ID NO: 122752 - DNA, 837 bp, Homo sapiens
  misc_feature: GYAE6OF02IJJ8U.19.82.H05.1.454.CMB.1.raw
tcagtactctcgtgcacgaccggtgctcgatttagtcgagctctctcgcgggggcatcactcaacaaccacatctgtcctctagaagaaaaccctgtgagcacagctcctcaccatggactgggccgtgggaggactcccttcctcgttggtggcagcagctacaagtcgcccactcccgaggtgctacgtgggtgccaggttcggtggggcgtggtagggtaggaacgggcggtccgggtcggggtcctacggtaggtacggtacggttcctcgtacgacgtaacgttcgtttccggttcccggtttaccccttaaacgtttaaagtttcgattacgtacggttagggttcggtcgacggtacgccgtaccgtaggtacggaaacggtacggtccgtacggtaggttggtagggtagggaggtacggttaacggtaaaacgggtaaaacgggttaaaaggaacgggtaaaccagggtaccgttacgtaagggtacgggaacgggtaaacggttacgtacccgggttaacgggaacgggtaaccgtacggtaccgacccgtaacggtacgtacgggtaaccccgggggttaccccggtacccttcgggtaccggtaccggaacgtaccggaaccggtaacgttaggacggtaggaccgtaggtaacgaaggttacgtaaccgtacgaacccgttacgggaaccgaaccgggtaccgtccggttaaccttaggttaccacgggttggaccggtaacggacggtaaccggaccggttaaattacggaagttaacggcgggtacgacgggtaacggttacgttacgtttcgttacccggg

SEQ ID NO: 122753 - DNA, 716 bp, Homo sapiens
  misc_feature: GYAE6OF02FU3BV.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctgaggtgaagaggcctggggcctcagtgaaggtctcctgcaagacttctggttccccttcaaattttgattatctaagttggtgcgacaggccacgtggacaagggctcgagtggagtgggatggataggaacggttaaaagtaggtaaaacacgaggtacgtagtaggacgggaagagtacgtttaccgaggggtacgaaaggtagtacccgaacgtaacgtacgggaaccgttaccgggggtaaccccccttacggttaccggttccgggaccgtaaccgaacggtacccgttaaccgtaagttcggggaacgtaccgtaggaacggtaaacggttacgtacggaaccgtacccgtagggtaacggaacccggacccgggttacccggtttaacgttaacgtttaaccgtgggttaccggtacggaacggaccgacccgggtaccggtaaagttacgttacggtaagggtacggtaccggggtaaggtaacggtttaccgggtaacgttttcccggg

SEQ ID NO: 122754 - DNA, 695 bp, Homo sapiens
  misc_feature: GYAE6OF02ICNER.19.82.H05.1.454.CMB.1.raw
tcagtactctcgtgcacgaccggtgctcgatttagtcgagctctctcgcgggggcatcactcaacaaccacatctgtcctctagagaaaaccctgtgagcacagctcctcaccatggactgggcctggaggatcctcctcttggtggcagcagctacaagtgcccactcccaggtgctactggtgcagtcgtggggctggaggtgaaggagggcccgtgggggccctcgagtaggaacggttctcctgacaagtacctttcgtcggggtttccccctttacctaaaaagtttttgaattatcaaagttgggtgcgtacaggcccagtggacgaagggctcgagtggagtgggatggataggaaacggtaaaagtggaaacacgaggactagtgacggtagagtagttaccgagggcaaggacgttcgaacctagtcggtaccgtacgggggtaccccctcggtacggtaccggaccgaaccgtacgtacccttaacgaagttacgggagtccgttagtaaacggtaacgttcgttacgtaaccgaccgtagggaacggacccgtaaccgggtaccgttacgttaaacgtttaccggtagtacggacggtaaggcggtacccggacgtaaacgttaagtaacgggtaaggtacgggacgggtaacggtacggtttaccgggttactttacccgggg

SEQ ID NO: 122755 - DNA, 687 bp, Homo sapiens
  misc_feature: GYAE6OF02JCN76.19.82.H05.1.454.CMB.1.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagtactctcgtgcacgaccggtgctcgatttagtcgagctctctcgcgggggcatcactcaacaaccacatctgtcctctagagaaaaccctgtgagcacagctcctcaccatggactgggcctggaggatccgtcctcttgggtggcagctagctaacaagtcgcccactcccgaggtgctacgtggtgcctagtccgtaggggctggaggtgaaggacggccgtggggcctnagtaggacgttcctcgtgacaacggtacttcgttcgggtttacccccttacgtaaaattttcgattactctaaggttgggtgcggacncgtaccgacgtcggacgagggctacgaggtggngtagggagtagggtanagggtaaacggtaaaggtacggaaacgacgacggtactagtcgacggagtagaacgtccggtacgggacaggtacgtacaactgtacgtacggtacgggtcccctcgtcggtaccgacctacgaccgtacctacgtacgtaggacgtctacggaagtacgtactacggtacctacgcgggaacgtaccggccggtaccgttacgttacgttacgtagggtcgtacggtacggccggaccggtaacgtaagttcggtaacggtaagggttacggaccggttaagggtacgttaccgggtttaaccgtttcccggg

SEQ ID NO: 122756 - DNA, 255 bp, Homo sapiens
  misc_feature: GYAE6OF01CXSBR.47.3.A03.1.454.CMB.1.raw
  modified_base (242)..(255): a, c, t, g, unknown or other
  misc_feature (242)..(255): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaaacgaactgtggctgcaccatctgtcttcatcttcccgccatctgatacgtgagctctgagcgggctgggcaaggcgcatagnnnnnnnnnnnnnn

SEQ ID NO: 122757 - DNA, 245 bp, Homo sapiens
  misc_feature: GYAE6OF01B48U8.47.3.A03.1.454.CMB.1.raw
  modified_base (241)..(245): a, c, t, g, unknown or other
  misc_feature (241)..(245): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggtactttcggccaagggaccaaggtggaaatcaaacgaactgtggctgcaccatctgtcttcatcttcccgccatctgatacgtgagctctgagcgggctggcaaggcgcatagnnnnn

SEQ ID NO: 122758 - DNA, 244 bp, Homo sapiens
  misc_feature: GYAE6OF01EC90D.47.3.A03.1.454.CMB.1.raw
  modified_base (239)..(244): a, c, t, g, unknown or other
  misc_feature (239)..(244): n is a, c, g, or t
tcagagctcacgtacacgaccggtgctcgatttagagagcgtcacagagttcactctcactatcagcggcctgcagcctgaagattctgcaacttattactgtctccagtatgatgcttacctcggactttcggccaagggaccaaggtggaaatcaaacgaactgtggctgcaccatctgtcttcatcttcccgccatctgatacgtgagctctgagcgggctggcaaggcgcatagnnnnnn

SEQ ID NO: 122759 - DNA, 532 bp, Homo sapiens
  misc_feature: GYAE6OF01DL8Z7.47.3.A03.1.454.CMB.1.raw
tcagagctcacgtacacgaccggtgctcgatttagagagcgtcacaggaggagaaggggaggaatcagtcccactcaggacacagcatggacatgagggtccccggctcagctcctggggcttccgtgctgctctggttcccaggtgccaggtgtgacatccagatgacccagtctcatcctcctgtctagcatctgtagagacagagtcaccatcacttgccgggcagtcagggcgttgcaaatgctttggcctggtttcagcagacacagggaaggcccctaagcgcctgatctatggtgcatacactttgacaaagtgggtccatcaagttcagcgcagtagtctggacagagtctactctcactatacacgacggcctcgcgacgcctagaagagttctgactaacttatttaactgttctcctatactagtatcgtccttacccgtccgtaccgtttccggaccgtaacgggtaaccgaacggtacggaaactacgaaacgtaacgtacgtaggactcgctaacccg

SEQ ID NO: 122760 - DNA, 265 bp, Homo sapiens
  misc_feature: GYAE6OF01A2ROH.47.3.A03.1.454.CMB.1.raw
  modified_base (241)..(265): a, c, t, g, unknown or other
  misc_feature (241)..(265): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgccatctgatacgtgagctctgagcgggctggcaaggcgcagtagnnnnnnnnnnnnnnnnnnnnnnnnn

SEQ ID NO: 122761 - DNA, 488 bp, Homo sapiens
  misc_feature: GYAE6OF01BE9WE.47.3.A03.1.454.CMB.1.raw
  modified_base (400)..(400): a, c, t, g, unknown or other
  misc_feature (400)..(400): n is a, c, g, or t
tcagagctcacgtacacgaccggtgctcgatttagagagcgtcacaggaggagaaggggaggaatcagtcccactcgaggacacagcagtggacatgagggtcccgctcagctcctggggctcctgctgctctggttcccaggtgccaggtgtgacatccagatgacccagtctccatcctccctgtctgcatctgtaggagacagagtcaccatcacttgccgggcgagtcagggcttgcaaatgctttggcctggtttcagcagacaccagggaagcccctaagccgcctgatctatggtgcatacactttgcaagtgggtcccatcaaggttcagcggcagtagtctgggacagagttcactctcactatcgagcggacctgcagcctgaatattcngctaacttattactgtctcagttatgatgcttaccgtggtacttcggccaacgggccaaggtgaaactcgaaacgactgagctgcacg

SEQ ID NO: 122762 - DNA, 247 bp, Homo sapiens
  misc_feature: GYAE6OF01DGWAN.47.3.A03.1.454.CMB.1.raw
  modified_base (241)..(247): a, c, t, g, unknown or other
  misc_feature (241)..(247): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgccatctgatacgtgagctctgagcgggctgggcaaggcgcatagnnnnnnn

SEQ ID NO: 122763 - DNA, 670 bp, Homo sapiens
  misc_feature: GYAE6OF01AHKEF.47.3.A03.1.454.CMB.1.raw
  modified_base (234)..(234): a, c, t, g, unknown or other
  misc_feature (234)..(234): n is a, c, g, or t
  modified_base (439)..(439): a, c, t, g, unknown or other
  misc_feature (439)..(439): n is a, c, g, or t
tcagagctcacgtacacgaccggtgctcgatttagagagcgtcacagagaggaagggggaatcagtcccactcaggacacagcatggacatgagggtcccccgctcagctcctggggctcctgctgctcgtggttcccaggtgccaggtgtgacatccagatcgacccagtcctccactccctcctgtctgcatctagtaggagacagacgtccaccatcacgttcggccgggngacggtcgagggtctagactaatgtcgttggccgtggttacagacacgaccgaccggaggaccgcccgtaacgcgctgactcgtagtggtcgactactacgtacgtttacgacggtaacggtcgggtaccctacgtacgtaacggtcgaggacggtacgtaggtacgggtacgtaggaacgtacgtacgttacctaccgttaccnctacctacgtccgacggtcccggacctcggaccgtacgtaccgtagtaacgtactttcgtaccgtaaccttaactttacgttacttcgtacctacgtagttacgtacgttacgtaccgttacccgttacccgtcggtaccggttaccggaaccggtaaacggtaccggtaagggtaacgtaacgtaaccgtaacgtacgtacggtacgtacctcgtacccgtacgttaccg

SEQ ID NO: 122764 - DNA, 242 bp, Homo sapiens
  misc_feature: GYAE6OF01BCM46.47.3.A03.1.454.CMB.1.raw
  modified_base (240)..(242): a, c, t, g, unknown or other
  misc_feature (240)..(242): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgccatctgatacgtgagctctgagcgggctggcaaggcgcatagnnn

SEQ ID NO: 122765 - DNA, 261 bp, Homo sapiens
  misc_feature: GYAE6OF01AMY4N.47.3.A03.1.454.CMB.1.raw
  modified_base (239)..(261): a, c, t, g, unknown or other
  misc_feature (239)..(261): n is a, c, g, or t
tcagagctcacgtacacgaccggtgctcgatttagagagcgtcacagagttcactctcactatcagcggcctgcagcctgaagattctgcaacttattactgtctccagtatgatgctttaccctcggactttcggccaagggaccaaggtggaaatcaaacgactgtggctgcaccatctgtcttcatcttcccgcatctgatacgtgagctctgagcgggctggcaaggcgcatagnnnnnnnnnnnnnnnnnnnnnnn

SEQ ID NO: 122766 - DNA, 251 bp, Homo sapiens
  misc_feature: GYAE6OF01ETR4L.47.3.A03.1.454.CMB.1.raw
  modified_base (243)..(251): a, c, t, g, unknown or other
  misc_feature (243)..(251): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaaggtggaaatcaaaacgaactgtggctgcaccatctgtcttcatcttcacgccatctgatacgtgagctctgagcgggctgggcaaggcgcatagnnnnnnnnn

SEQ ID NO: 122767 - DNA, 243 bp, Homo sapiens
  misc_feature: GYAE6OF01AR2SX.47.3.A03.1.454.CMB.1.raw
  modified_base (239)..(243): a, c, t, g, unknown or other
  misc_feature (239)..(243): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgcatctgatacgtgagctctgagcgggctggcaaggcgcatagnnnnn

SEQ ID NO: 122768 - DNA, 612 bp, Homo sapiens
  misc_feature: GYAE6OF01ENXVM.47.3.A03.1.454.CMB.1.raw
  modified_base (232)..(232): a, c, t, g, unknown or other
  misc_feature (232)..(232): n is a, c, g, or t
tcagagctcacgtacacgaccggtgctcgatttagagagcgtcacgtaggagagaaggggaatcagtcccactcaggacacagacatggacatgagggtcccccgctcagctcctggggctcctgctactctggctccggaggtgccagatgtgacatcccagatgacccagtcctccgatcctccctgtcctgcatctggtaggagacagagtcaccatcacttgccgggnaagtcagagacaataacagcgtatttaaattggtactcaccagaaaccgaggaaacgcccctaacctcctgactctatcgctgcatcctagtttgactagtaggtcgggtcccagttcgtaggttcaggtgcagtgatcgaggacagtatttcgactctacactatcagctagtctcgactaaccgtagtaacgttacgttttcgacccttaacttacgttaccgtacgttaccgaaacgtaacggtaaccgtttaacccgggtaccccgttaacgttaccgttttacgggacccgtaaacggggtaaccctaaacggtcggaacctaacgtaccgtaaaacgtacgttacggtacgccttacgccctaccgtgttaccg

SEQ ID NO: 122769 - DNA, 253 bp, Homo sapiens
  misc_feature: GYAE6OF01CZSUT.47.3.A03.1.454.CMB.1.raw
  modified_base (242)..(253): a, c, t, g, unknown or other
  misc_feature (242)..(253): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaaacgaactgtggctgcaccatctgtcttcatcttcccgcatctgatacgtgagctctgagcgggctgggcaaggcgcaatagnnnnnnnnnnnn

SEQ ID NO: 122770 - DNA, 580 bp, Homo sapiens
  misc_feature: GYAE6OF01E3TQO.47.3.A03.1.454.CMB.1.raw
  modified_base (144)..(144): a, c, t, g, unknown or other
  misc_feature (144)..(144): n is a, c, g, or t
  modified_base (233)..(233): a, c, t, g, unknown or other
  misc_feature (233)..(233): n is a, c, g, or t
  modified_base (468)..(468): a, c, t, g, unknown or other
  misc_feature (468)..(468): n is a, c, g, or t
tcagagctcacgtacacgaccggtgctcgatttagagagcgtcacaggagagaagggggaatcagtcccactcaggacacagcatgggacatgaggactccccgctcagctccgtggggctcctgctgctctggttcccaggtnccaggtgtgacatccagactgaccccagtcctccatccctccctgtctgcatctgtaggagaccaggagtcaccatcacttggccgggngagtcgagggtccgttgacaaatgctttggccttggtttcagcagaccaccgaggggaaccgccccgtaagccgcctgactcgtagtgggtgcatacctactttgactaaggtcgggtcccaatcgaaggttcaggcgacaggtacgcgtggacagtacgtcactctacactatcagcgctgccacgtcctaggaatcttcgagtactaacttattctacgtcctcgtaagttangtactcgtaacccgttacccgtccggttaccttccggaaccgtaacgggaaccgtaaagggtaagtaaactaaccgaaaacgtacttacggtagtacgtcgaccgtaacccg

SEQ ID NO: 122771 - DNA, 253 bp, Homo sapiens
  misc_feature: GYAE6OF01CY27B.47.3.A03.1.454.CMB.1.raw
  modified_base (240)..(253): a, c, t, g, unknown or other
  misc_feature (240)..(253): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgccatctgatacgtgagctctgagcgggctggcaaggcgcatagnnnnnnnnnnnnnn

SEQ ID NO: 122772 - DNA, 734 bp, Homo sapiens
  misc_feature: GYAE6OF01C7VQ4.47.3.A03.1.454.CMB.1.raw
  modified_base (231)..(231): a, c, t, g, unknown or other
  misc_feature (231)..(231): n is a, c, g, or t
tcagagctcacgtacacgaccggtgctcgatttagagagcgtcacagagaggaaggggaggaatcagtcccactcaggacacagcatggacatgacgggtccccgctcagctccgtggggctcctgctgctcgtggttcccaggtgccaggtgtgacatccagatgacccagtctccatccctccctgtctgcatctgtaggagacagagtccaccatcacttggccgggngagtcgaggggcgttagacaaatcgtcgtttcggccttggtttacagcagaccgtaccgaaggggaaccggaccccgtaagccgtaccgtgactcgtaagtggtcgactatactacgtttacgacgtaaaggttcggggtacccaagttaccgtaaggttacgacggccggacgtaaggtacgggtacgtagggacgtaaggtacggtttccaaccgttacctactaaccttagtaccgtacggtccggtacccgttcggccgtacgtacccgttagggaaacgtactttaccgtacgtaccttaaacttttaactttaccgtttaccgttaccgttaccctaggttaacttcggtacgttaccgtacccttttacccccggttacgggttaacccgtttcccgggaacccgggtaaaccgggtaacccgtaaagggttaacggaaaacgttaacccggtaaaacgtaaaccggttaggtaccggacctggaccctaaacccg

SEQ ID NO: 122773 - DNA, 635 bp, Homo sapiens
  misc_feature: GYAE6OF01CKDY0.47.3.A03.1.454.CMB.1.raw
tcagagctcacgtacacgaccggtgctcgatttagagagcgtcacagagaggaagggggaatcagtcccactcaggacacagcatggacatgagggtccccgctcagctcctggggctcctgctgctctggttcccaggtgccgaggtgtgacatccagatcgacccagtcctccatccctccctgtctgcatctggtaggagacagacgtcacctatcacttggccgggcgagtccggagggtcttagactaatgtcgttggtcctggtttcagcacgacaccgagggaaccgcccctaagccgacgtgatctagtggtgctactactacgttgaacgtaaggtcgggtaccagtacgtaacggttcgaggtcggactaggtacggtcgtaggggactaggtacgttacactcctactacacgtacgagtccggctagacgtacgtcctagtaacgtacttcgtacgtacttaactttacttacgttacgttccgtacgtaagttagtacgtagttaccgttaccgttacccgttagggttaccccgttacgggaacccgtaaacggggtacccgtaaagggttacgtaaaacgtacgaaaccgtgtacggtcgacgtacgaccctacgttacg

SEQ ID NO: 122774 - DNA, 600 bp, Homo sapiens
  misc_feature: GYAE6OF01C4VDU.47.3.A03.1.454.CMB.1.raw
  modified_base (199)..(199): a, c, t, g, unknown or other
  misc_feature (199)..(199): n is a, c, g, or t
  modified_base (438)..(438): a, c, t, g, unknown or other
  misc_feature (438)..(438): n is a, c, g, or t
  modified_base (587)..(587): a, c, t, g, unknown or other
  misc_feature (587)..(587): n is a, c, g, or t
tcagagctcacgtacacgaccggtgctcgatttagagagcgtcacagagaggaagggggaatcagtcccactcaggacacagcatggacatgagggtccccgctcagctcctggggctcctgctgctctggttcccaggtgccaggtgtgacatccagatgacccagtctccatcctccctgtcctgcatctgtagganacagatcaccatcacttggccggcgagtcaggggcttagacaatgtctttggccttggttcagcagacaccgagggacgcccctaagcgcctgatctagtggcgacatactacgttacgacgtaaaggtcgggtcccagtacgtaaggttacacggcggtactaaggttacggtcgtacgggactaggtacgttctactcctacactatcgacgtcgcctgacgtactcgtagaacgtnttacgtgtacctaactttacgttaccgttgtaccgttacctaaggttacgtcgtaacttccggtacctttaccccggtacggttaacccgttccggaacgtaacggaaccgtaaggtaacgaaactaacgtaaacgtacgtgtacggtntacgaccacgtac

SEQ ID NO: 122775 - DNA, 563 bp, Homo sapiens
  misc_feature: GYAE6OF01B0434.47.3.A03.1.454.CMB.1.raw
  modified_base (307)..(307): a, c, t, g, unknown or other
  misc_feature (307)..(307): n is a, c, g, or t
  modified_base (415)..(415): a, c, t, g, unknown or other
  misc_feature (415)..(415): n is a, c, g, or t
tcagagctcacgtacacgaccggtgctcgatttagagagcgtcacaggagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcgagtcgagggtcgttgcaaatgctttggcctggtttcagtcagacaccgagggaacggccccgtaagcgcctgatctatggtncatacactttagactaaaggtcggggtacccatacgaaggttcaggcggcagtaggtcgtgggacagagttcactctacactatcagcgctgacagctagaagattcngactacttatactgtctacagtatgtatgtacttacccgtcggtaccttttacgggacccgtaacggggtaacccgtaagggtacggtaaacttaccgaaaaccgttacgttacggtacggtaccgtacggacctacccgttaaccgg

SEQ ID NO: 122776 - DNA, 682 bp, Homo sapiens
  misc_feature: GYAE6OF01D85HN.47.3.A03.1.454.CMB.1.raw
  modified_base (348)..(348): a, c, t, g, unknown or other
  misc_feature (348)..(348): n is a, c, g, or t
tcagagctcacgtacacgaccggtgctcgatttagagagcgtcacagagaggaagggggaatcagtcccactcaggacacagcatggacatgagggtccccgctcagctcctggggcctcctgctgctctcggttcccaggtcgccaggtgtgacatccagatcgacccagtcctccacttccctccctgtctgctatctagtaggagacagacgtccaccatacacgttcggccgggtcgacgtcgagggtcgttagaactaagtgtcgtttcggtccttggtttcagacgacgaaccgacggaacggggtaaccgaccccgtaagccgtcctgtactcgtagtggnactaactactacgttagacgtaaaggtccgggtaccctagtaccgtaagttcgaggcggactaggtaggtcgtacgggactagtacgttacaccttacgtacctaacttagtccgaggccggtccacgcgtacgcgttaaggtactagttcgtcgtaacttaacgtttttaactacttcgtaccttaccgtaagttacgtagtacgttaccgttaccgtttaccccggtacggttacccgtttcccgggaaaccggaacgggtaaacccgtaagggtaacgtaaaccgtaaaccgtaaaacgaccggttggacggtacctacgccgaccttacg

SEQ ID NO: 122777 - DNA, 611 bp, Homo sapiens
  misc_feature: GYAE6OF01COD4P.47.3.A03.1.454.CMB.1.raw
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
tcagagctcacgtacacgaccggtgctcgatttagagagcgtcacagagaggaaggggaggaatcagtcccactcaggacacagcatggacatgacgggtccccgctcagctccgtggggctcctgctgctctggttcccaggtgccaggtgtgacatccagatgacccagtcctccatccctccctgtctgcatcgtgtaggagacagagtccaccatcacttcgccgggcaaggtcaagagactaagttaacagacgtaattttaaaagttggtaactcaaccaagaaaaccgaacgggaaaccgtaccccctaaacctccgtgaacttctagtcgctagcctactccctagtttcgactagtacggtcgggtaccccagttcgtaggttcaggttggactaggtggtaagtcgtggggactaggttactttcgaccttctaccgacctataccacgtcacgttccgtacgacctaacgtagaagttattttagaccttaacttactactagtaccaacgtagtacgttaccgtacccgtacttcgttacgacgacggtaaccaacgtcgtacaatacgaaacgtagtgtcggacngaccnctacttcg

SEQ ID NO: 122778 - DNA, 733 bp, Homo sapiens
  misc_feature: GYAE6OF01DEYSJ.47.3.A03.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagagctcacgtacacgaccggtgctcgatttagagagcgtcacaggagagaagggggaatcagtcccactcaggacacagcatggacatgagggtccccgctcagctcctgggctcctgctgctcgtcggttcccaggtgccaggtcgtgacatccagatcgacccagtctccatcctcctgtctgcatctgtagganacagagtcaccatcacttggccgggngagtcgagggtcttgactaatgtcttggccttggtttacagcaagaccacgagggaacgccctaagcgcctgactctatggtcgctatacgtcttagacgtaaggtcggggtaccctagtaccgtaaggttcgaggccggtacgtagggtaacggtccgttagggaaccgtaacggtacgttacgaccttacgtacctactaacgttcgacggtaccggtccgtacggaccgtacgtcccgtaaggtaaacgttcgttaccgtacgtaaccttaaacttttacgttaaccgttcgttaccttacccgtaaagtttacgtaggtaacttccggttacccgttttaaccccggttaccggggttacccggttttacccgggaaccggtaaaaccgggggtaaccgttaaacgggggttaaaccggtaaaacggttaaacccggtaaaacgggtaacccggtttcgggttaaccgggtacccgttacggaacccgttacccgttaaccgg

SEQ ID NO: 122779 - DNA, 560 bp, Homo sapiens
  misc_feature: GYAE6OF01DTF7Z.47.3.A03.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagagctcacgtacacgaccggtgctcgatttagagagcgtcacaggagagaagggggaatcagtcccactcaggacacagcatggacatgagggtccccgctcagctcctgggctcctgctgctctggttcccaggtgcctaggtgtgacatccagatgacccagtctccatccctccgtgtctgcatctgtagnacagagtcacgatcacttgccgggnagtcagggcttgcaaatgctttggcctggtttcagtcagaccacgaggacggacccctaagccgcctgatcgtatggtgcatacactttgcaaaggtcggggtcccagtcgaaggttcagccggtcaggtaggtctgggactagagttcactctacactatcagcggctgcacgtcctagaagtcttcgtgactaattacttaactcgtacctacctaggttatcgtactcgtccttaacccgtcggttaccgttccggaaccgtaacgggaaccgttaagggtacggtaaactaccgaaaacgacccgttaggtccggtatcgtcctaacgttaccg

SEQ ID NO: 122780 - DNA, 669 bp, Homo sapiens
  misc_feature: GYAE6OF01DP7E8.47.3.A03.1.454.CMB.1.raw
  modified_base (655)..(655): a, c, t, g, unknown or other
  misc_feature (655)..(655): n is a, c, g, or t
  modified_base (659)..(659): a, c, t, g, unknown or other
  misc_feature (659)..(659): n is a, c, g, or t
tcagagctcacgtacacgaccggtgctcgatttagagagcgtcacagaggagaagggggaatcagtcccactcaggacacagcatggacatggacgggtccccgctcagctccgtggggctcctgctgctctggttcccaggtgccaggtgtgacatccagatgacccagtctccatccctccctgtctgcatctggtaggagacagacgtcaccatcacgttcggccgggacgagtcgaggggtccgttagactaaatgtacgtttggccttggttacagacgaacgacgaaccggacggggaacgccccctaaggccgtacctaggtacttcgtagtggtctactacttacgtactttagacgtaacggtcgggtacccagtacgtaaggttcgaggtcggacgtaggtacggtcgtagggaactaggtacgttacctacttccgtacctacttactcggaacggtccgtacctggacctacggtaccgtaggtaaacgttactttacgtacgttaaccttaacgttttactaaccgttacgtaccttaccgtaagtagttacgtaacgttccgtacctttacccggtacggttaccgttaccggacggtaacgggaccgtaaggtacgaaactacgtaaagacgtggtacgntacnctaccgtacg

SEQ ID NO: 122781 - DNA, 909 bp, Homo sapiens
  misc_feature: GYAE6OF01AD07D.47.3.A03.1.454.CMB.1.raw
tcagagctcacgtacacgaccggtgctcgatttagagagcgtcacagtaggagaaggggctcagagaggagccttagccctggactccaaggcctttccacttggtgatcagccactgtacgcactagaggacttcaccatggaagttggggcctgacgcctgggttttccttgttgctattttagaaggtctccagtgtgaggtgccaagttggtgcaatcgtgggggagcttggtccaggccgtgggggtccctcgagtacgtcgtcctagtgcagtcctctggacttcacctttagttcctcgttggatcgaacgtttcggggtccgcctaggacctccgaaggggaacggggtcctagggacggttggggttacggaccgtaaaccgacgttaaacgtacccggtaagtacgtagggaaacgttaccaaacggtaaaaacccttgttacgggtacggtaaccttacgttaccggtacgggtaaaccggggaccgtaacgtttcccaaccccgttaacgttccccgtaaccccgtaaaggtaaaccggtaaccccggaaaacccgggtaacccccgaaaacgggttaacccgtttaccggttacccgtttacggtttttacccggtaacgggtaacctaaaacgggtttccgggtaaacccttaaccggggtaccccgtttaaggggaacgggttaaccgggtttaaacccgggaaaacggtaacccggtaacccggggtacctttaccggggttaaggttttaaaccgtttaaccgggtttggggttaccgggtttcgggtttacccgttacccgggttacgggtacccccgggtttaccccggttaccggggttaaccccccggggtacccgtttccggggtacccgttttacccccggggggg

SEQ ID NO: 122782 - DNA, 821 bp, Homo sapiens
  misc_feature: GYAE6OF01DU4YB.47.3.A03.1.454.CMB.1.raw
  modified_base (617)..(617): a, c, t, g, unknown or other
  misc_feature (617)..(617): n is a, c, g, or t
tcagagctcacgtacacgaccggtgctcgatttagagagcgtcacaggaggagaagggaggaatcagtcccactcaggacacagcatggacatgagggtccccgctcagctccgtggggctcctgcgtgctcgtcggttcccaggtcgccaggtgtgacatccagatcgacccagtcctaccatccctccctgtcctggctagttcgtaggtaaggacgaccgaggacgtccaacgtatccgtacgttcggccggggacaggtccgaggggtcggttacgactaaagttcggtaccgtttcgggtccctttagggtttacaacggtaccgaacggaacccgacccgggtaagggggaaaccgggtaccccccgttaacgggaccccggtaccgttaggtacctttacggtaacggttcgggtaccgtacgtaacgttaaccgtaaccgtttacggaaccggtaaaggggttccggggtaccctaacggtaccgtaacggttacgacggcggtaacgtaacggtcgggtaccggtacgggaacgtaggtacgttaccacgttacccgtactaacctacgtccgacgtccgaccgtagccgtacgtcgtaggtaacgtntttccgacgttaccgttaacttacgttacgtaccgtaacctaaactacgttaaagttaacgttacttaccgtttacccgttaacgttcccggtaacccgttacgggaaacccggtaaacggggaaaccgttaagggaaaccgttaaaaccgtaaccgtaaaccggttacggttacggttaccgttaccgcggtacctaacccgg

SEQ ID NO: 122783 - DNA, 252 bp, Homo sapiens
  misc_feature: GYAE6OF01AIUCS.47.3.A03.1.454.CMB.1.raw
  modified_base (243)..(252): a, c, t, g, unknown or other
  misc_feature (243)..(252): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtgaaatacaaacgactgtgctgcaccatctgtctcatcctcccgcatctgactacgtgagctcgtggacggcgggctggacgaaggcgacagannnnnnnnnn

SEQ ID NO: 122784 - DNA, 755 bp, Homo sapiens
  misc_feature: GYAE6OF01CHW6F.47.3.A03.1.454.CMB.1.raw
tcagagctcacgtacacgaccggtgctcgatttagagagcgtcacaggagagaaggggaatcagtcccactcaggacacagcatggacatgacgggtccccgctcagctccgtggggctcctgctgctcgtcggttcccgaggtcgccgaggtgtacgacactaccgagactaccgaaccccgtacggttcctacctacttccccttcccgtcgtcgtcgctattcgtaggtaaggacgacgaggtactacacctatcgtacggtccggccggacgtacggtcggagggtcgtacgactaagtcgttcgttcggcgttggtacagacgtaacgaccgaaccgggaagggtacccgaccctaacggccgtaccgtagtacttacgtaggtcgtacacgttacgtaacttcgttacggaacggtacgggttccggtactaacgtacgtaacggtcgacggaccggtagtacggtggaccggtaggaacgttacgtacgtacgtcctaacgttcgtaacttccgaccggtacggtcccggtaacgtcggtaccgtacgttacgtaagggttaacttaccggttacttaacggtaactttaagttttaaccgtcgttagtaccctagtagttacctacgttacgttaacccgtccggttaacccgtcggttaaccggtaccgggaacgtaaacgggtacaagggttaaaccaacggtaacgtaaacgggtctagggacgtaacctcgactcgttacccg

SEQ ID NO: 122785 - DNA, 719 bp, Homo sapiens
  misc_feature: GYAE6OF01BK9YG.47.3.A03.1.454.CMB.1.raw
tcagagctcacgtacacgaccggtgctcgatttagagagcgtcacagagaggaaggggaggtctcagagaggagccttagccctggactccaaggtcctttccacttggtgatcagcactgagcacaggaggactcacatggaagttgggctggagcgttgggttttccttgttgtcttacgttttaaaaggtcgtccgagttgtggaggtgcgtaggtaggtgggacggtccgggggagtcgttagttcgaggtccggtggggacgtcccgtgagtacctcctcgtgtgtagtcgtcgtagtatcgtacgtttctacgttaccttcgtggtatcggccgtacggtcgggtacccgaccgtaaaccgtaccggtaaggggtacgggtcggttgggttgggtcggttctaccgtaacgttactacgtaacgtcgtagtacgtggtacgtagttaagttaaattaaagttcgtacggtaccggtacgtccgggtagggaccgggtacctagttccgacgtactacgttacccgtacgaaacgacgaaccgaagacgtaagtataacgtagtgtaacgtgaagtaataccgaacgtatgtaggaaacgtgtaacggacgtacgtcgtcgttagtaacttagttcgttagtttcgtttacgttacgtcggttacccgttcccgggtttacggacccgggttacggttccgtcgggtaccgggg

SEQ ID NO: 122786 - DNA, 711 bp, Homo sapiens
  misc_feature: GYAE6OF01BNDNR.47.3.A03.1.454.CMB.1.raw
  modified_base (350)..(350): a, c, t, g, unknown or other
  misc_feature (350)..(350): n is a, c, g, or t
tcagagctcacgtacacgaccggtgctcgatttagagagcgtcacagagaggaaggggaggaatcagtcccactcaggacacagcatggacatggacgggtccccgctcagctccgtggggctcctgctgctctggtcccaggtgccaggtgtgacatccagatcgacccagtcctccatccctcctgtctgcatcgtgtaggaagacagagtaccaaccatccgaacgttcggccgggacgtagtcgaggggtcgttggaactaaagtgtcgttcggtccgttggttactagacaacgacaaccggaagggtaaccgacccgtaagtccgcgtgtactcgtagtcggtnactaatacctaacgtttcgaacgtaaagggtcgggtaccagtacgtaacggtacgaggacggtacgtacggtaggttccgtgggaaactaggtaacgttaccgtaaccttccgtaacgtaaccttacgtaaccggacggtaccggtccgtacggccgaacgtccgtaaggtaacgttacgtacgtacgtaccttaaccgttacgttaacctacgttacctacgtaacgttacgtagtacgtaccgttacccgttaacccggtacggttaccgttaaccgggaaccgtaaacgggtaaccgtaacgggtaacgtaaacgtaaacgaaacgttaacgtacggtacggtctcggtacctaaccg

SEQ ID NO: 122787 - DNA, 802 bp, Homo sapiens
  misc_feature: GYAE6OF01BICDG.47.3.A03.1.454.CMB.1.raw
  modified_base (205)..(205): a, c, t, g, unknown or other
  misc_feature (205)..(205): n is a, c, g, or t
tcagagctcacgtacacgaccggtgctcgatttagagagcgtcacgagagaggaagggggaatcagtcccactcaggacacagcatggacacggaggtccccgctcagctcctggggctcctgctgctctggttcccaggtgccaggtgtgacatccagatcgacccagtcctccactccctcctgtctgcatcgtcggtagganacagacgtcacctatctacgttcgccgggcgacgtcggaggggtcctagacaatcgtcgtttcggccgttcggttacgacgtacgacggtaaccgaacccggacggggaacccgaccccggtaaggccggtccctaggacttccgtaaggtcgtcggacctaacgtaccttacgtttacggacgttaacgggtccgggtacctaacggtcgtaaggtacgacggtacggtacgtacggtacggtacggtacgggaactacggtacttccggtaccttactaccgtaacgttcgtacgacgggtcctaccgtccggtaccgtacgtccgttaacgaagttaccgtttacgtacggtacctttaaccgttttacgttaccgttcggtaaccccttaccggtaggttacgttaaccggttcgtttaacccgggttaccccgtttacccggttaaccgggtttacccggttaaacccgggaccccgggttaaaacggggttaacccgaaagggggttttaaaccgaaacggttaaacccgggaaaccgttacccgttagggtacccgtcgtaaacccggttaccctaccgttagttccccg

SEQ ID NO: 122788 - DNA, 823 bp, Homo sapiens
  misc_feature: GYAE6OF01DXI83.47.3.A03.1.454.CMB.1.raw
  modified_base (180)..(180): a, c, t, g, unknown or other
  misc_feature (180)..(180): n is a, c, g, or t
  modified_base (796)..(796): a, c, t, g, unknown or other
  misc_feature (796)..(796): n is a, c, g, or t
tcagagctcacgtacacgaccggtgctcgatttagagagcgtcacagagaggaagggggaatcagtcccactcaggacacagcatggacatgacggggtcccccgctccagcctccgtggggcctccgtgctgctcgtcggttcccaggtcgccgaggtgtgacatccagatcgaacccngtcctccactccctcctgtcctgcctagtcgtaggtaggacgaccaagacgtccaaccatacctacgtcgggccgggcgtacgtcggagggtcgttagaactaagtcgttcgttcgtcgttggttcacgacgagaccgaccggaacgggaaccggtcccgtaacgccgtccgtagacttacgtagtggatactacgtacgtacgttagaacggtaacgggtcggtaccctagtacggtaacggtcgacggccggtagtacgggtacgtcgggtaacggacgtagtccgttactaaccgttcgaccgtaacgtaccgttacgacccgggtacccgtaccgtcggtacgtaccgtaaccgggtagttaaccgttacgtaccgttaaccggtacctttaaacctttcgttaacccgtttcggtaacccttaaccggtaacgttacttaaccggttaccggttaacccggttttaccctaacccggggtttacccggtaacccgggttttacccggggaaaacccgggtaaacggggtaaacccggttaaaggggaaaaccggttaaaacccggtaaacgtaaaacccgggtttaccgtacggtacccggggttaaaccncgtaaaccccggtttaaacgttacccg

SEQ ID NO: 122789 - DNA, 734 bp, Homo sapiens
  misc_feature: GYAE6OF01CFW4F.47.3.A03.1.454.CMB.1.raw
  modified_base (174)..(174): a, c, t, g, unknown or other
  misc_feature (174)..(174): n is a, c, g, or t
  modified_base (202)..(202): a, c, t, g, unknown or other
  misc_feature (202)..(202): n is a, c, g, or t
  modified_base (604)..(604): a, c, t, g, unknown or other
  misc_feature (604)..(604): n is a, c, g, or t
tcagagctcacgtacacgaccggtgctcgatttagagagcgtcacagagaggaaggggaggaatcagtcccactcaggacacagcatggacatggacgggtccccgctcagctccgtggggctcctgctgctctggttcccaggtcgccgaggtgtgacatccagatcgacccngtcctcctactccctccctgtcctgacntcgtaggtaggagaccagacgtaccacctatcgtaccgttcggccgggcgtagtcggagggtcgttacgactaagtgtcgtttggccgtttgttcgacgcaacgaccgaacggacgggaaccgtaccccgtaaggccgtaccgtagtacttacgtaggtcggtacgtacttaacttaccgttacgtttacggaaccgtaacgggggttcccggtactaagttaacgtacggttcaacggcggtacgtagggtacgtcggtaggaacgttagtaccttaccgtaacgttctaaccgtatttaccgcggacggtccaccgtggaacttaccgacggttaaggacttactacgtacgttaacttacctttcgtacgttacctcggttaacaggtttactacggtntttaccccggtacccttaccgggttccgtaccgggtttaaccggaacccggtaacgggtaaagtaaccgggttagaaaacccgtaaacggtaaacccggttaggtacggccgttacctacaacccgtacg

SEQ ID NO: 122790 - DNA, 728 bp, Homo sapiens
  misc_feature: GYAE6OF01DLZE2.47.3.A03.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (315)..(315): a, c, t, g, unknown or other
  misc_feature (315)..(315): n is a, c, g, or t
tcagagctcacgtacacgaccggtgctcgatttagagagcgtcacagagaggaagggggaatcagtcccactcaggacacagcatggacatgagggtccccgctcagctcctggggctcctgctgctctggttcccaggtgccaggtgtgacatccagatgacccagtctccatcctcctgtctgcatcgtagtagganacagagtcaccatcacgtggccgggngagtcgaggggtcttagacaaagtgtcgttggccttggtttcacgcacgacaccgagggaaccgaccctaagcgcctgatcgtagtggtnactactactcttagacgtaacggtcgggtacccagtacgtaaggtacgaggtaccggacgtaggttacgggtacgtagggaacgtaacggtacgttaccgtacttaccttaaccgaacgttacgtcgaacggtcccggtaccgtacggaccgaacggtacccgttaagggtaaacgtcgtttacggtaaccgttaacctttaaacgttttacgtttaccgttacggtttaccctaacggttaagttaaccgttagttaacgttacccggttaccgttaaccccgggtttaccggtaccggtttacccgggaaccggtaaacggggtaaaacccggtaagggtaacggtaaaacgtaacccggaaaacgtaccgggtacggttaacgtaccgtacgtaacccgtaccgttaacg

SEQ ID NO: 122791 - DNA, 247 bp, Homo sapiens
  misc_feature: GYAE6OF01ACF3H.47.3.A03.1.454.CMB.1.raw
  modified_base (241)..(247): a, c, t, g, unknown or other
  misc_feature (241)..(247): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatacaaacgaactgtggctgcaccatctgtctcatcttcccgcatctgatacgtgagctcgtgaggcgggctggcgaaggcgcatgnnnnnnn

SEQ ID NO: 122792 - DNA, 743 bp, Homo sapiens
  misc_feature: GYAE6OF01DY36R.47.3.A03.1.454.CMB.1.raw
tcagagctcacgtacacgaccggtgctcgatttagagagcgtcacagagaggaagggggaatcagtcccactcaggacacagcatggacatgagggtccccgctcagctccgtggggctcctgctgctcgtcggttcccaggtcgaccgaggtgtagacatccaagactcgacccagtcctccacctcctcctgtctgcctatcgtaggtaggacgacgacggtactaccaacctcgtaccgtaccggttccggggccgggtacggtaaccggtcgggtaacgggtcggttacgaacgttaaacgtcgttccggtttcggtccgtttgggttacacggtaccgaacggaaccgaaccgggtaacggggaacccggtaccccgtaacggtccgtaccgtacggacgttacgtacggttcgggtactactaacgtacgttacgtacggaacggtaacggtcggtaccctagtacgtaacggtgcggtacggacgtaggtcgtacgtagggtacaggtaccttcgacgtctacgtactacgtcgacggccgtacgtacgcgtacgtacgtagtacgtataccgtacgtaacttacgttactcgttacgtcctacgagttcgtactacgttaccgtaccgtaccgtcggtaaccggttaccgaaccggtaaacggtacggtaaggtaacggtaaaccgacggtaaaacgccggttacggtaacgtaccgacggtaccctagtacccg

SEQ ID NO: 122793 - DNA, 248 bp, Homo sapiens
  misc_feature: GYAE6OF01EGASP.47.3.A03.1.454.CMB.1.raw
  modified_base (234)..(234): a, c, t, g, unknown or other
  misc_feature (234)..(234): n is a, c, g, or t
  modified_base (239)..(248): a, c, t, g, unknown or other
  misc_feature (239)..(248): n is a, c, g, or t
tcagagctcacgtacacgaccggtgctcgatttagagagcgtcacagagttcactctcactatcagcggcctgcagcctgaagattctgcaacttattactgtctcagtatgatgcttacctcggactttcggccaagggaccaaggtggaaatcaaacgaactgtggctgcaccatctgtctcatccttcccgcatctgatacgtgagctctgagcgggtctggcaagggccnaatgnnnnnnnnnn

SEQ ID NO: 122794 - DNA, 865 bp, Homo sapiens
  misc_feature: GYAE6OF01BWDRV.47.3.A03.1.454.CMB.1.raw
tcagagctcacgtacacgaccggtgctcgatttagagagcgtcacagagaggaaggggaggaatcagtcccactcaggacacagcatggacatgacgggtccccgctcagctccgtggggctcctgctgctcgtcgggttcccagggtgccgaggtgtgacatccagatcgacccagtcctaccactccctccctgttctgactactcgtaggtaggacgacgacggtacgtccaactactccgtaccggttcgggccgggacgtacggtcgaggggtcgttacgacgtaacgttcggttaccgtttcggtccgtttggttaccacgacgaacgaaccggtaaccggaacgggggaaccggaccccgtaacggccggtaccgttacggacttacgtaggttcggtacgtactacgttaccgtacgttacggtaaccggtaaacgggttccgggtacctacgtaacggtacggttacgacggtcggtacgtaacggtacgggtcgtacgggaacgtaggtaccgttaccgtacttaccgtaacgtaaccgttacgtacgggtacccgggtaccgggtacccgtacggtacccgtaaccgggtacgttaacggtaacggttactttaccgtaacggttaacctttaaccggttttaacttaccgttacgtttacccggtacgttaacgttacgttacggttactttacccggttaacccgttacccgggttaccggttaccggttaacccgggaaccgggttaaaccggggtaaccggttaaacgggggttaacccgtaaaacgttaaacccggtaaaacggtacccggttacgggtaccggaccggttaaccgacccggttaaccg

SEQ ID NO: 122795 - DNA, 980 bp, Homo sapiens
  misc_feature: GYAE6OF01BEVIH.47.3.A03.1.454.CMB.1.raw
  modified_base (111)..(111): a, c, t, g, unknown or other
  misc_feature (111)..(111): n is a, c, g, or t
  modified_base (310)..(310): a, c, t, g, unknown or other
  misc_feature (310)..(310): n is a, c, g, or t
tcagagctcacgtacacgaccggtgctcgatttagagagcgtcacagagaggaagggggccttacgcccgtggactccgaacggtccctttccacgttggtgatcagcacngagcaacgagacggacctccaaccagtggtaaggtgggctgacgtcgtttcgggtttttccgttgttgtactttagttttaacggaaggttcgtcgtaggttggtaggtaaggtgacttaagttcgggtgactaacggttcgggtagggggtacgttcggttcggtaacccggcgggttccggggttccggggttcccngtacgtccttccttccgttcgtacgcgtcgtcctacgtgttaaccttcctttaccgttttcggtcccttaggttagtacggttggtacggttccgggaccctacgaccggttaccgggaacgggggtaacggggggtacgggtcggggtttacgggtacgggggtttacgggtaaccggtaaaccgtaaaacgttaaaccgttaaacggacgttaaagggtaaacgtacggggtaaaaccgtaaccgaaaaacggtttaacgttacgggttaacggtaccgtaactttaccgggacggtaacgggtaaaccccgggtctttacctaacccctacggtaacccttcccgtaaacggaaccgaaccgtaacccgtaaccgtaaccggtaaacttaccgttaccgttacgtttaccggtaacgtaacgtaacgaacgtacggtaccggtagtacggtaaggaaccgggtaacggtaacggtaacccgtaaacggtccgttaaccggtttgttaaccggttacgtttacgttcgggtttccgtaccggttaccgtccggttaccgtccccgggttaccccgggttcgggttaccccggttccggttcccggggttcggtacccggggttaccgggtaccgggttaccccgggttcccggtccggttaaccccgg

SEQ ID NO: 122796 - DNA, 730 bp, Homo sapiens
  misc_feature: GYAE6OF01EN585.47.3.A03.1.454.CMB.1.raw
  modified_base (200)..(200): a, c, t, g, unknown or other
  misc_feature (200)..(200): n is a, c, g, or t
  modified_base (586)..(586): a, c, t, g, unknown or other
  misc_feature (586)..(586): n is a, c, g, or t
tcagagctcacgtacacgaccggtgctcgatttagagagcgtcacagagaggaagggggaatcagtcccactcaggacacagcatggacatgagggtccccgctcagctcctggggctcctgctgctctggttcccaggtgccaggtgtgacatccagatcgacccagtctccatccctcctgtctgctatcgtgtaganacagtagcaccatcacttggacccgggcgtagtcgaggggcgttacgacaaagtgtcctttgggccttggtttacagtacacgaccaccgaaggggaacgacccctaaaggccgaccgttgactacgtagtcgggtagacctaagttacgtactttaggaacgtaaacggttccggggtaccctaagtacggtaaacggttcgaacggtacggtacgtaacgggttacggtacggtaacgggtaactaagggtactttacccgtaacttaccctaacgttacctaagtccgagggacccggttccgacggtaaccaccggtacctaggaaagtttctttacggtactaacttaacgtttacttacgtcgttactacgtaagtttanacgttactccggttaaccctttacccgtacggtttacccgtttaccggaaaccggttaaaccgggaacgtaaggggttaaccggtaaacgtaaaccgtaacgaaccggttacgggtacgtaccgtacgtaccctaccggttaac

SEQ ID NO: 122797 - DNA, 822 bp, Homo sapiens
  misc_feature: GYAE6OF01A9OUB.47.3.A03.1.454.CMB.1.raw
tcagagctcacgtacacgaccggtgctcgatttagagagcgtcacagagaggaagggggaggaatcacgtcccactcaggacacagcatggacatggacgggtccccgctcagctccgtggggctcctgctgctcttcggtccgaggtcgccgagggttgagaacactaccaagtacgtaccgaaccctacgttccctaccctaacttccccgttcccttggtccgtacggactacgttacggtaggtaacggagaacgtaacggtacgtaccaacctaagtcctaaccggttacgggccgggtacggtacggtacggtacgggttacggtagtaaccgtaaacgttcgttccggtttacggtccgttacggttacgacgaccgaacggaaccacgggtaacgggaacccgtaccgtaacggccgtccgtagtacttacgtaggtacgtcgaacctaacgtacgttaacgttacggaaacggtacgggtccgggtacctaacgtacggagttacgacgtacgggtaacgtacgggtaacggtcgaacgggaaacgtacgttacgtactacgtaccgtaattaccgtactacgggccgtacggtacctaggacccgtaggtacctaaacggccgtttagtccgtaacgtaactttacttacgtacttcggtactaccgtaagtacttacggtactttaccgtacccgttacccgtagttaacccttaccggggaaacgtaacgggtaaacgggtaaacggtaaacggtaacccgttaaataaaccggtaccggtaggtaccgtaaccctgtaacccgttaaac

SEQ ID NO: 122798 - DNA, 863 bp, Homo sapiens
  misc_feature: GYAE6OF01EFF1C.47.3.A03.1.454.CMB.1.raw
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
tcagagctcacgtacacgaccggtgctcgatttagagagcgtcacagagaggaaggggaggaatcacgtcccactcaggacacagcatggacatggacgggtcccccgctcacgcctccgcggggcctcctgctcgctcgtcggttcccaggtcgccgtagggtgtcgacnctccgagtagtccgacccgtgtaccctaccncctcccttcccgtntcctcgtctaactcgttagacggacgtacgacgtaccgtancccaacgttcgccgtacgtcgggtccggacggtacgttacggacggttacgttcgaacgttaacggtccgttcggtttaccgacggttcggttaccacgtacccggtaaggaacccgaccccggtaaagggggaccccgttacccgtaacgggacccgttaccgtacgttacgttaccgttaacggttacggtacccgttacttaccgtaaccggtttaacggttaccgggaaccgttaacgggttcccggtaaacgttaacggtaaccggttaaccgggtaacggtacggggttaccgggttaacggttaaccggggtacggttaacggggtacggttaacggtaaccggtttacctaccgtcctaaaccgtttaccttaccgtccggtacccgtacccgtaccggtcggtaaccctcggtaccgtaacgtaccgtcgttaccgtaacctacgttacgttaccgtacgtttaccgtacctagtacttcgtaagtcgttaccgtaccgttaccgtacgttacccggtacggtacggttaccgtaacggtaacggtaactaacggtaacccgaaacgttcgtaacgtaccgtcggtccgcccgtaag

SEQ ID NO: 122799 - DNA, 904 bp, Homo sapiens
  misc_feature: GYAE6OF01AOIWT.47.3.A03.1.454.CMB.1.raw
  modified_base (899)..(899): a, c, t, g, unknown or other
  misc_feature (899)..(899): n is a, c, g, or t
tcagagctcacgtacacgaccggtgctcgatttagagagcgtcacagagaggaaggggaggaatcagtcccactcaggacacagcatggacatgacgggtccccgctcagctcctggggctctgctgctctcggttccaggtgccgaggtgtagactactccgagactacgacccgtagttcctcctacttccctcccgttgtccgtgacctacttcgttacggtaagggaacacgtagtacgtaccaccgtacttccgtacgttcgggcccggggtggtaaccggtacggtacggggtcgttacggaaccgtaaagtttcggttaccggttttcgggtacccggtttacggtttaccgacggaccgtaacgggaacccgaacccggggaacccgggggttaaacccgggacccccgttaacgggcccggtacccgttacggtacgtttaccgttacgggtttacgggtaacgggtaccttaacgttaacccgttaccggttttaacggaaaccggtaaccgggggtttcccggggtaacccttaacgttaaccgggtaaccggtttaccgggacggtaccggggtaacggtacgggtttacgggtacccgggttaacggtaacggtaacggttacccgtttacctaccgttaccgttaactaacgtcggtacgacccggttaccgggtcccgtagacccgttaacgggcccgtttaaggtaaccgttcgtttacccggtaaccttaaccggttaacttttacgttccgtttaacggtaccctacggttagttaccggtaaacgttcgtttaacccgtccgtttaccggtaccgttacggtacggtaacccgacgggtaactaaggtacgtaacgtaacgacgtagttcgagactccgntaccg

SEQ ID NO: 122800 - DNA, 878 bp, Homo sapiens
  misc_feature: GYAE6OF01BGPO7.47.3.A03.1.454.CMB.1.raw
  modified_base (620)..(620): a, c, t, g, unknown or other
  misc_feature (620)..(620): n is a, c, g, or t
tcagagctcacgtacacgaccggtgctcgatttagagagcgtcacagagaggaagggggaatcagtcccactcaggacacagcatggacatggacgggtcccccgctcagcctccgtggggcctcctgctgtctcgttcggttcccagggtcgccgtaggtgtcgactacgtccgagtactcggaaccctacgtcctaccctaccttccccgtccgttcgtcctacgtactacgtccgttaggaacgacgaaccgagtaccgtaccaccgtacttaccgtacggtccgggaccgggtacgacggtcggacggttcgttagaaccgttagttcgttacggttttccggtccgtttcggtttacaaccggtaccgtaacggaacccgaccggggaaaccgggaccccggtaaccgtacggaccgtccgtacggtacgtacgttacggttcggtactaccgtaacgttacgttaaccgttaggtaaaccgggtacggttccggtaccttaacgttaacgtaccggttacgaacggtccgtaaaggcggtttacgggtacggtacggtaacgtaagttcgttacccgtattacccgtactaaccgttgaccgtacgggtacccncgttaacggtcgacgtacgtacggtaacttgttaccggtaacttacccggtttaactttaccgttaactccggttaacccttaacggttagttaaccgtcccggttacgtttaccgtttacccccggttacgtttaaccggggttccccgaaacccggggtaacggtttaaccggaaaccggtttaaaggtaaaccctaaacggtaccgggttaaagcccggttagtaaccgactaaccggttcgtaaccctttccgg

SEQ ID NO: 122801 - DNA, 1049 bp, Homo sapiens
  misc_feature: GYAE6OF01CIUWJ.47.3.A03.1.454.CMB.1.raw
tcagagctcacgtacacgaccggtgctcgatttagagagcgtcacagagaggaaggggaggaatcagtcccactcaggacacagcagtggacatggacgggtcccccgctcagccttccggtggggcctcctgctcgcttcgtcggttcccgaggtcgccggtaggtgtcgaacctacgtaccgaaggtactaccggacccctagttccctaccctacccttcccgttcccgttcgttaccgttcgtactacgttcggttaggaaacgggacaacgaacggtaccgtaccctaaccgttacttacccgtaccgggttaccgggcccggggtaccggtacgggtcgggtacggggttacgttatacgttaacggttcgtttccggttttcggtccgtttaggttaccgacgtaccgaacgtaaccggaaccgggaacgggaccccggtacccgtaccgccggtctacgtacgttacgtacgttcgggtaacacctttaacgtacgttaaccggtttaggaaaccggttaacgggggttccggtaaccctaagtaccggttaagtccggacggtacggtacggtacggggttaccggttacgggtaaaccggacgtttacggttaaccgccctttacccgttaccgtaacccttacgttaaccgggtacccggaccccggttaccgggtaccctaccggggtaaccttaacccgggtaaccgtttaacgggtaaaccggttttcctaccgttttaaaccgtaccgttttaaaccgtttacttacccgggtttaacctaccgtttaacccgtaagggtttccgttaaccggtttacccgttaccccggtttaacccccgggttttaccgggttacccccgggtttaaaccgggttaaacccccggggtaaaccgggggttaaaacccgggtttaaaggggtaaaaccccggttaaggtaaaaaccccccgtttaaacgggttaaccggtttacccgggggttaacggttaaccccggtacccggttcccgttaacccccgttaaacccgggg

SEQ ID NO: 122802 - DNA, 810 bp, Homo sapiens
  misc_feature: GYAE6OF01BCYPU.47.3.A03.1.454.CMB.1.raw
  modified_base (188)..(188): a, c, t, g, unknown or other
  misc_feature (188)..(188): n is a, c, g, or t
tcagagctcacgtacacgaccggtgctcgatttagagagcgtcacagagaggaagggggaatcagtcccactcaggacacagcatggacatgagggtccccgctcagctcctggggctcctgctgctctggttcccaggtgccaggtgtgacatccagatcgacccagtctccatcctccctgtctancatctggtaggacgactaggactacaccattctacgttcgggcccgggacgtacggttcggaacggggcgttacggactaaattcggtcgtttcggccgtttggtttaccgagtacgaacgaaccgtaaccggaacggggaaccggtacccccgtaaggcccggtaccgtacgtacttacggtacgttgggtcgtaccgtacttaaccgttacgtttcggtaaccggtaaacgggtccgggggttaacccctacggttaccggtaaagggtttacccggacgggtaccgggtacggtaacggggttacgggtacggttaggggtaaccgtaagggtaaccgttttaccggaaccctttacgtacccttacgtaacgtaccgaccggtacggtaccggcggtaaccgtaccgaccggttaagacgttactttcggtactaacgtaactttacgtacgttctaccgtacgtattaacgttagtcgttaacccgttccgttacccggttaggttacccggttacggaacccggtaaaccgggtacggtaaaacgggtaccggtaaaagttaacccgggaaagttacccggtagggttacgtaccgaccgtccgtaacccgttacg

SEQ ID NO: 122803 - DNA, 877 bp, Homo sapiens
  misc_feature: GYAE6OF01AND6O.47.3.A03.1.454.CMB.1.raw
  modified_base (149)..(149): a, c, t, g, unknown or other
  misc_feature (149)..(149): n is a, c, g, or t
  modified_base (864)..(864): a, c, t, g, unknown or other
  misc_feature (864)..(864): n is a, c, g, or t
tcagagctcacgtacacgaccggtgctcgatttagagagcgtcacagagaggaagggggaatcagtcccactcaggacacagcatggacatgagggtcccccgctcagctccgtggggcctcctgctgccttcgtcggttcccaggtcnccagatgtacgaccacccagactaccgaccctagtccctaccctacctccccttcccgtcgttccgtctacctaagttccgttagggtaacgggtacgaaccgtaacgggtaccgttacccaaccctacttaccgtaccgttccggacccggtaggtacgacgtacgacggtactagttaacgacttaaacgtttaagtttaagttggtactacgaacgacgtaaaccggaacggaaacggaacccgtacccctacgtccttaccgtacgtaccttacgtacgtactacctacgttacgttaacgtaacgttaacgggaaccgtaccggtacctacgtaccgggtagtaccggtaagggtacgggtaacggtaggtacggtaacggtacgggtaactacggttacccttactacccgttccaacccgaccgtagtaccgtaacgtccgttaacgtaccgtaccgaaccgtttaacggtacgtttaaccgtttaacgtttaccgaaaccctttaccgttaaccctttacgtacccggttaaacgaaccggttaaccggtttaaccccgggttaacccgttacccgttaaccggtttacccggtaacccgggaccggggtaaacccgtaaccgttaccgtacggaaccctaacggtaacccggtaggtaccgttcggaccgtcccttaaggaaccccgtttcgttaccgtccgtttnttcccgtaacccc

SEQ ID NO: 122804 - DNA, 778 bp, Homo sapiens
  misc_feature: GYAE6OF01ERJST.47.3.A03.1.454.CMB.1.raw
  modified_base (157)..(157): a, c, t, g, unknown or other
  misc_feature (157)..(157): n is a, c, g, or t
tcagagctcacgtacacgaccggtgctcgatttagagagcgtcacagagaggaaggggaggtctcagagaggagccttagccctggacctcccaaggcctttccacgttggtgatcagcactgacgcacagaggactcaccagtggagttgggctgngtcgttggttttccttgttgctattagttagaaggtgtcagtgtgaggtgcagcgtgggtggagggtcggggggacgaccgtggtaccgacggtccggtcgggggtccctggacgtacgtcctccgtgtcgccgacgtccttcgtcggtacttcctaacttccgtacgtacggttaacgaaccgttaacgaccgaacgttaccgcgttaccggtcccggggtacccgtaaccgtaaggtttccggaccgtaacgggtaacccgttacccgtcggttaacggtaacggttcgggttaccttacgtttacgttcggtcgtttacggttgggtccgtacgacccgtacgtaacgtactacggtgccttacgggctaccggggtcgacggggtacccgacgttaccacccgtactccgtacccgaaaagtcggaaaactgggaacctaacgtaaccttccttagttacctaacttcgaaaacttcgaaccttacgtaccgtacggtaccgggtagtaacccggggacgtaccgggtaggttcgttaacgtttacggtaaggtacggtaaaaggtccgtaaacggtacttacgggtaacggttaacggggtaaaccgttaacgggg

SEQ ID NO: 122805 - DNA, 761 bp, Homo sapiens
  misc_feature: GYAE6OF01BB64T.47.3.A03.1.454.CMB.1.raw
  modified_base (217)..(217): a, c, t, g, unknown or other
  misc_feature (217)..(217): n is a, c, g, or t
tcagagctcacgtacacgaccggtgctcgatttagagagcgtcacagagaggaagggggaatcagtcccactcaggacacagcatggacatgagggtccccgctcagctccgtggggctcctgctgctcgtggttcccaggtcgccagggtgtgacactccgagatcgaccctagttcctccactcccttccctgtctgctagtcgtaggtacgganaacagacgtaccacctatcctacgttccggccgggcgtacggtccggtaggggtcgttcgactaagttcgtcgtttcggcgttggtttcgagacgacgaccgaccggacggaaccgcccgtagcccgtcgtacgtactcgtacgtggtacgacgtaattaccgtacgtttacgacgtaacggtccggtaccctagtacgtaacgggttccgaggtacggtacgtaggttaccggtacggtacgggtaacgtaggtaccgtttacctacttccgtaacctaacggttaccgtaacggaccgggtcccggtaccgtacgtacccgtaccggttaacccgtaaggttaacgtacccgtttcgtaacggttaaccttacgttttacgtaccttcggtacccttaaggtacgttacgttgttacggttaccgtttacccgttacccggtcgttacccgggttaccgaaccggttaaccgggaacgtaagggtacgtaaaccgtacggtaaaccgtcggttaggtaccgagtcccgtacgtaaccgttcg

SEQ ID NO: 122806 - DNA, 302 bp, Homo sapiens
  misc_feature: GYAE6OF01C8LBN.47.3.A03.1.454.CMB.1.raw
  modified_base (266)..(266): a, c, t, g, unknown or other
  misc_feature (266)..(266): n is a, c, g, or t
  modified_base (269)..(302): a, c, t, g, unknown or other
  misc_feature (269)..(302): n is a, c, g, or t
tcagagctcacgtacacgaccggtgctcgatttagagagcgtcacagagttcactctcactatcagcggcctgcagcctgaagattctgcaacttattactgtctccagtatgatgccttaccctcggactttccggaccgaagggaccaagggtaggaaaatccgaaaacgaactggtggctgcaccatctgttcttcactccttcccgacctatctgactacgtgacgtctctggacgcgggcgtcggacgaacgggcacgtanagnnnnnnnnnnnnnnnnnnnnnnnnnnnnnnnnnn

SEQ ID NO: 122807 - DNA, 239 bp, Homo sapiens
  misc_feature: GYAE6OF02FHR9L.47.3.A03.1.454.CMB.1.raw
  modified_base (238)..(239): a, c, t, g, unknown or other
  misc_feature (238)..(239): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggacttcggccaagggaccaaggtggaaatcaaacgaactgtggctgcaccatctgtcttcatcttccgccatctgatacgtgagctctgagcgggctggcaaggcgcatagnn

SEQ ID NO: 122808 - DNA, 247 bp, Homo sapiens
  misc_feature: GYAE6OF02GK13Y.47.3.A03.1.454.CMB.1.raw
  modified_base (239)..(247): a, c, t, g, unknown or other
  misc_feature (239)..(247): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttccgccatctgatacgtgagctctgagcgggctggcaaggcgcatagnnnnnnnnn

SEQ ID NO: 122809 - DNA, 248 bp, Homo sapiens
  misc_feature: GYAE6OF02HZGFR.47.3.A03.1.454.CMB.1.raw
  modified_base (240)..(248): a, c, t, g, unknown or other
  misc_feature (240)..(248): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgccatctgatacgtgagctctgagcgggctggcaaggcgcatagnnnnnnnnn

SEQ ID NO: 122810 - DNA, 243 bp, Homo sapiens
  misc_feature: GYAE6OF02FPQ71.47.3.A03.1.454.CMB.1.raw
  modified_base (239)..(243): a, c, t, g, unknown or other
  misc_feature (239)..(243): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttccgccatctgatacgtgagctctgagcgggctggcaaggcgcatagnnnnn

SEQ ID NO: 122811 - DNA, 547 bp, Homo sapiens
  misc_feature: GYAE6OF02FXNJY.47.3.A03.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (414)..(414): a, c, t, g, unknown or other
  misc_feature (414)..(414): n is a, c, g, or t
tcagagctcacgtacacgaccggtgctcgatttagagagcgtcacagaggagaagggggaatcagtcccactcaggacacagcatcggacatgagggtccccgctcagctcctggggctcctgctgctctggttcccaggtgccaggtgtgacatccagatgacccagtctccatcctccctgtctgcatctgtagganacagagtcaccatcacttgccgggngagtcagggcttgcaatgcttggcctggtttcagcagacaccgagggacgcccctaagcgcctgatcgtatggtgcatactactttgactaaaggtcggggtcccagtcgtaaggttcgaggcggctaggtaggtcgtgggacagtacgtcactctcactatcgagcggcctgctagcctagactattcntactacttattctcgtactacctagttatgtatcgtaccttaccgtacggttacctttacgggaccgaacgggtaccgtaagggtacggtaaactacgtaaacgtactggtacggactcggacctaccgtacg

SEQ ID NO: 122812 - DNA, 265 bp, Homo sapiens
  misc_feature: GYAE6OF02HJLOH.47.3.A03.1.454.CMB.1.raw
  modified_base (221)..(221): a, c, t, g, unknown or other
  misc_feature (221)..(221): n is a, c, g, or t
  modified_base (247)..(265): a, c, t, g, unknown or other
  misc_feature (247)..(265): n is a, c, g, or t
tcagagctcacgtacacgaccggtgctcgatttagagagcgtcacaggagttcactctcactatcagcggcctgcagccctgaagattctgcaacttattactgtctccagtatgatgcttaccctcggactttcggccaagggaccaaggtggaaatcaaacgaactgtggctgcaccatcgtagtcttcattccttcccgcatctgatacgtgagtctntgagcgggctggcgaaggcgacatgnnnnnnnnnnnnnnnnnnn

SEQ ID NO: 122813 - DNA, 261 bp, Homo sapiens
  misc_feature: GYAE6OF02IPM5M.47.3.A03.1.454.CMB.1.raw
  modified_base (245)..(261): a, c, t, g, unknown or other
  misc_feature (245)..(261): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggacttttcggccaaagggaccaaaggtggaaatcaaaacgaactgtggctgcaccatctgtcttcatcttcccgccatctgatacgtgagctctgagcgggctggcaaaggcgcatagnnnnnnnnnnnnnnnnn

SEQ ID NO: 122814 - DNA, 246 bp, Homo sapiens
  misc_feature: GYAE6OF02GYVMV.47.3.A03.1.454.CMB.1.raw
  modified_base (235)..(246): a, c, t, g, unknown or other
  misc_feature (235)..(246): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatcttcccgcatctgatacgtgagctctgagcggctggcaagcgcatnnnnnnnnnnnn

SEQ ID NO: 122815 - DNA, 577 bp, Homo sapiens
  misc_feature: GYAE6OF02G6O9L.47.3.A03.1.454.CMB.1.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
tcagagctcacgtacacgaccggtgctcgatttagagagcgtcacgatctctcttgggggcaggagtcagacccagtcaggacacagcatggacatgagggtccccgctcagctcctggggctctgttgctctggttcccaggttccagatgcgacatccagatgacccagtctccatcttctgtgtctgcttctgtaggagacagagtcaccatcacttgtcgggcagtcaggtattagcaactggtagcctggtatcaacagaaccaggaacgcccctaactcctcatctctactgcactccactttgacaaaggtcgggtcccatcgaaggttcagcgcagtgatcgnggacagtntttacactctacactagtcagcagctcgcacgtccgtaggtaacgttagttttacggaaactttagtttattacgttacaaacgtaacgggttaacctacggtttacccgtcctaccgtaccgtttccgggacggtaggggtacccgaagggtacgggaagaatacgggtaaaacggacgtttaggaggtacgtacgtaccgtacgtacttcgtacgg

SEQ ID NO: 122816 - DNA, 606 bp, Homo sapiens
  misc_feature: GYAE6OF02HK34Y.47.3.A03.1.454.CMB.1.raw
  modified_base (293)..(293): a, c, t, g, unknown or other
  misc_feature (293)..(293): n is a, c, g, or t
tcagagctcacgtacacgaccggtgctcgatttagagagcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgtcttctggtaggagacagagtaccaccatcacttgtcgggcgagtcgaagggtattagcaacgttggttagcctggtatcaaacaagaaaccgagggaaacncccctaacctcctcactctctactgctactccactttgctaaaggtcgggtaccctagtacgaaggttcaggtcgcgagtggatcgacgggacagtatttcgaccttctacctactactactcgacagtcccgtgacctacgcttaggtaatacgttttaggaactttagttactgtacgaaacgttagggtaacctaccggtttaccaccgtccgttacccgtacgggtacggaacgggtaccggagggttacggaagtacggtaaggaaacgtacgtaggtcgtacgtcgaccgaacctagttccgttacg

SEQ ID NO: 122817 - DNA, 830 bp, Homo sapiens
  misc_feature: GYAE6OF02FW44J.47.3.A03.1.454.CMB.1.raw
tcagagctcacgtacacgaccggtgctcgatttagagagcgtcacagagagtaagggggaggaatcagtcccactcaggacacagcatggacatgagggtccccgcgtcagctcctggggctcctgcctgctctggttcccaggtgccgaggtgtgacatccagatgacccagtctccatcctcctgtctgcactcgtgtaggagacagagtcaccatcacttgccggtcgacggacgtcgagggtcgttggaactaaagttcgttacgtttcggtccgtttcggtttccacggtacaacggtaaccaccggaagggggtaacccgaccccgtaaggccggtacccgtacggtaacttaccttaaggttcgggtacgtaccgttaactttaccgttaccgtttcggaaccggtaaaggggtttcccggggtaccctagttaccgttaacgggtttccgacggtaccggacgtaagggttacggtacgtacggggaactacggtaccgttcctaaccgtctacctaacgtacgtaccgacggtccggtccgtagaccggtacgtaccgtaagaacgttactttacgtacgtaaccgttaaaccttttaacgttaccgttcgttaccgtaaccttaaggtttaacgtacgtaaccgtttccgttaaccccgtttaccccgggtaccggtttaaccggtttacccggggaacccgggtaaaaccgggggttaaccccggtaaaacgggggttaaccgtaaaacccggttaaccggtaaaaacccggttacccggtttacgggtaaccgggttacccgtaccggtaaacccccg

SEQ ID NO: 122818 - DNA, 649 bp, Homo sapiens
  misc_feature: GYAE6OF02HAGAH.47.3.A03.1.454.CMB.1.raw
  modified_base (205)..(205): a, c, t, g, unknown or other
  misc_feature (205)..(205): n is a, c, g, or t
tcagagctcacgtacacgaccggtgctcgatttagagagcgtcacagaggagaaggggaggaatcagtcccactcaggacacagcatggacatgagggtccccgctcagctcctggggctcctgctgctctggttcccaggtgccgaggtgtgacatccagatcgacccagtcctccatccctccctgtctgcatctggtagganacagagtccaccatcacttcggccgggcagtcgaggggcgttggacaagtgctttggcctggtttcagcagacaccgagggaacggccctaggccgcgtgactcgtagtgtgctatactacgtttgacgaaaggtcgggtacccagttaccggtaaggttccgaggccggtacgaggttacgggtcggtacggggacgtaggttacgtacgtaccttcctactactatacgacggccgtccgtacgacctacgtcgtaacgagttacttacgtacgtacttaaacctttacgttaccttcgtaccttaccgtaagttcttacgttacgttccgtaccttacccgtacggttacccggttacggtaaccggtaaccgggacggttaacggtaacggtaaactaaccggtaacgtacggtaggttacggtcctacggtacctaccg

SEQ ID NO: 122819 - DNA, 817 bp, Homo sapiens
  misc_feature: GYAE6OF02INR40.47.3.A03.1.454.CMB.1.raw
tcagagctcacgtacacgaccggtgctcgatttagagagcgtcacagaggagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttggccgggcagtcgaggggtcgttgcaaatgtctttggccttggtttcagcagacacgagggaacgcccctaagccgcctgatctagtggtgcatactacgtttcgacgtaaaggtcgggggtccctaagttaccgtaaacgggtttaccgacggaccgggtaccgtaagggttaacggggttccggtacgggggaaacgtacgggtaacggtttccgtaaccgtttaccgttacgtaaccgttaacgttccgaaaccgggtccgggtacccgttacggaccgtaaccggtacccgttaagggtaaaacgggttaccttttaccgtaaccgggttaacccttaaaaccgtttttaacctttaaccgttacggtttaccccgttaacccgtaagggtttaacttacgggttaacttaccgggttaccccttttaaacccccgggttaccgggtttaacccgtttttacccgggggaacccggtaaaaccgggggttaaacccggtaaacggggttaacgggtaaaaaccgttaaccggtaaaaaccggttaacgggttacgggtaccgggttaaccggtccggacccgttaacccgttaacgg

SEQ ID NO: 122820 - DNA, 707 bp, Homo sapiens
  misc_feature: GYAE6OF02F8LJI.47.3.A03.1.454.CMB.1.raw
  modified_base (141)..(141): a, c, t, g, unknown or other
  misc_feature (141)..(141): n is a, c, g, or t
  modified_base (387)..(387): a, c, t, g, unknown or other
  misc_feature (387)..(387): n is a, c, g, or t
  modified_base (443)..(443): a, c, t, g, unknown or other
  misc_feature (443)..(443): n is a, c, g, or t
  modified_base (575)..(575): a, c, t, g, unknown or other
  misc_feature (575)..(575): n is a, c, g, or t
  modified_base (699)..(699): a, c, t, g, unknown or other
  misc_feature (699)..(699): n is a, c, g, or t
tcagagctcacgtacacgaccggtgctcgatttagagagcgtcacaggagagaaggggaatcagtcccactcaggacacagcatggacatgacgggtccccgctcagctccgtgggctcctgctgctctggttcccaggtnccaggtgtgacactccgagactcgacccgagtcctccactcccttcctggtctgctattcgtaggtacggagacacggtatccaaccgattacctaaccggttcggccggagtacggttccgaggggtccgtttaggacctaaagtcggttacgtttcggaccgttcggtttccgaacgtcgacgtaccgaacggtacggggaccgtaccccgtaaggccgtccgtacgactcgtacgttcgggtnacctaacttaccgtaacgttgacgtaaacggttcggtaccaagttcgtaacggtcngccggaacgtacgtacggtacgcggttacaacggtacgttaccactccgtacctaacgttagacggtaccggtcgtaccgttgaaccggtccgactacggttaacgtacttcgacgttaacgtaacttttcncgttactcggttaccaagttcgtacttacgtcccttaaccgtccgttacgtcgttacccgaggtaaccgggtaactaggtaacgaaccttacggaacgttccgtggtacccgtagacccggttnaaccttcg

SEQ ID NO: 122821 - DNA, 807 bp, Homo sapiens
  misc_feature: GYAE6OF02F1485.47.3.A03.1.454.CMB.1.raw
  modified_base (165)..(165): a, c, t, g, unknown or other
  misc_feature (165)..(165): n is a, c, g, or t
tcagagctcacgtacacgaccggtgctcgatttagagagcgtcacagagaggaaggggaatcagtcccactcaggacacagcatggacatggagggtccccgctcagctcctggggctcctgctgctctggttcccaggtgccaggtgtgacatccagatgaccngtctcactccctcctgtctgcatctaggtaggagacagacgtcaccatcgacgttcggccgggacgtagtcgaggggtcgttagactaaagttcggtcgtttcggtccttggtttcaggtacagaacaaccggaagggaaccggtacccctaacggccgtacccgtggacttccgtaagttggtacggtacctaacttaacctacgtttacgaacgtaaaacggggttccggggtaccctaacgttacgtaacggtttcgaacgggtccggtacgaagggttacggtacgggtacggggtaactacggttaacgttacccgtacgtttacctactaaccgttacgtaacgtccggggtaccggtccttacgggtacccgacgggtaccccgttaaggaagtttaccgttacgtacggtaacccttaacgttttaacgttaaccgttcgttacccgtagtaaaccgtttagtcgttaaccgttaccgttcccctttaaccccgggttcgggtttaccctttacccggggtaacccggtaaccgggttaaacggtaaacgggttaacggtaaaacccgttaacggtaaaacccggtacggttacggtaccgggtacgtaccgggtaaccctaccgtttaaccgg

SEQ ID NO: 122822 - DNA, 266 bp, Homo sapiens
  misc_feature: GYAE6OF02GZA1R.47.3.A03.1.454.CMB.1.raw
  modified_base (247)..(266): a, c, t, g, unknown or other
  misc_feature (247)..(266): n is a, c, g, or t
tcagagctcacgtacacgaccggtgctcgatttagagagcgtcacagagttcactctcactatcagcggcctgcagcctgaagattctgcaacttattactgtctccagtatgatgccttaccctcggtactttcggccaaaggggaccaaggtggaaatcaaacgaactgtggctgcaccatctgtcttcatcttcccgcatctgatacgtgagctgtgaggcgggctggacaaggccgacatagnnnnnnnnnnnnnnnnnnnn

SEQ ID NO: 122823 - DNA, 254 bp, Homo sapiens
  misc_feature: GYAE6OF02FO6CI.47.3.A03.1.454.CMB.1.raw
  modified_base (244)..(254): a, c, t, g, unknown or other
  misc_feature (244)..(254): n is a, c, g, or t
tcagagctcacgtacacgaccggtgctcgatttagagagcgtcacagagttcactctcactatcagcggcctgcagcctgaagattctgcaacttattactgtctccagtatgatgcttaccctcggactttcggccaagggaccaaggtggaaatcaaacgaactgtggctgcaccatctgtcttcatccttcccgccatctgactacgtgagtctctgacgcgggctaggcaaggtcgcatnnnnnnnnnnn

SEQ ID NO: 122824 - DNA, 287 bp, Homo sapiens
  misc_feature: GYAE6OF02GXV7L.47.3.A03.1.454.CMB.1.raw
  modified_base (256)..(256): a, c, t, g, unknown or other
  misc_feature (256)..(256): n is a, c, g, or t
  modified_base (259)..(287): a, c, t, g, unknown or other
  misc_feature (259)..(287): n is a, c, g, or t
tcagagctcacgtacacgaccggtgctcgatttagagagcgtcacagagttcactctcactatcagcggccctgcagcctagaagattctgcaacttattactgtctccagtatgatgccttaccctcggtactttccggaccgaagggtacccaagggtggaaactacgaaacgaactgtggactgccaccatctgtctcacttcctcccgcctatcctagactacgtgactctctggaggcggctggacaggcnatnnnnnnnnnnnnnnnnnnnnnnnnnnnnn

SEQ ID NO: 122825 - DNA, 728 bp, Homo sapiens
  misc_feature: GYAE6OF02FV8IP.47.3.A03.1.454.CMB.1.raw
tcagagctcacgtacacgaccggtgctcgatttagagagcgtcacagagaggaaggggaggaatcacgtcccactcaggacacagcatggacatgacgggtccccgctcagcctccgtggggctcctgctgctctggtcccaggtcgcctaggtgtgactatccagactcgacctagtcctccactcctcctgtctcgcattcgtggtaaggagacgagacgtaccaactactcctacgttcggccggcgtacggtcgacggggtcttcgaacgtaattcgtcgttggccttggttcagcagaccacggacggacgacccgtaggccgtcgtacgactacgtagtcgacgtctaactacttacgttacgaacggtaacggttcggacctaggtactacggtagcgacggtacgaggtacgtcggtaggtactacggttacgtactaccgtactacgtacgttacgtcgtaccgggccgtacgccgtacggtaccgtattacggtaaccttcgttaccgtacccgggttaattttaacccggtttaacgttaccgttccggttaaccgtacccgttaaaggtttccgttagtacccgtttcccggttaaaccgtttcccgtacgggtttacccggttaccggaaccgggttaaggtaaaccccgggtaggttaacgaaaacccgttcgtaaacgttacgggtccggtaacttccgtacgacccttacgg

SEQ ID NO: 122826 - DNA, 753 bp, Homo sapiens
  misc_feature: GYAE6OF02IPOI5.47.3.A03.1.454.CMB.1.raw
  modified_base (177)..(177): a, c, t, g, unknown or other
  misc_feature (177)..(177): n is a, c, g, or t
tcagagctcacgtacacgaccggtgctcgatttagagagcgtcacagaggagaaggggaggaatcagtcccactcaggacacagcatggacatgacgggtccccgctcagctccgtggggctcctgctgctctggctctcaggtgccagatgtcgacaccctagactcgaccatccncctatcccgtcctgtcctgctatcgtgtaggacgacaacgtcgtacacctatcctaacgttggccggacgtagtccgaggtacctatacggacttaaacgttacttacggtcctaggtactacgaagacgtaaacggtaaacccgaggggttaaacgttaccgtaacgtccttaccgtagtaaccgttactttaaggttacttaacctaaaccgttcgtactttacgacccgttaaggttccccggggaacctttatcccgttacggtacgaccgggttgaactgggtaactaggtaccggtacgggaacttacttacgttacctacgtacctactaacgtaccgtacacgttaccaaccgtacctacggtaacgtaccgtaacgtacgttacgttaccggtttaactttacgtaaccgttacgcgtaccggacgtcgggtaacttacggtacgttaccgtaccgttccgtaccgttcttacccgttacgggttaccgggccggggtaacggtaccgggaagggtaaccggttacggtaaacgttaaacccggaaggttacccgtagggtacccgg

SEQ ID NO: 122827 - DNA, 688 bp, Homo sapiens
  misc_feature: GYAE6OF02JHZMU.47.3.A03.1.454.CMB.1.raw
  modified_base (147)..(147): a, c, t, g, unknown or other
  misc_feature (147)..(147): n is a, c, g, or t
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (425)..(425): a, c, t, g, unknown or other
  misc_feature (425)..(425): n is a, c, g, or t
  modified_base (485)..(485): a, c, t, g, unknown or other
  misc_feature (485)..(485): n is a, c, g, or t
tcagagctcacgtacacgaccggtgctcgatttagagagcgtcacagagagagggaggaatcagtccactcaggacacagcatggacatgagggtccccgctcagctcctggggcctcctgctgctctggtcccaggtcgccaggtntgacatccagatcgaccagtcctcctactcctccctgtctagcactctgtacggnacgagcgtacacctanctactcggccggtcgagttcgaacgggtcgttacgactaaagtcgtgtttcgccgttcggttcgacgtacgacgaacgaccggaacgggtaacggtaccccgtaaggccgtacccgtggtactcgtaacgttgggtacgtactacttactacgttagacggtaaacggttcggtaccctacgtacgtaacggttacgacgacgggtntaacgggtgtacccggtaggtaacgtaggttaactccgtactaccgtactacgtataccncggtacgtccgtcgcgtccgaccgtacgtaagtacgttctagacctacgtttataccgttacttactaccgtacgtatcgttactcggttaacccttcgttacccgtacgttccgggaaccggtaccggaaacggtaccggtaacgtaacggttaaccgtaaacggttctaacgggttccggtaacttaccggcgttaacccg

SEQ ID NO: 122828 - DNA, 275 bp, Homo sapiens
  misc_feature: GYAE6OF01C3STR.15.3.A03.1.454.CMB.1.raw
  modified_base (274)..(275): a, c, t, g, unknown or other
  misc_feature (274)..(275): n is a, c, g, or t
tcagtctacgtagccacgaccggtgctcgatttagagagcgtcacagggtccgggagatcatgagggtgtccttgggtttggggagtgcctacagcccgccgacttctgggccagggaaccctggtcaccgtctcctcagcctccaccaagggcccatcggtcttcccctggcgccctgctccaggagcacctccgagagcacagcggccctgggctgcctggtcaaggactacttccgctacgtagactgagcgggctggcaaggcgcatagnn

SEQ ID NO: 122829 - DNA, 280 bp, Homo sapiens
  misc_feature: GYAE6OF01DXLGB.15.3.A03.1.454.CMB.1.raw
  modified_base (279)..(280): a, c, t, g, unknown or other
  misc_feature (279)..(280): n is a, c, g, or t
tcagtctacgtagccacgaccggtgctcgatttagagagcgtcacaggggtccgggagatcatgagggtgtccttgggttttgggggagtgcctacagccccgccgacttctggggccagggaaccctggtcaccgtctcctcagcctccaccaagggcccatcggtcttcccctggcgccctgctccaggagcacctccgagagcacagcggccctgggctgcctggtcaaggactacttccgctacgtagactgagcgggctggcaaggcgcatagnn

SEQ ID NO: 122830 - DNA, 281 bp, Homo sapiens
  misc_feature: GYAE6OF01C29FG.15.3.A03.1.454.CMB.1.raw
  modified_base (277)..(281): a, c, t, g, unknown or other
  misc_feature (277)..(281): n is a, c, g, or t
tcagtctacgtagccacgaccggtgctcgatttagagagcgtcacaggggtccgggagatcatgagggtgtccttgggtttgggggagtgcctacagccccgccgacttctggggccagggaaccctggtcaccgtctcctcagcctccaccaagggcccatcggtcttcccctggcgccctgctccaggagcacctccgagagcacagcggcctgggctgcctggtcaaggactacttccgctacgtagactgagcgggctggcaaggcgcatagnnnnn

SEQ ID NO: 122831 - DNA, 286 bp, Homo sapiens
  misc_feature: GYAE6OF01EF4L6.15.3.A03.1.454.CMB.1.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
  modified_base (281)..(286): a, c, t, g, unknown or other
  misc_feature (281)..(286): n is a, c, g, or t
tcagtctacgtagccacgaccggtgctcgatttagagagcgtcacaggggtccgggagatcatgagggtgtccttgggttttggggggagtgcctacagccccgccgacttctggggccagggaaccctggtcaccgtctcctcagcctccaccaagggcccatcggtcttcccctggccgccctgctccaggancacctccgagagcacagcggccctgggctgcctggtcaaggactacttccgctacgtagactgagcgggctggcaaggcncatagnnnnnn

SEQ ID NO: 122832 - DNA, 372 bp, Homo sapiens
  misc_feature: GYAE6OF01DV4DW.36.13.B02.1.454.CMB.1.raw
  modified_base (367)..(372): a, c, t, g, unknown or other
  misc_feature (367)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctgggggcacagcggccctgggctgcctggtcaaggactacttccagacagcgtactgagcgggctggcaaggcgcatagnnnnnn

SEQ ID NO: 122833 - DNA, 371 bp, Homo sapiens
  misc_feature: GYAE6OF01AUGAG.36.13.B02.1.454.CMB.1.raw
  modified_base (364)..(371): a, c, t, g, unknown or other
  misc_feature (364)..(371): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctggggcacagcggccctggctgcctggtcaaggctacttccagacagcgtactgagcggctggcaaggcgcatagnnnnnnnn

SEQ ID NO: 122834 - DNA, 374 bp, Homo sapiens
  misc_feature: GYAE6OF01CG0Q8.36.13.B02.1.454.CMB.1.raw
  modified_base (367)..(374): a, c, t, g, unknown or other
  misc_feature (367)..(374): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggctacttccagacagcgtactgagcgggctggcaaggcgcatagnnnnnnnn

SEQ ID NO: 122835 - DNA, 375 bp, Homo sapiens
  misc_feature: GYAE6OF01BUBD4.36.13.B02.1.454.CMB.1.raw
  modified_base (368)..(375): a, c, t, g, unknown or other
  misc_feature (368)..(375): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttccagacagcgtactgagcgggctggcaaggcgcatagnnnnnnnn

SEQ ID NO: 122836 - DNA, 372 bp, Homo sapiens
  misc_feature: GYAE6OF01AF8OE.36.13.B02.1.454.CMB.1.raw
  modified_base (366)..(372): a, c, t, g, unknown or other
  misc_feature (366)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctggctgcctggtcaaggctacttccagacagcgtactgagcgggctggcaaggcgcatagnnnnnnn

SEQ ID NO: 122837 - DNA, 370 bp, Homo sapiens
  misc_feature: GYAE6OF01BJDUL.36.13.B02.1.454.CMB.1.raw
  modified_base (363)..(370): a, c, t, g, unknown or other
  misc_feature (363)..(370): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctgggggcacagcggccctgggctgcctggtcaaggattccagacagcgtactgagcgggctggcaaggcgcatagnnnnnnnn

SEQ ID NO: 122838 - DNA, 372 bp, Homo sapiens
  misc_feature: GYAE6OF01CLJIE.36.13.B02.1.454.CMB.1.raw
  modified_base (366)..(372): a, c, t, g, unknown or other
  misc_feature (366)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctgcgccctgctccaggagcacctctgggggcacagcggccctgggctgcctggtcaaggactacttccagacagcgtactgagcgggctggcaaggcgcatagnnnnnnn

SEQ ID NO: 122839 - DNA, 374 bp, Homo sapiens
  misc_feature: GYAE6OF01EM7MI.36.13.B02.1.454.CMB.1.raw
  modified_base (366)..(374): a, c, t, g, unknown or other
  misc_feature (366)..(374): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggtccagctctgtcccacaccgcagtcacatggcgccatctctcttgcagcttccaccaagggcccatcggtcttcccctggcgccctgctccaggagcacctctgggggcacagcggccctgggctgcctggtcaaggctacttccagacagcgtactgagcgggctggcaaggcgcatagnnnnnnnnn

SEQ ID NO: 122840 - DNA, 372 bp, Homo sapiens
  misc_feature: GYAE6OF01CWFCS.36.13.B02.1.454.CMB.1.raw
  modified_base (366)..(372): a, c, t, g, unknown or other
  misc_feature (366)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcggtcttcccctggcgccctgctccaggacgcacctctgggggcacgagcggccctgggctgcctggtcaaggctacttcagacagcgtactgagcgggctggcaaggcgcatagnnnnnnn

SEQ ID NO: 122841 - DNA, 373 bp, Homo sapiens
  misc_feature: GYAE6OF01C9EEE.36.13.B02.1.454.CMB.1.raw
  modified_base (276)..(276): a, c, t, g, unknown or other
  misc_feature (276)..(276): n is a, c, g, or t
  modified_base (367)..(373): a, c, t, g, unknown or other
  misc_feature (367)..(373): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaaggccatcgtctcccctggcgccctgctccaggancacctcgtgggggcacgagccggccctggctcgcctggtcaaggactacttccagacagcgtactgacgcgggctggcaaggcgacatagnnnnnnn

SEQ ID NO: 122842 - DNA, 374 bp, Homo sapiens
  misc_feature: GYAE6OF01D823S.36.13.B02.1.454.CMB.1.raw
  modified_base (368)..(374): a, c, t, g, unknown or other
  misc_feature (368)..(374): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttccagacagcgtactgagcgggctggcaaggcgcatagnnnnnnn

SEQ ID NO: 122843 - DNA, 409 bp, Homo sapiens
  misc_feature: GYAE6OF01EZN1H.36.13.B02.1.454.CMB.1.raw
  modified_base (372)..(374): a, c, t, g, unknown or other
  misc_feature (372)..(374): n is a, c, g, or t
  modified_base (377)..(409): a, c, t, g, unknown or other
  misc_feature (377)..(409): n is a, c, g, or t
tcagtacgctgtctcacgaccggtgctcgatttagtctagcgactttgggacgtttggggcagggagtgggtctaaggtgacgcaggtggcgccagccaggcgcacacccaaatgcccgtgagcccagacactggaccctgcctggaccctcgtggatagaccaagaaccaaggggcctctgcgccctgggcccgagctctgtcccacaccgcagtcacatcggcgccatctctcttgcagcttccacagggccatcgtctcccctgcgccctgctccaggagcacctctgggggcacaggcggccctgggctgccgtggtcaaggactacttccagacagcgtactgaagcgggctggcaaggcgcatagnnncgnnnnnnnnnnnnnnnnnnnnnnnnnnnnnnnnn

SEQ ID NO: 122844 - DNA, 372 bp, Homo sapiens
  misc_feature: GYAE6OF01E1UTD.36.13.B02.1.454.CMB.1.raw
  modified_base (367)..(372): a, c, t, g, unknown or other
  misc_feature (367)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggctacttccagacagcgtactgagcgggctggcaaggcgcatagnnnnnn

SEQ ID NO: 122845 - DNA, 365 bp, Homo sapiens
  misc_feature: GYAE6OF01BP220.36.13.B02.1.454.CMB.1.raw
  modified_base (361)..(365): a, c, t, g, unknown or other
  misc_feature (361)..(365): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggccatcggtcttcccctgcgccctcctccaagagcacctctggggcacagcgccctggctgcctggtcaaggactacttccagacagcgtactgagcgggctggcaaggcgcatagnnnnn

SEQ ID NO: 122846 - DNA, 371 bp, Homo sapiens
  misc_feature: GYAE6OF01CCXOV.36.13.B02.1.454.CMB.1.raw
  modified_base (366)..(371): a, c, t, g, unknown or other
  misc_feature (366)..(371): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcggtcttcccctggcgccctgctccaggagcacctctgggggcacagcggccctgggctgcctggtcaaggactacttccagacagcgtactgagcgggctggcaaggcgcatagnnnnnn

SEQ ID NO: 122847 - DNA, 375 bp, Homo sapiens; identical to SEQ ID NO: 122835
  misc_feature: GYAE6OF01D828Z.36.13.B02.1.454.CMB.1.raw
  modified_base (368)..(375): a, c, t, g, unknown or other
  misc_feature (368)..(375): n is a, c, g, or t

SEQ ID NO: 122848 - DNA, 369 bp, Homo sapiens
  misc_feature: GYAE6OF01BUJ97.36.13.B02.1.454.CMB.1.raw
  modified_base (265)..(265): a, c, t, g, unknown or other
  misc_feature (265)..(265): n is a, c, g, or t
  modified_base (363)..(369): a, c, t, g, unknown or other
  misc_feature (363)..(369): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggccatcggtcttcccctggcnccctgctccaggagcacctctgggggcacagcgcctggctgcctgtcaaggactacttccagtacagcgtactgagcgggctggcaaggcgcatacgnnnnnnn

SEQ ID NO: 122849 - DNA, 410 bp, Homo sapiens
  misc_feature: GYAE6OF01AL28Y.36.13.B02.1.454.CMB.1.raw
  modified_base (398)..(410): a, c, t, g, unknown or other
  misc_feature (398)..(410): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatccggtcttccccctggccgccctgcctccaggacgccacctcgtgggggccacgacggccgggcccgtggggcctcggcccgttggtaccaagggtacctaccttccagaccagccgtactgaggcgggctggcgaaggcgcatagnnnnnnnnnnnnn

SEQ ID NO: 122850 - DNA, 377 bp, Homo sapiens
  misc_feature: GYAE6OF01AOZFK.36.13.B02.1.454.CMB.1.raw
  modified_base (282)..(282): a, c, t, g, unknown or other
  misc_feature (282)..(282): n is a, c, g, or t
  modified_base (367)..(377): a, c, t, g, unknown or other
  misc_feature (367)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatccggtcttccccctggcgccctgctccaggancacctcgtggggcacacgcggccctgggctgcctggcaaggctacttccagacagcgtactgagcgggctggacaggcgcatagnnnnnnnnnnn

SEQ ID NO: 122851 - DNA, 372 bp, Homo sapiens
  misc_feature: GYAE6OF01B2YE5.36.13.B02.1.454.CMB.1.raw
  modified_base (361)..(361): a, c, t, g, unknown or other
  misc_feature (361)..(361): n is a, c, g, or t
  modified_base (366)..(372): a, c, t, g, unknown or other
  misc_feature (366)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggccatcgtcttcccctggcgccctgctccaggacgcacctcgtgggggcacgagcggccctgggctgcctggtcaaggactacttcagacagcgtactgagcgggctggcaaggcgnatagnnnnnnn

SEQ ID NO: 122852 - DNA, 381 bp, Homo sapiens
  misc_feature: GYAE6OF01C1S31.36.13.B02.1.454.CMB.1.raw
  modified_base (368)..(381): a, c, t, g, unknown or other
  misc_feature (368)..(381): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcggtctcccctggcgccctgctccaggagcacctctgggggcacgacgcggccctgggcctgcctggtcaaggctacttccagacagcgtactgagcgggctggcaaggcgcagtagnnnnnnnnnnnnnn

SEQ ID NO: 122853 - DNA, 373 bp, Homo sapiens
  misc_feature: GYAE6OF01CDF1M.36.13.B02.1.454.CMB.1.raw
  modified_base (368)..(373): a, c, t, g, unknown or other
  misc_feature (368)..(373): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttccagacagcgtactgagcgggctggcaaggcgcatagnnnnnn

SEQ ID NO: 122854 - DNA, 377 bp, Homo sapiens
  misc_feature: GYAE6OF01DSWYN.36.13.B02.1.454.CMB.1.raw
  modified_base (370)..(377): a, c, t, g, unknown or other
  misc_feature (370)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccatctctgtcccacaccgcagtcacatggcgccatctctcttgcagcttccaccaagggccatcggtcttcccctggcgccctgctccaggagcacctcgtgggggcacgaggccggcccgtgggctgcctggtcaaggctacttccagacagcgtactgagcgggctggcaaggcgcatagnnnnnnnn

SEQ ID NO: 122855 - DNA, 376 bp, Homo sapiens
  misc_feature: GYAE6OF01ENXYJ.36.13.B02.1.454.CMB.1.raw
  modified_base (368)..(376): a, c, t, g, unknown or other
  misc_feature (368)..(376): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggccccatcggtcttccccctggcgccctgctccaggagcacctctgggggcacagcggccctgggctgcctggtcaaggctacttccagacagcgtactgagcgggctggcaaggcgcatagnnnnnnnnn

SEQ ID NO: 122856 - DNA, 405 bp, Homo sapiens
  misc_feature: GYAE6OF01CPYNL.36.13.B02.1.454.CMB.1.raw
  modified_base (263)..(263): a, c, t, g, unknown or other
  misc_feature (263)..(263): n is a, c, g, or t
  modified_base (388)..(405): a, c, t, g, unknown or other
  misc_feature (388)..(405): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcgtccttccccnggccgccctgcctccaggcgcacctcgtgggggccacgacgccggcccgtggggcctcggccgttggtccaagggtacctacttccagacagcgtactgacgcgggctggcaaggcgacagtagnnnnnnnnnnnnnnnnnn

SEQ ID NO: 122857 - DNA, 383 bp, Homo sapiens
  misc_feature: GYAE6OF01BBP3Q.36.13.B02.1.454.CMB.1.raw
  modified_base (369)..(369): a, c, t, g, unknown or other
  misc_feature (369)..(369): n is a, c, g, or t
  modified_base (375)..(383): a, c, t, g, unknown or other
  misc_feature (375)..(383): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaggcccatccgtcttcccctggccgccctgctccaggacgcacctctcgggggcacagcggcccgtgggcctcgcctggtcaaggactacttccgacgacacgcgtactgacgcgggctggcaaggcncatagnnnnnnnnn

SEQ ID NO: 122858 - DNA, 460 bp, Homo sapiens
  misc_feature: GYAE6OF01AFU3V.36.13.B02.1.454.CMB.1.raw
  modified_base (434)..(435): a, c, t, g, unknown or other
  misc_feature (434)..(435): n is a, c, g, or t
  modified_base (437)..(460): a, c, t, g, unknown or other
  misc_feature (437)..(460): n is a, c, g, or t
tcagtacgctgtctcacgaccggtgctcgatttagtctagcgactttggctttgggggcagggagtgggctaaggtgacgcaggtggcgccagccaggcgcacaccccaatgcccgtgagccccagacactggaccctgcctggaccctcggtggatagacaagtaaccaaggggcctctgcgccctgggcccagctctgtcccacaccgcagtcacagtggcgccatctctcgttcgcacgccttcccaccgaacgggccccagttccggtccttcccccctggtccgccccttgcctccaggacgccaccgtccgtcggggggccaccgaggccggcccgtcggggccgtcgccgtgggtcgaacgggacctaccgttccacggacaggtccgtaacgtggaacgcggggctgggacaacggcgcgagtagnncnnnnnnnnnnnnnnnnnnnnnnnn

SEQ ID NO: 122859 - DNA, 392 bp, Homo sapiens
  misc_feature: GYAE6OF01C705N.36.13.B02.1.454.CMB.1.raw
  modified_base (384)..(392): a, c, t, g, unknown or other
  misc_feature (384)..(392): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccaccaagggcccatcggtccttccccctggccgccctgcctccaggagccacctcgtcgggggcacgacgccggcccgtgggcctggccctggtcaaggactacttccaagacagcgtactgagcgggctggcaagggcgcatagnnnnnnnnn

SEQ ID NO: 122860 - DNA, 401 bp, Homo sapiens
  misc_feature: GYAE6OF01BGVLT.36.13.B02.1.454.CMB.1.raw
  modified_base (391)..(401): a, c, t, g, unknown or other
  misc_feature (391)..(401): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagccttccaccaagggcccatccggtccttcccctggccgccctgcctccaggacgccaccgtcgtcgggggcacgacgccggcccgtgggcctcgccgtggtacaaggacctacttccgagacagcgtactgaggcgggcgtggacgaaggcgcatagnnnnnnnnnnn

SEQ ID NO: 122861 - DNA, 368 bp, Homo sapiens
  misc_feature: GYAE6OF01BBMHU.36.13.B02.1.454.CMB.1.raw
  modified_base (356)..(368): a, c, t, g, unknown or other
  misc_feature (356)..(368): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaggccatcgtctcccctgcgccctgctccagagcacctctggggcacagcggccctggctgcctggtcaagctactccagacagcgtactgacgcgggctggcaaggcgcagtagnnnnnnnnnnnnn

SEQ ID NO: 122862 - DNA, 368 bp, Homo sapiens
  misc_feature: GYAE6OF01EKIZH.36.13.B02.1.454.CMB.1.raw
  modified_base (327)..(327): a, c, t, g, unknown or other
  misc_feature (327)..(327): n is a, c, g, or t
  modified_base (362)..(368): a, c, t, g, unknown or other
  misc_feature (362)..(368): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggccatcgtctcccctgcgccctgctccaggagcacctctgggggcacagcggccctgggctgcctggtcaaggactacttccngacagcgtactgagcgggctggcaaggcgcatagnnnnnnn

SEQ ID NO: 122863 - DNA, 380 bp, Homo sapiens
  misc_feature: GYAE6OF01EYIZA.36.13.B02.1.454.CMB.1.raw
  modified_base (265)..(265): a, c, t, g, unknown or other
  misc_feature (265)..(265): n is a, c, g, or t
  modified_base (363)..(363): a, c, t, g, unknown or other
  misc_feature (363)..(363): n is a, c, g, or t
  modified_base (369)..(380): a, c, t, g, unknown or other
  misc_feature (369)..(380): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcgtcttcccctggcnccctgctccaggagcaccctctcgggggcacgagccggccctgggctggcctggtcaaggctacttccagacagcgtactgagcgggctggcaaggcncatagnnnnnnnnnnnn

SEQ ID NO: 122864 - DNA, 374 bp, Homo sapiens
  misc_feature: GYAE6OF01DW0QS.36.13.B02.1.454.CMB.1.raw
  modified_base (367)..(374): a, c, t, g, unknown or other
  misc_feature (367)..(374): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtccaacaccgcagtcacatggcgccatctctcttgcagcttccaccaagggcccatcggtcttcccctggcgccctgctccaggagcacctctgggggcacagcggccctgggctgcctggtcaaggactacttccagacagcgtactgagcgggctggcaaggcgcatagnnnnnnnn

SEQ ID NO: 122865 - DNA, 367 bp, Homo sapiens
  misc_feature: GYAE6OF01DDGD5.36.13.B02.1.454.CMB.1.raw
  modified_base (225)..(225): a, c, t, g, unknown or other
  misc_feature (225)..(225): n is a, c, g, or t
  modified_base (272)..(272): a, c, t, g, unknown or other
  misc_feature (272)..(272): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (361)..(367): a, c, t, g, unknown or other
  misc_feature (361)..(367): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctntcttgcagcttccacaaggccatcgtcttcccctgcgccctgctccnggagcacctctgggggcacagccggccctgggctgcctggtcaaggactacttcagacagcgtactgagcgggntggcaaggcgnatgnnnnnnn

SEQ ID NO: 122866 - DNA, 373 bp, Homo sapiens
  misc_feature: GYAE6OF01DQXCQ.36.13.B02.1.454.CMB.1.raw
  modified_base (362)..(373): a, c, t, g, unknown or other
  misc_feature (362)..(373): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgcctgctccagagcactctgggggcacagcggccctgggctgcctggtcaaggctactccagacagcgtactgagcgggctggcaaggcgcatagnnnnnnnnnnnn

SEQ ID NO: 122867 - DNA, 380 bp, Homo sapiens
  misc_feature: GYAE6OF01AVCBX.36.13.B02.1.454.CMB.1.raw
  modified_base (371)..(380): a, c, t, g, unknown or other
  misc_feature (371)..(380): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaaggccatcgtcttcccctggcgccctgctccaggacgcacctcgtgggggcacgacggccggccctgggctgcctggtcaaggactacttccagacagcgtactgacgcgggctggcgaaggcgcatagnnnnnnnnnn

SEQ ID NO: 122868 - DNA, 374 bp, Homo sapiens
  misc_feature: GYAE6OF01EDRM1.36.13.B02.1.454.CMB.1.raw
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
  modified_base (365)..(374): a, c, t, g, unknown or other
  misc_feature (365)..(374): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcgtctcccctgcgccctgctccaggagcacctctgggggcacngcggccctgggctgcctggtcaaggactacttaccngacagcgtaactgagcgggctggcaaggcgcatagnnnnnnnnnn

SEQ ID NO: 122869 - DNA, 379 bp, Homo sapiens
  misc_feature: GYAE6OF01D4PQC.36.13.B02.1.454.CMB.1.raw
  modified_base (369)..(379): a, c, t, g, unknown or other
  misc_feature (369)..(379): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgcctccaggagcacctctgggggcacagcggccctgggctgcctggtcaaggactacttccagacagcgtactgagcgggctggcaaggcgcatagnnnnnnnnnnn

SEQ ID NO: 122870 - DNA, 520 bp, Homo sapiens
  misc_feature: GYAE6OF01BTCWY.36.13.B02.1.454.CMB.1.raw
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (483)..(520): a, c, t, g, unknown or other
  misc_feature (483)..(520): n is a, c, g, or t
tcagtacgctgtctcacgaccggtgctcgatttagtctagcgactttggctttggggcagggagtgggctaaggtgacgcaggtggcgccagccaggcgcacaccccaatgcccgtgagccccagacactggaccctgcctggaccctcgtggatagacaagaaccaaggggccctctgcgccctgggcccagctctgtcccacaccgcagtcacatggcgccatctctcttgcagtcttccaccgaacgggcccatccggtccttcccccgtggccgccctgcctcccgaggacgccacccgtcgtcgggggccaacgacggcccggccccgtggggcctcggtcccgtgggtaccaaacgggtaccttaaccgttcccgaacgtaccgacgtccgtaccgtggaaccgggtcgggaccgttcggaccgtaaacgggccgaccgtaacgtaggcnagcagtgacctnancagctcatgcagnnnnnnnnnnnnnnnnnnnnnnnnnnnnnnnnnnnnnn

SEQ ID NO: 122871 - DNA, 389 bp, Homo sapiens
  misc_feature: GYAE6OF01EQ6MM.36.13.B02.1.454.CMB.1.raw
  modified_base (371)..(389): a, c, t, g, unknown or other
  misc_feature (371)..(389): n is a, c, g, or t
tcagtacgctgtctcacgaccggtgctcgatttagtctagcgactttggctttggggcagggagtgggctaaggtgacgcaggtggcgccagccaggcgcacaccccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatccggtcttccccctggccgccctgcctccaggagcacctctgggggcacagcgccctgggctgcctggtcaaggactacttccagacagcgtactgagcgggctggcaaggcgcatagnnnnnnnnnnnnnnnnnnn

SEQ ID NO: 122872 - DNA, 389 bp, Homo sapiens
  misc_feature: GYAE6OF01BC5T6.36.13.B02.1.454.CMB.1.raw
  modified_base (371)..(389): a, c, t, g, unknown or other
  misc_feature (371)..(389): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggccatcggtcttccccctggccgccctgctccaggacgcacctcgtgggggcacagccggccctgggctgcctggtcaaggctacttccagacagcgtactgacgcgggctggcaaggcgcatagnnnnnnnnnnnnnnnnnnn

SEQ ID NO: 122873 - DNA, 426 bp, Homo sapiens
  misc_feature: GYAE6OF01BHRTR.36.13.B02.1.454.CMB.1.raw
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
  modified_base (381)..(382): a, c, t, g, unknown or other
  misc_feature (381)..(382): n is a, c, g, or t
  modified_base (384)..(426): a, c, t, g, unknown or other
  misc_feature (384)..(426): n is a, c, g, or t
tcagtacgctgtctcacgaccggtgctcgatttagtctagcgactttggctttgggggcagggagtgggctaaggtgacgcagggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggcttcccctggcgccctgctccaggacncacctctcgggggccacagcggccctggctgcctggtcaaggactacttccgagacagcgtaactgacgcgggctggcaaaggcgacactagncgacnncnnnnnnnnnnnnnnnnnnnnnnnnnnnnnnnnnnnnnnnnnnn

SEQ ID NO: 122874 - DNA, 495 bp, Homo sapiens
  misc_feature: GYAE6OF01AJVUY.36.13.B02.1.454.CMB.1.raw
  modified_base (451)..(452): a, c, t, g, unknown or other
  misc_feature (451)..(452): n is a, c, g, or t
  modified_base (454)..(454): a, c, t, g, unknown or other
  misc_feature (454)..(454): n is a, c, g, or t
  modified_base (457)..(495): a, c, t, g, unknown or other
  misc_feature (457)..(495): n is a, c, g, or t
tcagtacgctgtctcacgaccggtgctcgatttagtctagcgactttggctttgggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctcgtccccacacccgcagtcacatcggcgccatcctctcttgcagctccaccagggcccagtccggtccttcccccgtggccgccctgcctccgaggacgccaccgtcggtcgggggccacgacgccggcccgtgggcctcggcccgtgggtaccgaacgggtaccttaccgttacccgaacggaccgacggtaccggtaacgtcgggaaccgggtccggggccgtacgggaccgaaacgggccgacgtagtacggnngncgnnnnnnnnnnnnnnnnnnnnnnnnnnnnnnnnnnnnnnn

SEQ ID NO: 122875 - DNA, 475 bp, Homo sapiens
  misc_feature: GYAE6OF01BY2GC.36.13.B02.1.454.CMB.1.raw
  modified_base (417)..(417): a, c, t, g, unknown or other
  misc_feature (417)..(417): n is a, c, g, or t
  modified_base (429)..(475): a, c, t, g, unknown or other
  misc_feature (429)..(475): n is a, c, g, or t
tcagtacgctgtctcacgaccggtgctcgatttagtctagcgactttggctttgggggcaggggagtgggctaaggtgacgcaggtggcgccagccaggcgcacaccccaatgcccgtgagcccagacactggaccctgcctggaccctcgtggatagacaagaaccaaggggcctctgcgccctgggcccagctctgtcccacaccgcagtcacatggcgccatctctcttgcacgcttcccaaccaagggcccatcggtcttccccctggccgccctgcctccaggacgccaccgtcgtgggggccacgacggccggcccgtcgggcctgcccgtggtacaacggtactacttccgagacagccgtaacgtggacggccgggacgtcgggacgtaaacgggccgactaacgtagngacgatgagctnnnnnnnnnnnnnnnnnnnnnnnnnnnnnnnnnnnnnnnnnnnnnnn

SEQ ID NO: 122876 - DNA, 526 bp, Homo sapiens
  misc_feature: GYAE6OF01BL3C0.36.13.B02.1.454.CMB.1.raw
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (485)..(526): a, c, t, g, unknown or other
  misc_feature (485)..(526): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagccttccaccgaaggcccagtccggtccttccccctggccgccctgcctcccgaggacgccacccgtcggtcgggggccacgacggccgggcccgtcggggcctcggcccgttgggtaccgaaacgggtaccttaaccgttcccgaaaggaccgtacggtaccggttaaccgtcgggaaacgggcccgggggtaccgttacggggaccggaaaacgggggccgaccgtaaggttaacggcncgngcgcgngcnnnnnnnnnnnnnnnnnnnnnnnnnnnnnnnnnnnnnnnnnn

SEQ ID NO: 122877 - DNA, 396 bp, Homo sapiens
  misc_feature: GYAE6OF01CDHH2.36.13.B02.1.454.CMB.1.raw
  modified_base (385)..(396): a, c, t, g, unknown or other
  misc_feature (385)..(396): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttcaccaaggccatcggtcttcccctggcgccctgctccaggagccacctcgtgggggccacgaggccggcccgtggggctcggcccgtggtccaaagggacctacgttccagacagcgtactggagccggggctgggcaaggcgcatagnnnnnnnnnnnn

SEQ ID NO: 122878 - DNA, 383 bp, Homo sapiens
  misc_feature: GYAE6OF01BA8CA.36.13.B02.1.454.CMB.1.raw
  modified_base (369)..(383): a, c, t, g, unknown or other
  misc_feature (369)..(383): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagctccacacgggccatcggtcttcccctggccgccctgctccaggagcacctcgtggggcacagccggccctgggctgcctggtcacggactacttccagtacagcgtacgtgaggcgggctggcaggcgcatagnnnnnnnnnnnnnnn

SEQ ID NO: 122879 - DNA, 381 bp, Homo sapiens
  misc_feature: GYAE6OF01BX394.36.13.B02.1.454.CMB.1.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (369)..(381): a, c, t, g, unknown or other
  misc_feature (369)..(381): n is a, c, g, or t
tcagtacgctgtctcacgaccggtgctcgatttagtctagcgactttggctttggggcgagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctgcnccctgctccaggacncacctctgggggcacgacgcggccctggggcctgcctggtcaaggactactccagacagcgtactgagcgggctggcaggcgcatgnnnnnnnnnnnnn

SEQ ID NO: 122880 - DNA, 434 bp, Homo sapiens
  misc_feature: GYAE6OF01AU55Z.36.13.B02.1.454.CMB.1.raw
  modified_base (401)..(401): a, c, t, g, unknown or other
  misc_feature (401)..(401): n is a, c, g, or t
  modified_base (403)..(410): a, c, t, g, unknown or other
  misc_feature (403)..(410): n is a, c, g, or t
  modified_base (412)..(434): a, c, t, g, unknown or other
  misc_feature (412)..(434): n is a, c, g, or t
tcagtacgctgtctcacgaccggtgctcgatttagtctagcgactttgggctttgggggcagggagtgggctaaggtgacgcaggtggcgcccagcccaggcgcacaccccaatgcccgtgagcccagacactggaccctgcctggaccctgtggatagacaagaaccaaggggcctctgcgccctgggcccagcctctgtcccacaccgcagtcactatcggcgccagtcctctcttgcagccttccaccaaggggccccatccggtcttccccctggccgccctgcctccaggagcaccgtcgtgggggccacgacggcggccctgggtctgccgtggtcaaggactacttaccagacagccgtacgtgacggcgggcgtggacaagggcgcagtacgncnnnnnnnncnnnnnnnnnnnnnnnnnnnnnnn

SEQ ID NO: 122881 - DNA, 584 bp, Homo sapiens
  misc_feature: GYAE6OF01CQXAN.36.13.B02.1.454.CMB.1.raw
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (545)..(546): a, c, t, g, unknown or other
  misc_feature (545)..(546): n is a, c, g, or t
  modified_base (548)..(584): a, c, t, g, unknown or other
  misc_feature (548)..(584): n is a, c, g, or t
tcagtacgctgtctcacgaccggtgctcgatttagtctagcgactttggctttgggggcaggggagtgggctaaggtgacgcaggtggcgccagccaggccgcacaccccaatgccccgtgagcccagacactggaccctgcctggaccctcgtggatagacaagaaccaagggcctctgccgccctggccccagctctcgtcccccacaccgcacgtcacatggccgccatctctcttgcagtccttccaccgtaacggggccctaacgtccggttcccttccccccgtggtccccgtccccgtcggtacccttccgaacgggccgacccgtaacccgttcggggtccggggggaccaccggaaccgggtcccgggtccccgtacgggggtccctccggtacccggttacgggtaccgaaaccgggtaccttaaccccgttacccaacgggtaacccacggtaccggtacgtacggggaacggtcccgggggaccgttcgggaccgtaaacgggcgaaccgtagtaggatcgcgnangntnngnncnnnnnnnnnnnnnnnnnnnnnnnnnnnnnnnnnnnnn

SEQ ID NO: 122882 - DNA, 630 bp, Homo sapiens
  misc_feature: GYAE6OF01CLOLV.36.13.B02.1.454.CMB.1.raw
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (595)..(595): a, c, t, g, unknown or other
  misc_feature (595)..(595): n is a, c, g, or t
  modified_base (603)..(603): a, c, t, g, unknown or other
  misc_feature (603)..(603): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatcctctcttgcagtccttccaccgaacgggccctacgttccggtcccttcccccgtggccgtcccctgcctccgacggtacgcctacccgtccggtacgggggaccaccggacggccggtccccgtcggggtaccctccgggcccgttacggggtacctaaacgggtaaccctttacccgttacccgaacggtaaccgacggtaccgttacgtagggaccgggacccggggtccgttacgggaccggaacggggtccgtaacgtaaccgttacggacgtcgacgcgagcgacgtancgngtacctagntccgagtcctaganacgtcntcgtacncgtcgtacagtagtgctgcgactacgatacgcacgacgngacgcgtnactcgacgtcgacgtcacancngtncg

SEQ ID NO: 122883 - DNA, 648 bp, Homo sapiens
  misc_feature: GYAE6OF01CMZPE.36.13.B02.1.454.CMB.1.raw
  modified_base (231)..(231): a, c, t, g, unknown or other
  misc_feature (231)..(231): n is a, c, g, or t
  modified_base (517)..(517): a, c, t, g, unknown or other
  misc_feature (517)..(517): n is a, c, g, or t
  modified_base (543)..(543): a, c, t, g, unknown or other
  misc_feature (543)..(543): n is a, c, g, or t
  modified_base (615)..(615): a, c, t, g, unknown or other
  misc_feature (615)..(615): n is a, c, g, or t
  modified_base (624)..(624): a, c, t, g, unknown or other
  misc_feature (624)..(624): n is a, c, g, or t
  modified_base (642)..(642): a, c, t, g, unknown or other
  misc_feature (642)..(642): n is a, c, g, or t
tcagtacgctgtctcacgaccggtgctcgatttagtctagcgactttgggtcggtttgggcagggagtgggctaaggtgacgcgaggtggccgccagccaggcgcacacccaatgcccgtgagcccctagaccactggaccctgcctggaccctcgtggactagacaagaccaagggcctctgccgccctggcccagctcgtcgtcccacgaccgcacgtcacatcggccnccatcctctctgccagtccttccgaccgaacgggccctagttccggttcccttacccccgtggcccgtccctacgtcctacccgaacggacgtacccacccgtcggtacggggaccacgtacgtccggtacccgtgggtcctcggaccgtcgggtaccaacgggtaccgttaccgtttccgaacgtaccgtacgtccggtacgtacggaccggtccggggtacgtacgggaccgaacgggtccgacgtacgtacggctcacgtcgtagcgtcgtacgccgtgacgngtacgtgacgtacgtctatacgcgtnaccgtgtcagttgcgtatacggtcctgtacctgtaaccgtgacccgttgaccgttagacttacgcgtacgtnaccggttcncgtacgcaccggttcacngtctcg

SEQ ID NO: 122884 - DNA, 384 bp, Homo sapiens
  misc_feature: GYAE6OF01EQTN3.36.13.B02.1.454.CMB.1.raw
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(267): a, c, t, g, unknown or other
  misc_feature (266)..(267): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (359)..(360): a, c, t, g, unknown or other
  misc_feature (359)..(360): n is a, c, g, or t
  modified_base (363)..(384): a, c, t, g, unknown or other
  misc_feature (363)..(384): n is a, c, g, or t
tcagtacgctgtctcacgaccggtgctcgatttagtctagcgactttggtcgtttggggcagggagtgggctaaggtgacgcaggtggcgccagccaggcgcacacccaatgcccgtgagccccagacactggaccctgacctggaccctcgtgatagacaagaccaggggcctctgcgccctgggcccagctctgtcccacaccgcagtcacatcggcgccatctctcttgccagcctccacgaggccatcgtctcccngcnccnnctcngtancactcngggcagngcggcctgggctgcctggtcagctactccagacngccgtatgagccgggctggcctaagggcacagtcgcnngcnnnnnnnnnnnnnnnnnnnnnn

SEQ ID NO: 122885 - DNA, 405 bp, Homo sapiens
  misc_feature: GYAE6OF01BVDSD.36.13.B02.1.454.CMB.1.raw
  modified_base (394)..(405): a, c, t, g, unknown or other
  misc_feature (394)..(405): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctcgtcccacaccgcagtcacatggcgccatctctcttgcagccttccaccaacgggcccatccggtcttccccctggccgccctgcctccaggacgccacctccgtgggggccacgacgccgggcccgtgggctcggcccgtggtccaagggactacttccagacagcgtactggacgcgggctggcaacggcgcagtagnnnnnnnnnnnn

SEQ ID NO: 122886 - DNA, 381 bp, Homo sapiens
  misc_feature: GYAE6OF01BJJSH.36.13.B02.1.454.CMB.1.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (352)..(352): a, c, t, g, unknown or other
  misc_feature (352)..(352): n is a, c, g, or t
  modified_base (358)..(381): a, c, t, g, unknown or other
  misc_feature (358)..(381): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagccttccaccaaggcccatcggtctcccctggccncctgctccaganccactcgtggggcacngcgccnggctgcctggtcagactactcagacagcgtactgagcgggctggcaaggcncaatgnnnnnnnnnnnnnnnnnnnnnnnn

SEQ ID NO: 122887 - DNA, 485 bp, Homo sapiens
  misc_feature: GYAE6OF01CLOWN.36.13.B02.1.454.CMB.1.raw
  modified_base (224)..(224): a, c, t, g, unknown or other
  misc_feature (224)..(224): n is a, c, g, or t
  modified_base (316)..(316): a, c, t, g, unknown or other
  misc_feature (316)..(316): n is a, c, g, or t
  modified_base (467)..(485): a, c, t, g, unknown or other
  misc_feature (467)..(485): n is a, c, g, or t
tcagtacgctgtctcacgaccggtgctcgatttagtctagcgactttggctttggggcagggagtgggctaaggtgacgcaggtggcgccagccaggcgcacacccaatcgcccgtgagcccagacactggaccctgcctggaccctcgtggatagacaagaaccgaaggggcctctgcgcccgtgggcccagcctctcgtcccacaccgcacgtcacatggcncctatctctacttgcagtccttccaccgaacgggccctacgttccggttcccttacccccgtgggccgtcccttaggcctacccgagggacnccgacccgttcgggcgggggacaccggacggccggtccccgtgggccttacgccggttcgtaacgaacggtaccttaccgtaccgaacggaaccacggtccgtaacggaggaacgggccgggacgtgggaccggaaggttcgactaagtgnnnnnnnnnnnnnnnnnnn

SEQ ID NO: 122888 - DNA, 444 bp, Homo sapiens
  misc_feature: GYAE6OF01DA8ZA.36.13.B02.1.454.CMB.1.raw
  modified_base (221)..(221): a, c, t, g, unknown or other
  misc_feature (221)..(221): n is a, c, g, or t
  modified_base (425)..(444): a, c, t, g, unknown or other
  misc_feature (425)..(444): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgccgccctgggcccagctctcgtcccacaccgcagtcacatcggcncatctctcttgcagtcctccaccgaacgggcccagttccggtccttccccgtggccgccctgcctccgaggacgccaccgtcgtcgggggccacgacggccggtccgtggcctcggccgtggtaccgaaaggtaccttaaccgttccgaacgtacgacgtaccgtacgtggacgggtcggcgtagggactaacggcgatagcgnnnnnnnnnnnnnnnnnnnn

SEQ ID NO: 122889 - DNA, 406 bp, Homo sapiens
  misc_feature: GYAE6OF01C60LI.36.13.B02.1.454.CMB.1.raw
  modified_base (265)..(265): a, c, t, g, unknown or other
  misc_feature (265)..(265): n is a, c, g, or t
  modified_base (392)..(393): a, c, t, g, unknown or other
  misc_feature (392)..(393): n is a, c, g, or t
  modified_base (396)..(406): a, c, t, g, unknown or other
  misc_feature (396)..(406): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaacgggcccatccggtccttccccnggccgccctcgcctccgaggcgcaccgtcgtcggggcacgcgccggcccgtgggctcgccgtggtccaacggtactacttccaagacagtcgtactggacggcgggctaggcgaaggccgtcagtgnnagnnnnnnnnnnn

SEQ ID NO: 122890 - DNA, 470 bp, Homo sapiens
  misc_feature: GYAE6OF01AJTLA.36.13.B02.1.454.CMB.1.raw
  modified_base (440)..(440): a, c, t, g, unknown or other
  misc_feature (440)..(440): n is a, c, g, or t
  modified_base (442)..(470): a, c, t, g, unknown or other
  misc_feature (442)..(470): n is a, c, g, or t
tcagtacgctgtctcacgaccggtgctcgatttagtctagcgactttggctttggggcagggagtgggctaaggtgacgcaggtgacgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagtccttccaccgaacgggccccagtccggtccttcccccgtggccgtcccctgcctccgaggcgccaccgtcggtcgggggccaccgacggcccgggcccgtcgggtccgtcggtccgtcggtacgaacggtacctaccgttaccacgacacggtccgtaacgtggacggccgggtcgtacggaccgaacgggtcgacgacgtagcgngnnnnnnnnnnnnnnnnnnnnnnnnnnnnn

SEQ ID NO: 122891 - DNA, 421 bp, Homo sapiens
  misc_feature: GYAE6OF01DBO6Q.36.13.B02.1.454.CMB.1.raw
  modified_base (283)..(283): a, c, t, g, unknown or other
  misc_feature (283)..(283): n is a, c, g, or t
  modified_base (379)..(379): a, c, t, g, unknown or other
  misc_feature (379)..(379): n is a, c, g, or t
  modified_base (383)..(421): a, c, t, g, unknown or other
  misc_feature (383)..(421): n is a, c, g, or t
tcagtacgctgtctcacgaccggtgctcgatttagtctagcgactttggctttgggggcagggagtgggctaaggtgacgcaggtggcgccagccaggcgcacacccaatgcccgtgagcccagacactggaccctgcctggaccctcgtggatagacaagaaccaaggggcctcgtgcgccctgggcccagctctcgtcccacaccgcagtcacatggcgcatctctcttgcagcttccacaacggccatcggtccttcccctggccgccctgctccaggcncacctcggtgggggcacgacgccggccgtggctcgcgtggtacaaggcttactccaagcagcgtactggacgcggctaggacgaacggcgacgtanacgnnnnnnnnnnnnnnnnnnnnnnnnnnnnnnnnnnnnnnn

SEQ ID NO: 122892 - DNA, 468 bp, Homo sapiens
  misc_feature: GYAE6OF01A5P2U.36.13.B02.1.454.CMB.1.raw
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (427)..(468): a, c, t, g, unknown or other
  misc_feature (427)..(468): n is a, c, g, or t
tcagtacgctgtctcacgaccggtgctcgatttagtctagcgactttggtctttggggcagggagtgggctaaggtgacgcaggtggcgccagccaggcgcacacccaatgcccgtgagcccagacactggaccctgcctggaccctcgtggatagacaagaaccaaggggcctctgccgccctgggccccagctctgtcccacaccgcagtcacatggccgccatctctctgcagcttccacaggcccatcgtctcccctggcnccctagctccaggagccaccgtcgtgggggcaacncggccggccctgggctcgaccgtcggtacaacgggtactacttccgagtacgacggtccgtaacctggaacggccgggggtctacggggaccgtaaagggcgacccgtaagtacgncganctngacnnnnnnnnnnnnnnnnnnnnnnnnnnnnnnnnnnnnnnnnnn

SEQ ID NO: 122893 - DNA, 473 bp, Homo sapiens
  misc_feature: GYAE6OF01AZH43.36.13.B02.1.454.CMB.1.raw
  modified_base (320)..(320): a, c, t, g, unknown or other
  misc_feature (320)..(320): n is a, c, g, or t
  modified_base (448)..(473): a, c, t, g, unknown or other
  misc_feature (448)..(473): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactcggaccctgcctggaccctcgtggatagacaagaaccaaggggcctctcgccgcccgtgggcccagctctcgtcccacacccgcacgtcacagtcggccgcctatcctctcttcgccacgtccttaccgaaccgaacgggccccacgttccggtcccttcccccgtcggcccgccctgccctaccgacggcnccgaccgtcggtcggggccaacgcggcccggccgtcgggccgtcgtccgtcggaccgaacgtaccttactccgacgtacgcgtaccgtacgtggcggcgggtcgtacgggacgacggcacgacgtagnnnnnnnnnnnnnnnnnnnnnnnnnn

SEQ ID NO: 122894 - DNA, 504 bp, Homo sapiens
  misc_feature: GYAE6OF01AFF9B.36.13.B02.1.454.CMB.1.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (452)..(454): a, c, t, g, unknown or other
  misc_feature (452)..(454): n is a, c, g, or t
  modified_base (456)..(456): a, c, t, g, unknown or other
  misc_feature (456)..(456): n is a, c, g, or t
  modified_base (458)..(468): a, c, t, g, unknown or other
  misc_feature (458)..(468): n is a, c, g, or t
  modified_base (470)..(504): a, c, t, g, unknown or other
  misc_feature (470)..(504): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgccgccctgggcccagctctgtcccacaccgcagtcacatggcgccatctctcttgcagcttccaccgaagggccatccgtcttcccccnggccnccctgcctccgaggacgccacccgtcgtgggggcctacgaggccggccccgttgggcctcgcccgtgggttaccaaacgggtccttaccgtttacccgaaggaaccgacggtaccggttaaggacggtccgggggaccttcggggaaccgaaacggggccgaaccgtagttaagggcagagnnnanannnnnnnnnnnannnnnnnnnnnnnnnnnnnnnnnnnnnnnnnnnnn

SEQ ID NO: 122895 - DNA, 468 bp, Homo sapiens
  misc_feature: GYAE6OF01BFBYQ.36.13.B02.1.454.CMB.1.raw
  modified_base (264)..(264): a, c, t, g, unknown or other
  misc_feature (264)..(264): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (427)..(468): a, c, t, g, unknown or other
  misc_feature (427)..(468): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatccggttcctcccgnggcctccctgcctcaggcacctaccgtcggtcgggcacgacggcccgcccggtcggctcggccgttagggtacgaaaggtaccttaccgtccgaacgacgacggtccgtacgaggtacgggccgggtacgtcgggaacgaacgggccgacgtagtagnacngnnnnnnnnnnnnnnnnnnnnnnnnnnnnnnnnnnnnnnnnnn

SEQ ID NO: 122896 - DNA, 509 bp, Homo sapiens
  misc_feature: GYAE6OF01AMIEU.36.13.B02.1.454.CMB.1.raw
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (471)..(509): a, c, t, g, unknown or other
  misc_feature (471)..(509): n is a, c, g, or t
tcagtacgctgtctcacgaccggtgctcgatttagtctagcgactttggctttgggggcaggggagtgggctaaggtgacgcaggtggcgccagccaggcgcacacccaatgcccgtgagccccagacactggaccctgcctggaccctcgtggatagacaagaaccaaggggcctctcgcgcccgtgggcccagcctctcgcccacaccgccagtcacatcggccgccatcttcctcttcgccagtccttaccaaccgacgggcccctatccggttcccttcccccgtcggcctaccccctcccttaccaacggcgtacccaccgttcggcggggcctaccgacggtcccggcccgtcgggccttcggcccgtggtacgaacggtaccttaccgtccgaacgaccgtaccggcgttaccgtaggacggccggnggtacggacgacggcganagtcgntgcancngatcannnnnnnnnnnnnnnnnnnnnnnnnnnnnnnnnnnnnnn

SEQ ID NO: 122897 - DNA, 478 bp, Homo sapiens
  misc_feature: GYAE6OF01ER8ZN.36.13.B02.1.454.CMB.1.raw
  modified_base (269)..(269): a, c, t, g, unknown or other
  misc_feature (269)..(269): n is a, c, g, or t
  modified_base (316)..(316): a, c, t, g, unknown or other
  misc_feature (316)..(316): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(433): a, c, t, g, unknown or other
  misc_feature (432)..(433): n is a, c, g, or t
  modified_base (435)..(440): a, c, t, g, unknown or other
  misc_feature (435)..(440): n is a, c, g, or t
  modified_base (442)..(478): a, c, t, g, unknown or other
  misc_feature (442)..(478): n is a, c, g, or t
tcagtacgctgtctcacgaccggtgctcgatttagtctagcgactttggctttgggggcagggagtgggctaagggtgacgcaggtggcgccagccaggcgcacaccccaatgcccgtgagccccagacactggaccctgcctggaccctcgtggatagacaagaaccaagggcctctgcgccctgggcccagctctgtcccacaccgcagtcacatggcgccatctctccttgcagctccaccaaggcccatccgtctcccctggccnccctgcctccgagacgccacctcgtgggggcacgacggccgggcccnggggcctggccctgggtacaaacgggacctttacttcccgaagtaccaggccgtaacgttggacgggcggggtacgtgggaccgaaacggggcgacaagtacggncngtnancntnnannnnnnannnnnnnnnnnnnnnnnnnnnnnnnnnnnnnnnnnnn

SEQ ID NO: 122898 - DNA, 399 bp, Homo sapiens
  misc_feature: GYAE6OF01BTT0T.36.13.B02.1.454.CMB.1.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (343)..(344): a, c, t, g, unknown or other
  misc_feature (343)..(344): n is a, c, g, or t
  modified_base (352)..(352): a, c, t, g, unknown or other
  misc_feature (352)..(352): n is a, c, g, or t
  modified_base (356)..(361): a, c, t, g, unknown or other
  misc_feature (356)..(361): n is a, c, g, or t
  modified_base (363)..(365): a, c, t, g, unknown or other
  misc_feature (363)..(365): n is a, c, g, or t
  modified_base (367)..(367): a, c, t, g, unknown or other
  misc_feature (367)..(367): n is a, c, g, or t
  modified_base (369)..(370): a, c, t, g, unknown or other
  misc_feature (369)..(370): n is a, c, g, or t
  modified_base (372)..(372): a, c, t, g, unknown or other
  misc_feature (372)..(372): n is a, c, g, or t
  modified_base (375)..(376): a, c, t, g, unknown or other
  misc_feature (375)..(376): n is a, c, g, or t
  modified_base (378)..(399): a, c, t, g, unknown or other
  misc_feature (378)..(399): n is a, c, g, or t
tcagtacgctgtctcacgaccggtgctcgatttagtctagcgactttgggctttggggcagggagtgggctaagggtgacgcaggtggcgccagccaggcgcacacccaaatgccccgtgacgccccagacactggaccctgcctggaccctcgtggatagacaagaaccaaggggcctctgcgccctgggccccaggctctgtcccacaccgcaggtccacatggccgccatctctctgcagcttccaccaggccatcggtctccccngccncctgctcagcncacctcgtggggcangcgccgnggctgctggcaagctntcagacngctacgngagcggnngcaggcantagnnnnnngnnngnanntnatnnannnnnnnnnnnnnnnnnnnnnn

SEQ ID NO: 122899 - DNA, 473 bp, Homo sapiens
  misc_feature: GYAE6OF01CGQXK.36.13.B02.1.454.CMB.1.raw
  modified_base (423)..(473): a, c, t, g, unknown or other
  misc_feature (423)..(473): n is a, c, g, or t
tcagtacgctgtctcacgaccggtgctcgatttagtctagcgacttttggctttggggcagggagtgggctaaggtgacgcaggtggcgccagccaggcgcacacccaatgcccgtgagcccagacactggaccctgcctggaccctcgtggatagacaagaaccgaaggggcctctgcgccctggggcccagctctgtcccacaccgcagtcacatggcgccatctctcttgcagcttccaccgacggcccatccggtcttccccctggccaccctcctccaaagcgccacctcgtgggggccaacgcggccggcccgtgggcctcgcccgtgggtcaacgggtactaccttcccgaagaccaaggtccgttaactcggaaggccggggtcgtgggacctaagggcccgtagaacgtacggnnnnnnnnnnnnnnnnnnnnnnnnnnnnnnnnnnnnnnnnnnnnnnnnnnn

SEQ ID NO: 122900 - DNA, 571 bp, Homo sapiens
  misc_feature: GYAE6OF01CL77Y.36.13.B02.1.454.CMB.1.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (523)..(523): a, c, t, g, unknown or other
  misc_feature (523)..(523): n is a, c, g, or t
  modified_base (533)..(571): a, c, t, g, unknown or other
  misc_feature (533)..(571): n is a, c, g, or t
tcagtacgctgtctcacgaccggtgctcgatttagtctagcgactttggctttgggggcagggagtgggctaaggtgacgcaggtggcgccagccaggcgcacacccaatgcccgtgagcccagacactcggaccctgcctcggaccctcggtggatacgacaaaggaaccgaacggggcctcgtggccgcccgtcgggcccagtcctctccggtacccacgacccgtcacgtcacngtcggccnccacttctccttcgttacgcacgtcctaccgaaccgaaccgggcctacggttccggttcccttcccccggtcggcccgtcccgtacgtccgtacccggaacgggcctaccgacccgttcggggacgggggaccaacggccgggccgggttcccgtcggggtacctcgggtacccggttaggtaccgaaaacgggttacccttaaaccggttccgaacggaaccgtacggtaccgttacggaggtccgggacggtcgacgggacgaacggcagaacgtnactgatgcgnnnnnnnnnnnnnnnnnnnnnnnnnnnnnnnnnnnnnnn

SEQ ID NO: 122901 - DNA, 547 bp, Homo sapiens
  misc_feature: GYAE6OF01EAIC2.36.13.B02.1.454.CMB.1.raw
  modified_base (500)..(500): a, c, t, g, unknown or other
  misc_feature (500)..(500): n is a, c, g, or t
  modified_base (505)..(507): a, c, t, g, unknown or other
  misc_feature (505)..(507): n is a, c, g, or t
  modified_base (509)..(509): a, c, t, g, unknown or other
  misc_feature (509)..(509): n is a, c, g, or t
  modified_base (511)..(547): a, c, t, g, unknown or other
  misc_feature (511)..(547): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccgaaggggcctctgcgccctgggcccagctctgtcccacaccgcagtcacatggcgccatctctcttgctacgtccttaccaccgaacgggcccctagttccggttccctttccccccgtcggcccgccccttgccctacccgaaggacgcctaaccccgtcggtcggggggtccaccggacggcccggggtccccgtggggccgttccggcccgttcggggaactaaaccgggtaacccttaccgttaccccgaaggaccgaaccggccgtttaccgagggaccgggtccggggtaccgtaggggaccgaaacgggtccgaaccgtaagttacggnctagnnngngnnnnnnnnnnnnnnnnnnnnnnnnnnnnnnnnnnnnn

SEQ ID NO: 122902 - DNA, 375 bp, Homo sapiens
  misc_feature: GYAE6OF02JEZ5U.36.13.B02.1.454.CMB.1.raw
  modified_base (365)..(375): a, c, t, g, unknown or other
  misc_feature (365)..(375): n is a, c, g, or t
tcagtacgctgtctcacgaccggtgctcgatttagtctagcgactttggctttgggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggctacttccagacagcgtactgagcggctggcaaggcgcatagnnnnnnnnnnn

SEQ ID NO: 122903 - DNA, 375 bp, Homo sapiens
  misc_feature: GYAE6OF02IQVZW.36.13.B02.1.454.CMB.1.raw
  modified_base (367)..(375): a, c, t, g, unknown or other
  misc_feature (367)..(375): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctgggggcacagcgaccctgggctgcctggtcaaggactacttccagacagcgtactgagcgggctggcaaggcgcatagnnnnnnnnn

SEQ ID NO: 122904 - DNA, 369 bp, Homo sapiens
  misc_feature: GYAE6OF02F5H1B.36.13.B02.1.454.CMB.1.raw
  modified_base (366)..(369): a, c, t, g, unknown or other
  misc_feature (366)..(369): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctggggcacagcggccctgggctgcctggtcaaggactacttccagacagcgtactgagcgggctggcaaggcgcatagnnnn

SEQ ID NO: 122905 - DNA, 371 bp, Homo sapiens
  misc_feature: GYAE6OF02I5NLE.36.13.B02.1.454.CMB.1.raw
  modified_base (365)..(371): a, c, t, g, unknown or other
  misc_feature (365)..(371): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctggggcacagcggccctgggctgcctggtcaaggctacttccagacagcgtactgagcgggctggcaaggcgcatagnnnnnnn

SEQ ID NO: 122906 - DNA, 396 bp, Homo sapiens
  misc_feature: GYAE6OF02IM9XC.36.13.B02.1.454.CMB.1.raw
  modified_base (375)..(396): a, c, t, g, unknown or other
  misc_feature (375)..(396): n is a, c, g, or t
tcagtacgctgtctcacgaccggtgctcgatttagtctagcgactttggcgtttggggcagggagtgggctaaggtgacgcaggtggcgccagccaggcgcacacccaatgccccgtgagccccagacactggaccctgcctggaccctcgtggatagacaagaaacaaggggcctctgcgccctgggcccagcctctgtcccacaccgcagtcacatggcgccatctctcttgcagcttccaccaagggcccatccggtcttccccctggcgccctgctccaggagcacctctcgggggcacagcggccctgggctgcctggtcaaggactacttccgagacagcgtactgagcgggctggcaaggcgcatagnnnnnnnnnnnnnnnnnnnnnn

SEQ ID NO: 122907 - DNA, 377 bp, Homo sapiens
  misc_feature: GYAE6OF02HWGVZ.36.13.B02.1.454.CMB.1.raw
  modified_base (371)..(377): a, c, t, g, unknown or other
  misc_feature (371)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacgaaggcccatcgtccttcccctggccgccctgctccaggagcacctcgtggggcacagccgcccgtgggctcgcctggtacaaggactacttccagacagcgtactgagcgggctggacaaggcgcatagnnnnnnn

SEQ ID NO: 122908 - DNA, 374 bp, Homo sapiens
  misc_feature: GYAE6OF02IHJT1.36.13.B02.1.454.CMB.1.raw
  modified_base (367)..(374): a, c, t, g, unknown or other
  misc_feature (367)..(374): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctgggggcacagcggccctgggctgcctggtcaaggactacttccagacagcgtactgagcgggctggcaaggcgcatagnnnnnnnn

SEQ ID NO: 122909 - DNA, 375 bp, Homo sapiens
  misc_feature: GYAE6OF02IKH0T.36.13.B02.1.454.CMB.1.raw
  modified_base (367)..(375): a, c, t, g, unknown or other
  misc_feature (367)..(375): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggcctgggctgcctggtcaaggactacttccagacagcgtactgagcgggctggcaaggcgcatagnnnnnnnnn

SEQ ID NO: 122910 - DNA, 372 bp, Homo sapiens
  misc_feature: GYAE6OF02HX3ZI.36.13.B02.1.454.CMB.1.raw
  modified_base (368)..(372): a, c, t, g, unknown or other
  misc_feature (368)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttccagacagcgtactgagcgggctggcaaggcgcatagnnnnn

SEQ ID NO: 122911 - DNA, 372 bp, Homo sapiens
  misc_feature: GYAE6OF02IRFGY.36.13.B02.1.454.CMB.1.raw
  modified_base (365)..(372): a, c, t, g, unknown or other
  misc_feature (365)..(372): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctggggcacagcggcctgggctgcctggtcaaggactacttccagacagcgtactgagcgggctggcaaggcgcatagnnnnnnnn

SEQ ID NO: 122912 - DNA, 369 bp, Homo sapiens
  misc_feature: GYAE6OF02I9FFD.36.13.B02.1.454.CMB.1.raw
  modified_base (365)..(369): a, c, t, g, unknown or other
  misc_feature (365)..(369): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggtccagctctgtcccacaccgcagtcacatggcgccatctctcttgcagcttccaccaagggcccatcggtcttccccctggcgccctgctccaggagcacctctggggcacagcgccctgggctgcctggtcaaggctacttccagacagcgtactgagcgggctggcaaggcgcatagnnnnn

SEQ ID NO: 122913 - DNA, 370 bp, Homo sapiens
  misc_feature: GYAE6OF02FGLQW.36.13.B02.1.454.CMB.1.raw
  modified_base (366)..(370): a, c, t, g, unknown or other
  misc_feature (366)..(370): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctggggcacagcggccctgggctgcctggtcaaggctacttccagacagcgtactgagcgggctggcaaggcgcatagnnnnn

SEQ ID NO: 122914 - DNA, 376 bp, Homo sapiens
  misc_feature: GYAE6OF02I2UTM.36.13.B02.1.454.CMB.1.raw
  modified_base (367)..(376): a, c, t, g, unknown or other
  misc_feature (367)..(376): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctggggcacagcggccctgggctgcctggtcaaggactacttccagacagcgtactgagcgggctggcaaggcgcatagnnnnnnnnnn

SEQ ID NO: 122915 - DNA, 378 bp, Homo sapiens
  misc_feature: GYAE6OF02JCTQM.36.13.B02.1.454.CMB.1.raw
  modified_base (369)..(378): a, c, t, g, unknown or other
  misc_feature (369)..(378): n is a, c, g, or t
tcagtacgctgtctcacgaccggtgctcgatttagtctagcgactttggcgtttggggcagggagtgggctaaggtgacgcaggtggcgccagccaggccgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctggggcacagcggccctgggctgcctggtcaaggctacgttccagacagcgtactgagcgggctggcaaggcgcatagnnnnnnnnnn

SEQ ID NO: 122916 - DNA, 377 bp, Homo sapiens
  misc_feature: GYAE6OF02GDAQV.36.13.B02.1.454.CMB.1.raw
  modified_base (281)..(281): a, c, t, g, unknown or other
  misc_feature (281)..(281): n is a, c, g, or t
  modified_base (366)..(377): a, c, t, g, unknown or other
  misc_feature (366)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggancacctctggggcacagcggccctgggctgcctggtcaaggactacttccagacagcgtactgagcgggctggcaaggcgcatagnnnnnnnnnnnn

SEQ ID NO: 122917 - DNA, 372 bp, Homo sapiens; identical to SEQ ID NO: 122844
  misc_feature: GYAE6OF02IY000.36.13.B02.1.454.CMB.1.raw
  modified_base (367)..(372): a, c, t, g, unknown or other
  misc_feature (367)..(372): n is a, c, g, or t

SEQ ID NO: 122918 - DNA, 398 bp, Homo sapiens
  misc_feature: GYAE6OF02HS9E6.36.13.B02.1.454.CMB.1.raw
  modified_base (375)..(398): a, c, t, g, unknown or other
  misc_feature (375)..(398): n is a, c, g, or t
tcagtacgctgtctcacgaccggtgctcgatttagtctagcgactttggcgtttgggggcagggagtgggcgtaaggtgacgcaggtggcgccagccaggcgcacacccaatgcccgtgagcccagacactggaccctggcctggaccctcgtggatagacaagaaccaaggggcctctgcgccctgggcccagctcctgtcccacaccgcagtcacatggcgccatctctcttgcagcttccaccaaggcccatcgtcttcccctggcgccctgctccaggacgcacctctgggggcacagcggccctgggctgcctggtcaaggacctacttccagacagcgtactgacgcgggcgtggacaaggcgcatagnnnnnnnnnnnnnnnnnnnnnnnn

SEQ ID NO: 122919 - DNA, 375 bp, Homo sapiens
  misc_feature: GYAE6OF02GR4X6.36.13.B02.1.454.CMB.1.raw
  modified_base (368)..(375): a, c, t, g, unknown or other
  misc_feature (368)..(375): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgcccctgctccaggagcacctctggggcacagcggccctgggctgcctggtcaaggactacttccagacagcgtactgagcgggctggcaaggcgcatagnnnnnnnn

SEQ ID NO: 122920 - DNA, 373 bp, Homo sapiens
  misc_feature: GYAE6OF02GVLW2.36.13.B02.1.454.CMB.1.raw
  modified_base (218)..(218): a, c, t, g, unknown or other
  misc_feature (218)..(218): n is a, c, g, or t
  modified_base (365)..(373): a, c, t, g, unknown or other
  misc_feature (365)..(373): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcnccatctctcttgcagcttccaccaagggcccatcggtcttcccctggcgccctgctccaggagcacctctggggcacagcggcctgggctgcctggtcaaggactacttccagacagcgtactgagcgggctggcaaggcgcatagnnnnnnnnn

SEQ ID NO: 122921 - DNA, 543 bp, Homo sapiens
  misc_feature: GYAE6OF02HCEMD.36.13.B02.1.454.CMB.1.raw
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(448): a, c, t, g, unknown or other
  misc_feature (447)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(455): a, c, t, g, unknown or other
  misc_feature (454)..(455): n is a, c, g, or t
  modified_base (457)..(458): a, c, t, g, unknown or other
  misc_feature (457)..(458): n is a, c, g, or t
  modified_base (460)..(461): a, c, t, g, unknown or other
  misc_feature (460)..(461): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
tcagtacgctgtctcacgaccggtgctcgatttagtctagcgactttggtcgttttgggggcagggagtcgggctaaggtggacgcaggtggcgccgagccaggcggccacacccaatgccccgtggagccccagacactggaccctggcctcggaccctccgtggatagacaagaaccaaggggaccttctacgcgccctcgggcccacgcctctgtcccacaccgcagtcacatggcgccatctctcttgccgagcttccaccgaacggccatcggtcttccccctggtccgccctggtctccaggacgcgaacctcggtcgggggccacccacgccggccctcggggactcgcctgggtcaagggactaccttccagtacagcggtacgtcgagcgggcgtggcgaaggcgcgagtacgancgngcagctacatcgtacnancnncncncnncnncnntatntntatatntananactatatactacgtactacgtcgtcgtcgcgacggacgacgacgagacgacgtacgtgtcgngnc

SEQ ID NO: 122922 - DNA, 376 bp, Homo sapiens; identical to SEQ ID NO: 122914
  misc_feature: GYAE6OF02FQ3F6.36.13.B02.1.454.CMB.1.raw
  modified_base (367)..(376): a, c, t, g, unknown or other
  misc_feature (367)..(376): n is a, c, g, or t

SEQ ID NO: 122923 - DNA, 441 bp, Homo sapiens
  misc_feature: GYAE6OF02I7N8R.36.13.B02.1.454.CMB.1.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (397)..(397): a, c, t, g, unknown or other
  misc_feature (397)..(397): n is a, c, g, or t
  modified_base (400)..(441): a, c, t, g, unknown or other
  misc_feature (400)..(441): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcncccctgcctccgaggcnccacctcgtcgggcacgcggccgccgtggctcgccgtggtacgaacgtacttacctccagacgacgtcgtactggacggccgggcgtcggacgaagggccacgtagtacgncgnnnnnnnnnnnnnnnnnnnnnnnnnnnnnnnnnnnnnnnnnn

SEQ ID NO: 122924 - DNA, 377 bp, Homo sapiens
  misc_feature: GYAE6OF02H23R4.36.13.B02.1.454.CMB.1.raw
  modified_base (369)..(377): a, c, t, g, unknown or other
  misc_feature (369)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgcccctgctccaggagcacctctgggggcacagcggccctgggctgcctggtcaaggactacttccagacagcgtactgagcgggctggcaaggcgcatagnnnnnnnnn

SEQ ID NO: 122925 - DNA, 378 bp, Homo sapiens
  misc_feature: GYAE6OF02HZ0SU.36.13.B02.1.454.CMB.1.raw
  modified_base (369)..(378): a, c, t, g, unknown or other
  misc_feature (369)..(378): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgcccctgctccaggagcacctctgggggcacagcggccctgggctgcctggtcaaggactacttccagacagcgtactgagcgggctggcaaggcgcatagnnnnnnnnnn

SEQ ID NO: 122926 - DNA, 377 bp, Homo sapiens
  misc_feature: GYAE6OF02GWYPA.36.13.B02.1.454.CMB.1.raw
  modified_base (370)..(377): a, c, t, g, unknown or other
  misc_feature (370)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggacgcacctctgggggcacgagcggccctgggctgcctggtcaaggactacttccagacagcgtactgagcgggctggcaaggcgcatagnnnnnnnn

SEQ ID NO: 122927 - DNA, 403 bp, Homo sapiens
  misc_feature: GYAE6OF02FWR31.36.13.B02.1.454.CMB.1.raw
  modified_base (374)..(403): a, c, t, g, unknown or other
  misc_feature (374)..(403): n is a, c, g, or t
tcagtacgctgtctcacgaccggtgctcgatttagtctagcgactttggcgtttgggggcagggagtgggcgtaacggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttaccccctggcgccctgctccaggagcacctctgggggcacagcggccctgggctgcctggtcaaggactacttccagacagcgtactgacgcgggctggcaaggcgcatagnnnnnnnnnnnnnnnnnnnnnnnnnnnnnn

SEQ ID NO: 122928 - DNA, 405 bp, Homo sapiens
  misc_feature: GYAE6OF02JM5O5.36.13.B02.1.454.CMB.1.raw
  modified_base (378)..(378): a, c, t, g, unknown or other
  misc_feature (378)..(378): n is a, c, g, or t
  modified_base (387)..(405): a, c, t, g, unknown or other
  misc_feature (387)..(405): n is a, c, g, or t
tcagtacgctgtctcacgaccggtgctcgatttagtctagcgactttggctttgggcagggagtgggctaaggtgacgcaggtggcgccagccaggcgcacacccaatgcccgtgagcccagacactggaccctgcctggaccctcgtggatagacaagaccaagggcctctgcgccctgggcccagctctgtcccacaccgcagtcacatggcgccatctctcttgcagcttccaccaagggcccatcgtcttcccctgcgccctgctcccaggagcaccctctcgggggccacgagccggtccccgtgggcctggccctcgggtcaacgggcctactccctagacctagcgtactgaggtcggctggcaaggccgnaacgtagcnnnnnnnnnnnnnnnnnnn

SEQ ID NO: 122929 - DNA, 375 bp, Homo sapiens; identical to SEQ ID NO: 122835
  misc_feature: GYAE6OF02FL8TK.36.13.B02.1.454.CMB.1.raw
  modified_base (368)..(375): a, c, t, g, unknown or other
  misc_feature (368)..(375): n is a, c, g, or t

SEQ ID NO: 122930 - DNA, 365 bp, Homo sapiens
  misc_feature: GYAE6OF02FHYUO.36.13.B02.1.454.CMB.1.raw
  modified_base (359)..(365): a, c, t, g, unknown or other
  misc_feature (359)..(365): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaggcccatcggtctcccctggcgccctgctccaggagcacctcgtgggcacagcgcctggctgcctggtcaaggctacttccagacagcgtactgagcgggctggcaaggcgcatagnnnnnnn

SEQ ID NO: 122931 - DNA, 379 bp, Homo sapiens
  misc_feature: GYAE6OF02I2A1J.36.13.B02.1.454.CMB.1.raw
  modified_base (218)..(218): a, c, t, g, unknown or other
  misc_feature (218)..(218): n is a, c, g, or t
  modified_base (369)..(379): a, c, t, g, unknown or other
  misc_feature (369)..(379): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcnccatctctcttgcagcttccaccaagggcccatccggtcttccccctggcgcccctgctccaggagcacctctggggcacagcggccctgggcctgcctggtcaaggactacttcagacagcgtactgagcgggctggcaaggcgcatagnnnnnnnnnnn

SEQ ID NO: 122932 - DNA, 379 bp, Homo sapiens
  misc_feature: GYAE6OF02HF5OZ.36.13.B02.1.454.CMB.1.raw
  modified_base (372)..(379): a, c, t, g, unknown or other
  misc_feature (372)..(379): n is a, c, g, or t
tcagtacgctgtctcacgaccggtgctcgatttagtctagcgactttggctttggggcagggagtgggctaaggtgacgcaggtgacgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatccggtcttccccctggccgccctgctccaggacgcacctctgggggcacgagcggccctgggctgcctggtcaaggctacttccagacagcgtactgagcgggctggacaaggcgcatagnnnnnnnn

SEQ ID NO: 122933 - DNA, 386 bp, Homo sapiens
  misc_feature: GYAE6OF02FGJHS.36.13.B02.1.454.CMB.1.raw
  modified_base (364)..(364): a, c, t, g, unknown or other
  misc_feature (364)..(364): n is a, c, g, or t
  modified_base (370)..(386): a, c, t, g, unknown or other
  misc_feature (370)..(386): n is a, c, g, or t
tcagtacgctgtctcacgaccggtgctcgatttagtctagcgactttggctttggggcagggagtgggcctaaggtgacgcaggtggcgccagccaggcgcacacccaatgcccgtgagcccagacactggaccctgcctggaccctcgtggattagacaagaaccaaggggtcctctgcgccctgggcccagctctgtcccacaccgcaggtcacatggcgcccagtctctcttgccagcttccaccaagggcccatcggtcttccccctggcgccctgctccaggagcacctctggggcacagcgcctgggctgcctggtcaggctacttccagacagcgtactgagcgggctggcaaggcncatagnnnnnnnnnnnnnnnnn

SEQ ID NO: 122934 - DNA, 385 bp, Homo sapiens
  misc_feature: GYAE6OF02IT1N9.36.13.B02.1.454.CMB.1.raw
  modified_base (220)..(220): a, c, t, g, unknown or other
  misc_feature (220)..(220): n is a, c, g, or t
  modified_base (372)..(385): a, c, t, g, unknown or other
  misc_feature (372)..(385): n is a, c, g, or t
tcagtacgctgtctcacgaccggtgctcgatttagtctagcgactttggctttggggcagggagtgggctaaggtgacgcaggtggcgccagccaggcgcacacccaatgcccgtgaccgcccagacactggaccctgcctggaccctcgtggatagacaagaaccaaggggcctctgcgccctgggcccagctctgtcccacaccgcagtcacatggcnccatctctcttgcagcttccaccaagggcccatcggtcttccccctggcgcccctgctccaggagcacctctgggggcacagcggccctgggctgcctggtcaaggctacttccagacagcgtactgacgcgggctggcgaaggcgcatagnnnnnnnnnnnnnn

SEQ ID NO: 122935 - DNA, 431 bp, Homo sapiens
  misc_feature: GYAE6OF02FHGPF.36.13.B02.1.454.CMB.1.raw
  modified_base (270)..(270): a, c, t, g, unknown or other
  misc_feature (270)..(270): n is a, c, g, or t
  modified_base (379)..(379): a, c, t, g, unknown or other
  misc_feature (379)..(379): n is a, c, g, or t
  modified_base (381)..(383): a, c, t, g, unknown or other
  misc_feature (381)..(383): n is a, c, g, or t
  modified_base (385)..(390): a, c, t, g, unknown or other
  misc_feature (385)..(390): n is a, c, g, or t
  modified_base (392)..(431): a, c, t, g, unknown or other
  misc_feature (392)..(431): n is a, c, g, or t
tcagtacgctgtctcacgaccggtgctcgatttagtctagcgactttggcgtttggggcagggagtcgggctaaggtgacgcaggtggcgccagccaggccgcacacccaatgcccgtgagcccagacactggaccctgcctggaccctcgtggatagacaagaaccaaggggcctctgccgccctgggcccagctctgtcccacaccgcagtcgacatgggcgccatctcgtccttgcagcttccaccaagggcccatcggtctccccnggcgccctgctccaggagcacctctgggggcacgagcggcccctgggctggcctggtcaagggctacgttccagacacgcgtactgagcgggctggcaaggcgcatagntnnngnnnnnngnnnnnnnnnnnnnnnnnnnnnnnnnnnnnnnnnnnnnnnn

SEQ ID NO: 122936 - DNA, 536 bp, Homo sapiens
  misc_feature: GYAE6OF02J2YJ9.36.13.B02.1.454.CMB.1.raw
  modified_base (230)..(230): a, c, t, g, unknown or other
  misc_feature (230)..(230): n is a, c, g, or t
  modified_base (283)..(283): a, c, t, g, unknown or other
  misc_feature (283)..(283): n is a, c, g, or t
  modified_base (447)..(448): a, c, t, g, unknown or other
  misc_feature (447)..(448): n is a, c, g, or t
  modified_base (450)..(450): a, c, t, g, unknown or other
  misc_feature (450)..(450): n is a, c, g, or t
  modified_base (452)..(453): a, c, t, g, unknown or other
  misc_feature (452)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
  modified_base (510)..(514): a, c, t, g, unknown or other
  misc_feature (510)..(514): n is a, c, g, or t
  modified_base (517)..(517): a, c, t, g, unknown or other
  misc_feature (517)..(517): n is a, c, g, or t
  modified_base (519)..(520): a, c, t, g, unknown or other
  misc_feature (519)..(520): n is a, c, g, or t
  modified_base (522)..(524): a, c, t, g, unknown or other
  misc_feature (522)..(524): n is a, c, g, or t
  modified_base (526)..(526): a, c, t, g, unknown or other
  misc_feature (526)..(526): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
  modified_base (534)..(535): a, c, t, g, unknown or other
  misc_feature (534)..(535): n is a, c, g, or t
tcagtacgctgtctcacgaccggtgctcgatttagtctagcgactttggtcgttttgggggcagggagtcggctaaggtgacgcaggtggcgccagccaggcggccacacccaatcgcccgtggacgcccagacactggaccctgcctggaccctcgtggatagacaagaaccaaggggcctctcgcgccctgggcccagtctctcgtcccacaccgcagtcacatggcnccatctctcttgcacgcttccacaaggccagttccggtccttccccgtggccnccctgcctaccgaggacgcctaccgtcggtacggggcaccacggccggtacccgtggggtcctggcccgtagggtaccaacgggtaccttaaccgttccgagaccacggtcgtacgtcggacggccggtcgtcggacgaacggccgactatacgcactcgcacnncncnncncncgcgngcnanctntactactctcncncncactctactctctcgtcgcgacngnnnnngcncnncnnncncnnncncnnc

SEQ ID NO: 122937 - DNA, 387 bp, Homo sapiens
  misc_feature: GYAE6OF02HCNGL.36.13.B02.1.454.CMB.1.raw
  modified_base (372)..(387): a, c, t, g, unknown or other
  misc_feature (372)..(387): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcgtcttcccctggcgccctgcctccaggagcacctctgggggcacgacgccggccctgggctgcctggtcaaggacctacttccagacagcgtactgagcgggctggcaaggcgcatacgnnnnnnnnnnnnnnnn

SEQ ID NO: 122938 - DNA, 390 bp, Homo sapiens
  misc_feature: GYAE6OF02JZO89.36.13.B02.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (324)..(324): a, c, t, g, unknown or other
  misc_feature (324)..(324): n is a, c, g, or t
  modified_base (361)..(390): a, c, t, g, unknown or other
  misc_feature (361)..(390): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctctgcancttccacaggcccatcggtctcccctgcgcctgctccaggancacctctggggcacagcgcctggctcgcctggtcaagctacttccagacngcgtactgagcggctggcaaggcgacacgtagcagcnnnnnnnnnnnnnnnnnnnnnnnnnnnnnn

SEQ ID NO: 122939 - DNA, 373 bp, Homo sapiens
  misc_feature: GYAE6OF02HMSKA.36.13.B02.1.454.CMB.1.raw
  modified_base (280)..(280): a, c, t, g, unknown or other
  misc_feature (280)..(280): n is a, c, g, or t
  modified_base (362)..(373): a, c, t, g, unknown or other
  misc_feature (362)..(373): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccaccaagggcccatcgtcttcccctggcgcctgctccaggancacctctggggcacagcgccctggctgcctggcaaggactacttccagacagcgtactgagcggctggcaaggcgacatagnnnnnnnnnnnn

SEQ ID NO: 122940 - DNA, 478 bp, Homo sapiens
  misc_feature: GYAE6OF02FFKMN.36.13.B02.1.454.CMB.1.raw
  modified_base (302)..(302): a, c, t, g, unknown or other
  misc_feature (302)..(302): n is a, c, g, or t
  modified_base (440)..(440): a, c, t, g, unknown or other
  misc_feature (440)..(440): n is a, c, g, or t
  modified_base (443)..(444): a, c, t, g, unknown or other
  misc_feature (443)..(444): n is a, c, g, or t
  modified_base (446)..(478): a, c, t, g, unknown or other
  misc_feature (446)..(478): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagaccactggaccctgcctggaccctcgtggatagacaagaaccagggcctctgccgcccgtgggcccagcctctcgtcccacaccgcacgtcacgagtcggccgccctatcctcttccttcgcctacgtccttacccgaaccgaccgggtccctacgtccgttcccctccccgtggcccncccgtgcctaccggacggcgtccaccggttcgggcggccacggcggtccgccgtggctcggcgtaggacacggtacctacgtccgacgacgtacgtcgtacggaggccgggccggtgtacggaacgacggtcacgtancgnntnnnnnnnnnnnnnnnnnnnnnnnnnnnnnnnnn

SEQ ID NO: 122941 - DNA, 386 bp, Homo sapiens
  misc_feature: GYAE6OF02FKH8F.36.13.B02.1.454.CMB.1.raw
  modified_base (367)..(386): a, c, t, g, unknown or other
  misc_feature (367)..(386): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctgcgccctgctccaggacgcacctctggggcacagcggccctgggctgcctggtcagggactacttccagacagcgtactgagcgggctggcaaggcgcatagnnnnnnnnnnnnnnnnnnnn

SEQ ID NO: 122942 - DNA, 377 bp, Homo sapiens
  misc_feature: GYAE6OF02FVSUL.36.13.B02.1.454.CMB.1.raw
  modified_base (367)..(377): a, c, t, g, unknown or other
  misc_feature (367)..(377): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgcctgggcccagctctgtcccacaccgcagtcacatggcgccatctctcttgcagcttccaccaagggcccatcggtcttccccctggcgccctgctccaggagcacctctggggcacagccggccctgggctggcctggtcaaggctacttccagacagcgtactgagcgggctggcaaggcgcatagnnnnnnnnnnn

SEQ ID NO: 122943 - DNA, 376 bp, Homo sapiens
  misc_feature: GYAE6OF02GVMYN.36.13.B02.1.454.CMB.1.raw
  modified_base (366)..(376): a, c, t, g, unknown or other
  misc_feature (366)..(376): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaagggcccatcggtcttccccctggcgccctgctccaggagcacctctggggcacagcggccctgggctgcctggtcaaggctacttccagacagcgtactggagcgggctggcaaggcgcatagnnnnnnnnnnn

SEQ ID NO: 122944 - DNA, 376 bp, Homo sapiens
  misc_feature: GYAE6OF02HY7GG.36.13.B02.1.454.CMB.1.raw
  modified_base (364)..(376): a, c, t, g, unknown or other
  misc_feature (364)..(376): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccagagcacctctggggcacagcggccctgggctgcctggtcaggactacttccagacagcgtactgagcggctggcaaggcgcatagnnnnnnnnnnnnn

SEQ ID NO: 122945 - DNA, 399 bp, Homo sapiens
  misc_feature: GYAE6OF02FUSCE.36.13.B02.1.454.CMB.1.raw
  modified_base (371)..(399): a, c, t, g, unknown or other
  misc_feature (371)..(399): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgcccctgctccaggagcacctctgggggcacagcggcctgggctgcctggtcaaggactacttccagacagcgtactgagcgggctgggcaaggcgcaagtagnnnnnnnnnnnnnnnnnnnnnnnnnnnnn

SEQ ID NO: 122946 - DNA, 393 bp, Homo sapiens
  misc_feature: GYAE6OF02HKHDF.36.13.B02.1.454.CMB.1.raw
  modified_base (382)..(383): a, c, t, g, unknown or other
  misc_feature (382)..(383): n is a, c, g, or t
  modified_base (385)..(393): a, c, t, g, unknown or other
  misc_feature (385)..(393): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggccccagctctgtcccacaccgcagtcacatggcgccatctctcttgcagcttccaccaagggcccatcgtcttccccctggcgccctgctccaggagccacctcgtgggggcacacggccggccctgggcctggccgtggtccaacgggacctacttcccagacagcgtactgagcgggctggcaaggcgcagtagnngnnnnnnnnn

SEQ ID NO: 122947 - DNA, 420 bp, Homo sapiens
  misc_feature: GYAE6OF02FLPBO.36.13.B02.1.454.CMB.1.raw
  modified_base (282)..(282): a, c, t, g, unknown or other
  misc_feature (282)..(282): n is a, c, g, or t
  modified_base (374)..(374): a, c, t, g, unknown or other
  misc_feature (374)..(374): n is a, c, g, or t
  modified_base (378)..(420): a, c, t, g, unknown or other
  misc_feature (378)..(420): n is a, c, g, or t
tcagtacgctgtctcacgaccggtgctcgatttagtctagcgactttggctttgggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccaccaagggcccatccggtcttccccctggcgccctgctcccnggagcacctctggggcacagcggccctggctgcctggtcaacggactacttccagacagctacgtgacgcggctggcgaaggcgcagtagcngcannnnnnnnnnnnnnnnnnnnnnnnnnnnnnnnnnnnnnnnnnn

SEQ ID NO: 122948 - DNA, 516 bp, Homo sapiens
  misc_feature: GYAE6OF02I5H3W.36.13.B02.1.454.CMB.1.raw
  modified_base (281)..(281): a, c, t, g, unknown or other
  misc_feature (281)..(281): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (462)..(463): a, c, t, g, unknown or other
  misc_feature (462)..(463): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (482)..(495): a, c, t, g, unknown or other
  misc_feature (482)..(495): n is a, c, g, or t
  modified_base (497)..(516): a, c, t, g, unknown or other
  misc_feature (497)..(516): n is a, c, g, or t
tcagtacgctgtctcacgaccggtgctcgatttagtctagcgactttggtctttggggtcgagggagtgggcgtaaggtgacgcgaggtggcgccagccaggcgcacacccaatgcccgtgagcccagacactggaccctgcctggaccctcgtggatagacaagaaccaaggggcctctgcgccctgggcccagctctgtcccacacccgcagtcacatggccgccatcctctcttgcagccttccaccgaaggcccagtccggtccttccccctggccncccctcgctaccacggagccaccttcgcgggggccacgacgccggcccgtggccgtcgcccgtcggttccgaaacgggacctaccgtttacccgaacggtaccgacgacggttacctacgggaacgcggggcctgggacgaacggggcgaccgaagttaccgagngacgntgcgngngngnngngngngcncgncngcncnnnnnnnnnnnnnngnnnnnnnnnnnnnnnnnnnn

SEQ ID NO: 122949 - DNA, 478 bp, Homo sapiens
  misc_feature: GYAE6OF02H36QZ.36.13.B02.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (435)..(435): a, c, t, g, unknown or other
  misc_feature (435)..(435): n is a, c, g, or t
  modified_base (437)..(438): a, c, t, g, unknown or other
  misc_feature (437)..(438): n is a, c, g, or t
  modified_base (440)..(478): a, c, t, g, unknown or other
  misc_feature (440)..(478): n is a, c, g, or t
tcagtacgctgtctcacgaccggtgctcgatttagtctagcgactttggctttggggcaggggagtgggctaaggtgacgcaggtggcgccagccaggcgcacacccaatgcccgtgagcccagacactggaccctgcctggacccctcgtggatagacaagaaccaaggggcctctgcgccctgggcccagctctgtcccanacccgcagtcacatggcnccatctctcttgcagtcttccaaccgaagggtcccagtccggtccttcccccgnggcccgccctgcctccaagggcnccaccctgtcgggggcaccgagcccggtccctcgggctcgcccgttggcgtaaacggctacgttacccgagaccgaggtaccgtaactcggaacggccggggcgttgggaccgaaacgggccgacgtaaagtcggancnngnnnnnnnnnnnnnnnnnnnnnnnnnnnnnnnnnnnnnnn

SEQ ID NO: 122950 - DNA, 390 bp, Homo sapiens
  misc_feature: GYAE6OF02FTU8Q.36.13.B02.1.454.CMB.1.raw
  modified_base (373)..(390): a, c, t, g, unknown or other
  misc_feature (373)..(390): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccggacactggaccctgcctggaccctcgtggatagacaagaaccaaggggcctctgcgccctgggcccagctctgtcccacaccgcagtcacatggcgccatctctcttgcagcttccaccaagggcccatccggtcttccccctggcgccctgctccaggacgcacctcgtgggggcacgagccggccctgggctggcctggtcaaggactacttccagacagcgtactgagcgggctgcgaggcgcatagnnnnnnnnnnnnnnnnnn

SEQ ID NO: 122951 - DNA, 444 bp, Homo sapiens
  misc_feature: GYAE6OF02G7XMT.36.13.B02.1.454.CMB.1.raw
  modified_base (275)..(275): a, c, t, g, unknown or other
  misc_feature (275)..(275): n is a, c, g, or t
  modified_base (402)..(402): a, c, t, g, unknown or other
  misc_feature (402)..(402): n is a, c, g, or t
  modified_base (406)..(444): a, c, t, g, unknown or other
  misc_feature (406)..(444): n is a, c, g, or t
tcagtacgctgtctcacgaccggtgctcgatttagtctagcgactttggctttggggcagggagtgggctaaggtgacgcaggtggcgccagccaggcgcacaccccaatgcccgtgagccccagacactggaccctgcctggaccctcgtggatagacaagaaccaaggggcctctgcgccctgggcccagctctgtcccacaccgcagtcacatggcgccatctctcttgcagcttccaccaacgggccccatccggtccttccccctcggcncccctgcctcccaggacgccacctcgtgggggcacgacgcggcccgtgggcctgccgtggtcaaggactacttccagacagccgtaactgaacggccgggctcgggcgaacgggtccgacaagtagntagnnnnnnnnnnnnnnnnnnnnnnnnnnnnnnnnnnnnnnn

SEQ ID NO: 122952 - DNA, 385 bp, Homo sapiens
  misc_feature: GYAE6OF02GGUGX.36.13.B02.1.454.CMB.1.raw
  modified_base (264)..(264): a, c, t, g, unknown or other
  misc_feature (264)..(264): n is a, c, g, or t
  modified_base (368)..(385): a, c, t, g, unknown or other
  misc_feature (368)..(385): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccacaagggccatcggtctcccctgcncctgctccaggagcacctctggggcacgagcggccctgggctcgcctggtcaaggctacttccagacagcgtactgacgcggcgtggcgaacggcgcatacggnnnnnnnnnnnnnnnnnn

SEQ ID NO: 122953 - DNA, 387 bp, Homo sapiens
  misc_feature: GYAE6OF02FLT37.36.13.B02.1.454.CMB.1.raw
  modified_base (368)..(368): a, c, t, g, unknown or other
  misc_feature (368)..(368): n is a, c, g, or t
  modified_base (375)..(387): a, c, t, g, unknown or other
  misc_feature (375)..(387): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggcgcacctcgtggggccacgagccggcccttgggctgcctggtcaaggactaccttccagacagcgtactgagcgggcgtggcaaggcncgatagnnnnnnnnnnnnn

SEQ ID NO: 122954 - DNA, 448 bp, Homo sapiens
  misc_feature: GYAE6OF02HPGZ6.36.13.B02.1.454.CMB.1.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (397)..(398): a, c, t, g, unknown or other
  misc_feature (397)..(398): n is a, c, g, or t
  modified_base (402)..(448): a, c, t, g, unknown or other
  misc_feature (402)..(448): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgccctggaccctcgtggatagacaagaaccaagggggcctctgcgcccctgggcccagctctgtcccacacccgcagtcacatggcnccatctctcttgcagccttccaccaaggcccatccgtcttcccccgtggccnccctgctccgaggagcacctcgtcggggcacgacggccgcccgtgggctcgccgtggtcaacggacttactccagacagcgtactgacgcgggctggacgaaggtccgcgaactggactcgannacgnnnnnnnnnnnnnnnnnnnnnnnnnnnnnnnnnnnnnnnnnnnnnnn

SEQ ID NO: 122955 - DNA, 429 bp, Homo sapiens
  misc_feature: GYAE6OF02F13S8.36.13.B02.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (384)..(386): a, c, t, g, unknown or other
  misc_feature (384)..(386): n is a, c, g, or t
  modified_base (388)..(429): a, c, t, g, unknown or other
  misc_feature (388)..(429): n is a, c, g, or t
tcagtacgctgtctcacgaccggtgctcgatttagtctagcgactttggtcgtttgggggcaggggagtgggcgtaaggtgacgcaggtggcgccagccaggcgcacacccaatgccccgtgagcccagacactggaccctggcctggaccctcgtggatagacaagaaccaaggggcctctgcgccctgggcccagctcngtcccacaccgcagtcacatggcgccatctctcttgcctagcttccacaacgggcccagtcgtccttcccctggccgcctgcctccgaggacgcacctcgnggggcacgcgcgcctggctgcctgcaaggactactccagacagcgtacgtgacgcgggntcggacgaacggcgacagtacgnnngnnnnnnnnnnnnnnnnnnnnnnnnnnnnnnnnnnnnnnnnnn

SEQ ID NO: 122956 - DNA, 521 bp, Homo sapiens
  misc_feature: GYAE6OF02HF9H8.36.13.B02.1.454.CMB.1.raw
  modified_base (479)..(480): a, c, t, g, unknown or other
  misc_feature (479)..(480): n is a, c, g, or t
  modified_base (484)..(521): a, c, t, g, unknown or other
  misc_feature (484)..(521): n is a, c, g, or t
tcagtacgctgtctcacgaccggtgctcgatttagtctagcgactttggctttggggcagggagtgggctaaggtgacgcaggtggcgccagccaggcgcacaccccaatgcccgtgagccccagacactggaccctgccctggacccctcggtggatagacaaagaaccgaaggggcctctgccgcccgtcgggcccagcctctcgtcccacaccgcacgtcacagtcggccgccattcctccttcttcgcacgtccttacccaaccgaacgggcccctagttcccggtcccttcccccgtggcccgcccctcgcctccgaggacgcctaccgtcggtcgggggccacgacggcccggtcccgtcggggcctcggtccgttcgggtaacgaacggtaccttaccttccgaacgtaccgacggtccgttacgtagggacgggtccgggacggtcgggacgaacggccgactaagtacgnngacnnnnnnnnnnnnnnnnnnnnnnnnnnnnnnnnnnnnnn

SEQ ID NO: 122957 - DNA, 412 bp, Homo sapiens
  misc_feature: GYAE6OF02FS0RL.36.13.B02.1.454.CMB.1.raw
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (389)..(390): a, c, t, g, unknown or other
  misc_feature (389)..(390): n is a, c, g, or t
  modified_base (392)..(394): a, c, t, g, unknown or other
  misc_feature (392)..(394): n is a, c, g, or t
  modified_base (396)..(412): a, c, t, g, unknown or other
  misc_feature (396)..(412): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagccccagacactggaccctgcctggaccctcgtggatagacaagaaccaaggggcctctgcgccctgggcccagctctgtcccacaccgcagtcacatggcnccatctctcttgcagccttccaccaagggccccagtccggtccttcccccnggccgccctgcctccaggcncaccgtcgnggggcacgcgccggccgtgggctcgcctggcaaggtactacctcgacgacacgtcgtactggacgcgggctggacgaaggccgacatagnngnnngnnnnnnnnnnnnnnnnn

SEQ ID NO: 122958 - DNA, 437 bp, Homo sapiens
  misc_feature: GYAE6OF02IBBH0.36.13.B02.1.454.CMB.1.raw
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (405)..(437): a, c, t, g, unknown or other
  misc_feature (405)..(437): n is a, c, g, or t
tcagtacgctgtctcacgaccggtgctcgatttagtctagcgactttgggcttttgggggcaggggagtgggctaagggtgacgcaggtggcgccagccaggcgcacaccccaatgcccgtgagcccagacactggaccctgcctggaccctcgtggatagacaagaaccaaggggcctctgcgccctgggcccagctctgtcccacacccgcagtcacatggcgccatctctcttgcngcctcaccgaggccatcgtctcccctgccnccngctcngancncctgtcgggcacgagccggccgtgggctcgccgtacggtacaacggtactaccgttccacgacacggtcctaacgtcggaacggcgggtccgtcgggacgacggaccgtcagttagcgngngnnnnnnnnnnnnnnnnnnnnnnnnnnnnnnnnn

SEQ ID NO: 122959 - DNA, 403 bp, Homo sapiens
  misc_feature: GYAE6OF02G6VB6.36.13.B02.1.454.CMB.1.raw
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (382)..(383): a, c, t, g, unknown or other
  misc_feature (382)..(383): n is a, c, g, or t
  modified_base (385)..(403): a, c, t, g, unknown or other
  misc_feature (385)..(403): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaacgggccatcggtccttcccctggccgccctgcctccgaggacgcaccctcgtcggggccacgacgccggcccgtcgggcctcgccgtggtcaaggctacgtccgagacngctacngacgcggctggcaggcgacagtagnngnnnnnnnnnnnnnnnnnnn

SEQ ID NO: 122960 - DNA, 470 bp, Homo sapiens
  misc_feature: GYAE6OF02HHO4G.36.13.B02.1.454.CMB.1.raw
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (439)..(441): a, c, t, g, unknown or other
  misc_feature (439)..(441): n is a, c, g, or t
  modified_base (443)..(443): a, c, t, g, unknown or other
  misc_feature (443)..(443): n is a, c, g, or t
  modified_base (445)..(470): a, c, t, g, unknown or other
  misc_feature (445)..(470): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctcgtcccacaccgcagtcacatggccgccatctctcttgcagcttccaccaacggcccatcggtccttccccctggccgccccgtgcctccgacggacgccaccgtcgtcggggcacgacggccggcccgtgggcctcggccgtcggtccaagggtaccttaccgttaccacggtaaccgacggtccgttaaccgtgggaccggtcggggccgtgggaccgaacgggccgaccaagtacgncngcnnngngnnnnnnnnnnnnnnnnnnnnnnnnnn

SEQ ID NO: 122961 - DNA, 504 bp, Homo sapiens
  misc_feature: GYAE6OF02GORQV.36.13.B02.1.454.CMB.1.raw
  modified_base (220)..(220): a, c, t, g, unknown or other
  misc_feature (220)..(220): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(464): a, c, t, g, unknown or other
  misc_feature (463)..(464): n is a, c, g, or t
  modified_base (466)..(472): a, c, t, g, unknown or other
  misc_feature (466)..(472): n is a, c, g, or t
  modified_base (474)..(476): a, c, t, g, unknown or other
  misc_feature (474)..(476): n is a, c, g, or t
  modified_base (478)..(504): a, c, t, g, unknown or other
  misc_feature (478)..(504): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgcccgtgggtccagctctgtcccacacccgcagtcacatggcnccatcctctcttgcagcttccaccaacgggcccatcggtccttccccgtggccgccctcgcctccgaggacgccacctcgtgggggaccacgacggccggcccgtgggccgtcggccgtcgggtcaaacgggtaccttacgttacccgaggtaccgacggtccgtaacgtggaacggcggggtccgtagggacgaaacgggtccggacgaacgtaaggngcagcgngcganacnngnancngnncnnnnnnngnnnannnnnnnnnnnnnnnnnnnnnnnnnnn

SEQ ID NO: 122962 - DNA, 558 bp, Homo sapiens
  misc_feature: GYAE6OF02IAFNJ.36.13.B02.1.454.CMB.1.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (510)..(516): a, c, t, g, unknown or other
  misc_feature (510)..(516): n is a, c, g, or t
  modified_base (518)..(558): a, c, t, g, unknown or other
  misc_feature (518)..(558): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccgaaggggcctctgccgccctgggcccagctctgtccccacacccgnacgtcacagtcggcgccatcctcttcttgcacgtccttccgaaccgaaggcccccngttcccggttcccttcccccccgtgggtccccgtcccccgtgtccctcccggaagggtaccgcccgtacccgtacgggtcgggggaccaccgacggcccggtccccggtgggcctccggtccgtagggtaccgaacggtaccttacccttaccgacggtacgtaccggtcgttaaccggttgggaccgggaccggggtcgtacggaccggaacggccgtcgtaaaggtcgagcagcagctaagnnnnnnngnnnnnnnnnnnnnnnnnnnnnnnnnnnnnnnnnnnnnnnnn

SEQ ID NO: 122963 - DNA, 589 bp, Homo sapiens
  misc_feature: GYAE6OF02GKPIX.36.13.B02.1.454.CMB.1.raw
  modified_base (194)..(194): a, c, t, g, unknown or other
  misc_feature (194)..(194): n is a, c, g, or t
  modified_base (290)..(290): a, c, t, g, unknown or other
  misc_feature (290)..(290): n is a, c, g, or t
  modified_base (439)..(439): a, c, t, g, unknown or other
  misc_feature (439)..(439): n is a, c, g, or t
  modified_base (538)..(538): a, c, t, g, unknown or other
  misc_feature (538)..(538): n is a, c, g, or t
  modified_base (568)..(568): a, c, t, g, unknown or other
  misc_feature (568)..(568): n is a, c, g, or t
tcagtacgctgtctcacgaccggtgctcgatttagtctagcgactttggctttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctcngtcccacaccgcagtcaacatggcgccatctctcttgcagcttccaccaaaggccatcggtcctccccgtgccgccctgctccaggacgcacctcncgggggtccacgagccggtcccgtgggactcgaccgttacggtacgaaacggtaacctacgtttacccgaagtaccgaacggcccggttaaccttaggaacgggtccgggtccgtacggaccgaaacgggtacgaccgaagttaacggngagtacgaacacgacgtacgatcagtacgacagacactacgacgactactacgacgacgtagatagacgtacgcgtacacgacgacgtacgagatacanacacagtacgctacacgagtacgtacgtanacgtcgacgacctatagtacg

SEQ ID NO: 122964 - DNA, 618 bp, Homo sapiens
  misc_feature: GYAE6OF02I4BAM.36.13.B02.1.454.CMB.1.raw
  modified_base (189)..(189): a, c, t, g, unknown or other
  misc_feature (189)..(189): n is a, c, g, or t
  modified_base (331)..(331): a, c, t, g, unknown or other
  misc_feature (331)..(331): n is a, c, g, or t
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
  modified_base (525)..(525): a, c, t, g, unknown or other
  misc_feature (525)..(525): n is a, c, g, or t
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
  modified_base (564)..(564): a, c, t, g, unknown or other
  misc_feature (564)..(564): n is a, c, g, or t
tcagtacgctgtctcacgaccggtgctcgatttagtctagcgactttggcgtttggggcagggagtgggctaaggtgacgcaggtggcgccagccaggcgcacacccaatcgcccgtgacgcccaggaccactcggaccctggcctcggaccctcggtggaataggaacaagaaccgaagggggccctntcggccgcccgtagggcccagcctcgtcgtcccacaccgtcaagtcacagtcggcgccatcctcttctgcactctaccaccgtaacgggcctatcccggtacccttccccgtacggaccgtccctcgccgtccgaaggtacncctaccgcggtcggggccacgacggtccggccggtcggcgtcggccgtaggaccgtacggtacctacgttccgaacggtctacggacgttacgacggacgggccgacggtcggacgacggtcgtaccaggtacncgngtancgacggtnagcagtcggataccagngacgcagcgtatcgacgagcgcgcgacncgacgtacgcgagcgtcncagtcgacgacncacgtacgntactacgtccgtacgtacgtacgttacggtaacggtaccgacgtccgtaccgag

SEQ ID NO: 122965 - DNA, 796 bp, Homo sapiens
  misc_feature: GYAE6OF02GTZBA.36.13.B02.1.454.CMB.1.raw
  modified_base (740)..(740): a, c, t, g, unknown or other
  misc_feature (740)..(740): n is a, c, g, or t
  modified_base (792)..(792): a, c, t, g, unknown or other
  misc_feature (792)..(792): n is a, c, g, or t
tcagtacgctgtctcacgaccggtgctcgatttagtctagcgactttgggctttggggcagggagtgggctaagggtgacgcgaggtggcgccagccagggccgcacacccaatcgcccggtgacgcccagacactggaccctgccgtggaccctcgtggatagacaagaaccgaaggggcctctcgccgtccctgggccctacgcctcgtcgtcccaccaccgcgtacggtcacagtacggccgacctactcctcgtccgttcgactacgccttacccgaaccgaaccggggccctaacgttcccggtttacccgttttacccccgttgggtacccgtacccctcggtacccttaccggaaacgggtaccggacctaacccgttaccggtcgggggtacccaaccggtacgggccccggttacccggttcggggtacccttccgggtccccgtttacggggttaccggtaaaaccgggttacccggtttaacccggtttccccggaacggtaaccggtaacggtaccggttaaccggttagggaaccggggtccgggtacgtacgggaacccgaaacggggtacgtaccgtaagttaccggtgtaacgtcgactacgtacagtcgtatcgtacgtacgtacgtactggtactagtacgtacgtactacggtactacgtacgtaacgtcgtagtaccggttctaccgaaggtacgacggtataacgtaactaaccggtanacgtacgacggctaccgctaaccggttcttccgtactctcctctctaccgtntacg

SEQ ID NO: 122966 - DNA, 237 bp, Homo sapiens
  misc_feature: GYAE6OF01AZUXA.35.11.A11.1.454.CMB.1.raw
  modified_base (234)..(237): a, c, t, g, unknown or other
  misc_feature (234)..(237): n is a, c, g, or t
tcagtacagatcgtcacgaccggtgctcgatttagctacgactgcagggtagctggaatttgagtcctgggccagggaaccctggtcatcgtctcctcagcctccaccaagggcccatcggtcttcccctggcgccctgctccaggagcacctccgagagcacagcggccctgggctgcctggtcaaggactacttccacgatctgtactgagcgggctggcaaggcgcatagnnnn

SEQ ID NO: 122967 - DNA, 520 bp, Homo sapiens
  misc_feature: GYAE6OF01DG7H2.35.11.A11.1.454.CMB.1.raw
tcagtacagatcgtcacgaccggtgctcgatttagctacgactgcagggggggctcaggaggcagagctctgggaatctcaccatggcctggacccctctcctgctcccctcctcactttctgcacagtctctgaggcctcctatgagctgacacagccaccctcggtgtcagtgtccccaggacagacggccaggattacctgctctggagatgcattgtcagaaagatttggtttttggtaccagaagaagtcaggccaggcccctgtcttggtcatgttcgaggacgacaagcgaccctccgggatccctgagagattctctggctccagctcagggactatggtcacttgatcatcactggggcccaggtggaggatgaggctgactattattgttgttacaacaaagtccaatgaatttaattttcttgggtgttcggcggtaggacctaagttgactgtcctaggtcagccgaaggctcgccccctgtcactctcgttcccgccctcctctacg

SEQ ID NO: 122968 - DNA, 488 bp, Homo sapiens
  misc_feature: GYAE6OF01DGJ9T.35.11.A11.1.454.CMB.1.raw
  modified_base (301)..(301): a, c, t, g, unknown or other
  misc_feature (301)..(301): n is a, c, g, or t
tcagtacagatcgtcacgaccggtgctcgatttagctacgactgcaggggggctcaggaggcagagctctgggaatctcaccatggcctggacccctctcctgctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagagccctnagggatccctgagcgtattctctggctccagctcagggacaacagtcacgttgacatcagtgagtcaggcagagacgagctgattattactgtcaatcagacagacacaacaatagtccgtgttggcggtaggaccgaagctggaccgtccgtaggtcgacgacccaaggcctcgcccccgtaccgg

SEQ ID NO: 122969 - DNA, 589 bp, Homo sapiens
  misc_feature: GYAE6OF01BHZKB.35.11.A11.1.454.CMB.1.raw
  modified_base (233)..(233): a, c, t, g, unknown or other
  misc_feature (233)..(233): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagtnttttggttttggaccagaagaagtcaggccaggcccctgtcttggtcatgttcgaggacgacaagccgaccctccgggatccctgagagtattctctggctccgagctcgagggactagtggtcaccttgatcatcacgtcggggcccagggtggaggagtggaggctgacttattattgttgttacaaactaaagtccaaattgtaatttaagtttttcgttgggttgttcgggtacgggtagggtacctaaggttgtacgtggtaccgttaggtacgacggtcccgtaaggtcctcggcccccgttacggttcccgtacttccgttaccgttccccctaccccttcccgtaccg

SEQ ID NO: 122970 - DNA, 574 bp, Homo sapiens
  misc_feature: GYAE6OF01DNT4E.35.11.A11.1.454.CMB.1.raw
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagtatttggttttggtaccagaagaagtcaggccaggcccctgtcttggtcatgttcgaggacgacaagcgaccctccgggatccctgagagattctctggctccagctcgagggactagtggtcaccttgatcatcacgtggggcccagggtggagatgaggctgactattattgttgtacaacaagtccaatgaatttaatttttcgtgggttgttcgggtcggtagggtacctaaggtttgacgttcgtccgtaggtcctaggccccgtaaaggccttccggcccccccgttcgggtcctaccgttccgttccggttcccccgcccccttccgtccgtaacccg

SEQ ID NO: 122971 - DNA, 625 bp, Homo sapiens
  misc_feature: GYAE6OF01DKURN.35.11.A11.1.454.CMB.1.raw
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagtatttggttttgtaccagaagaagtcaggccaggcccctgtcttggtcatgttcgaggacgacaagcgaccctccgggatccctgagagattctctggctccagctcgagggactatggtcaccttgatcatcacgtggggacccagggtggaggagtgaggctagtacttaatttattgtttgttacaaactaaagtccaattgtaatttaagtttttcgttaggggttgtttcgggacgggtagggtaaccgtaaggtttacgacgttggtacccgttagggtaccgacggtaccccgtaaagggtcccttacccggtcccccccgttcgggttccctaacccgtttccgttacccggtttcccccccgtcccccttcccgtcccgtaacccgg

SEQ ID NO: 122972 - DNA, 643 bp, Homo sapiens
  misc_feature: GYAE6OF01EHUUE.35.11.A11.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagtacagatcgtcacgaccggtgctcgatttagctacgactgcagggggggctcaggaggcagagctctgggaatctcaccatggcctggacccctctcctgctcccctcctcactttctgcacagtctctgaggcctcctatgagctgacacagccaccctcggtgtcagtgtccccaggacagacggccaggattaccngctctggagatgcattgtacagaaagtntttggttttgtaccagaagaagtcaggccaggccctgtcttggtcatgttcgaggacgacgaagccgacccgtccgggactcccgtgagagattctcgtggctccagctcgagggactagtggtcaccttgactcatcacgtcggggcccagggtggaggagtggaggctgtaacttatttagtttgtttacgttacaaactaaacgttccaaagttgtaatttaagtttttcgttaggggttaggtttccgggacggggtaacggggtaaccgtaaggttcgtaacgttcggttaccgtagggttaccacggtacccgaacgggtcctaccggtccccccgttccgggtacctaacccggtttccgttacccggtttccccccggtcccctttccccgtcccgtaacccgg

SEQ ID NO: 122973 - DNA, 676 bp, Homo sapiens
  misc_feature: GYAE6OF01EAYJG.35.11.A11.1.454.CMB.1.raw
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagattttggttttaggaccagaagaagtcaggccaggccctgtcttggtcatgttcgaggacgacaagccgaccctccgggactccctggagagtactttccgctcggacctccgagtctacgagggtacttagtcggtacctactgatacacttcgacgtcgggacccgtaggtcgggaggtagtggaggtctaggtaacttagtttagtttaggtttagtaactaaacgtaaacgtacctaaagttacgttaattttaacgttttttcggttaggggttacggtttacgggtacggggtaacgggtaaccgttaaggttacgaccttggttcccgttacgggtccgaacgaccccgtaacgggtaccgttccccggtcccccgttcggtacccttaccgttccgttccccggttacccccgtcccccttcccgtacccgtaacccgg

SEQ ID NO: 122974 - DNA, 539 bp, Homo sapiens
  misc_feature: GYAE6OF01CX15H.35.11.A11.1.454.CMB.1.raw
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacagccaccctcggtgtcagtcgtccccaggacagacggccaggatcacctgctctggagatgcattgaccaaagcaatatacttattggtaccagcagaagtcaggccaggcccctgtattgatgatgtataaagacactggagacggccctcgagggactccccgtggagcgtatttcctcgtcggccttccagctcgaaggggaccaaacgacgtcacgttcgaacctagtcaggtggacgtccgaggacaaggaacgacggaggctgtattattactagtacaatcacgacaagaccaacaacaatacgtccgtgttcggcggacgggacagctggaccgtccgtaggtcacgtacccaggcctccgccccgtcggtaccc

SEQ ID NO: 122975 - DNA, 513 bp, Homo sapiens
  misc_feature: GYAE6OF01B3JJC.35.11.A11.1.454.CMB.1.raw
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
tcagtacagatcgtcacgaccggtgctcgatttagctacgactgcagggggggctcaggaggcagagctctgggaatctcaccatggcctggacccctctcctgctcccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccaccaggcaaagccccaaactcatgatttatgatgtcagtaatcggccctnatgggtttcaatcgcttctctgctccaagtctggcaacacggcctccngaccatctcgtggcctccaggctgacgacgaggctgattatactgcagctcatatacaaccagcagcactctcgtcggttcggacggacggaccaagccgtagacccgttccgtaggtcacggaccccaaggccctccgtcccccgtggtacccg

SEQ ID NO: 122976 - DNA, 539 bp, Homo sapiens
  misc_feature: GYAE6OF01BLLAW.35.11.A11.1.454.CMB.1.raw
tcagtacagatcgtcacgaccggtgctcgatttagctacgactgcagggggggctcaggaggcagagctctgggaatctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcaagaagtcaggccacggcccctgtattgatgatagtaataaagacactgacgacggccctagacgggtactcccgtgacgcgtattctcgtggcctcagcctcgagggacaactacgtcacgttcgaactatcgaggtcggacgtccaggacaaggaacggacgaggctagtattattactgtacatcagtacagaaccacaactaactacgtccgtggttcggacggaggaccgagcgtacggtaccgtccgtaggccacggacccgaaggcctccgtccccgtccgg

SEQ ID NO: 122977 - DNA, 639 bp, Homo sapiens
  misc_feature: GYAE6OF01AS8DI.35.11.A11.1.454.CMB.1.raw
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagtatttggtttttggaccagaagaagtcaggccaggcccctgtcttggtcatgttcgaggacgacaagccgacccttccgggactccctggagagattctctggccttccgagcctaccgaggggaccttaagtcggtacctacctttgactcaattccacgttcgggggcccctaggggttcggaaggagttggaacgggcgttacggtaacttatttagtttggtttagttaccaaaacgtaaagttcccaaagttgtaatttaattttttcgttagggttgttcgggtcgggtaagggacctaaggttgaacttcggtacctagggtcacggcccgtaaggccgtccgacccccgttcggttcctaccgttccgttccggtttaccccgccccctttccgtacccg

SEQ ID NO: 122978 - DNA, 669 bp, Homo sapiens
  misc_feature: GYAE6OF01B1DN5.35.11.A11.1.454.CMB.1.raw
tcagtacagatcgtcacgaccggtgctcgatttagctacgactgcagggggggctcaggaggcagagctctgggaatctcaccatggcctggacccctctcctgctcccctcctcactttctgcacagtctctgaggcctcctatgagctgacacagccaccctcggtgtcagtcgtccccaggacagacggccaggacttacctgctctggagatgctattgtacaaggtaaagtgttttggttttggtaaccagaagaagtcaggccaggccctgtcttggtcagtgtacgaggacgacagccgacccgtcgggatcccgtgagagtattcgtcgtgcctcagctacgagggtactagtcggtctaccgtttgacttcgacttccgaaccggtcgggggacccctaggggtgggagggtactgggaggtctagtacttatttagtttagtttcgttactaaacgtaaagtcctaaattgtaatttaacgtttttacgttggggttacggtttccggggtaacgggtacgggtaaccgttaaggttcgtacgttcggttaccgttacgggtaccgtacggtaccccgaacgggtccctacccggtcccccgttcggttacccgtacgttcccgttccggttccccccgtccccttccgtccgtacccg

SEQ ID NO: 122979 - DNA, 650 bp, Homo sapiens
  misc_feature: GYAE6OF01A9X4N.35.11.A11.1.454.CMB.1.raw
tcagtacagatcgtcacgaccggtgctcgatttagctacgactgcagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacagacggccaggattacctgctctggagatgctattgtcaagaaagtgttttggttttggaaccagaagaagtcgaggccaggtccctgtcttggtctatgttcgaggacgacagccgacccgtcggactcccgtgagagtacttctcgtcggcctccgagtcctacgaagggtactagtcggtacctacgttgactcatccgacggtcggggacccgtagggtggaggagtgggagtcgtagtacttagtttagttgttacgttacaaacgtaacgtacctaagttagttaattttagtttttcgttagggttcggttcgggtacgggtaagggtaaccgtaaggttcgtacgttcggttaccgttacggtaccacggtcccgtaaggtcccgtccggtcccccgttacggttcccgtaccgtttcccgttcccgttccccctccccgttccccgtaccg

SEQ ID NO: 122980 - DNA, 677 bp, Homo sapiens
  misc_feature: GYAE6OF01CH5ZJ.35.11.A11.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacagacggccaggattacctgctctgganatgcattgtcagaaagtntttggttttgaccagaanaagtcagccaggcccctgtcttggtcatgttcgaggacgacagccgaccctcgggatccctgagngtattcnctggctccagctcgagggactatcggtcaccgtttgatcattccacgtcggggacccagggtggaggtagtggagggtctagtaacttattagtttgtttacgttacaaaacgtaaacgttaccctaaagttacgttaattttaaagtttttttccggttaggggtttggtttaccggggtaccgggtaagggtaacccgttaagggttcgtaaccgttggtttacccgtacgggttaccgtaacggtaccccgtaaacgggtccgttacccgggtacccccccgttacgggttacccgttaccgtttccccgttaccggtttcccccccgtccccgttccccgttaccccgg

SEQ ID NO: 122981 - DNA, 767 bp, Homo sapiens
  misc_feature: GYAE6OF01BY1LH.35.11.A11.1.454.CMB.1.raw
tcagtacagatcgtcacgaccggtgctcgatttagctacgactgcagggggtgggctcaggaggcagagctctgggaatctcaccatggcctggaccctctcctgctcccctctcactttctgcacagtctctgaggcctcctatgagctgacacagccaccctcggtgtcagtcgtccccaggacacggacggccaggattaccgtgcctgtgggagatggactagttgtacaagtaaaagtgtttttgggtttttacggaacctaaggaaagtaagtcgaacggtccgacggtcccctggttcgttggtctagttggttcgaaggacgacgaacgccgtacccgtcgggactcccgtaggaagacggtactttccgtacgtcgggccttaccgaacggtcctacggtaaggggtaccttagttcgggtacctaacgtttgactaccgtaattccgaacggttcgggggaccctaggggtagggaggtagtcggacggtcgtagtaacttagtttacgtttagttacgttaacgtaaacgtaacgtacctaaagttagttaactttaagttttttcggttacgggtttacggttaccgggtacggggtaacgggttaaccgttaaggtttacgtaaccggttacggttaccggttaacggtaccgtaacggtacccgtaacgggtcccttcccgggaccccccgtttcgggtacccttacccggttcccgttacccggttccccccgtcccgttccgttaacccgg

SEQ ID NO: 122982 - DNA, 753 bp, Homo sapiens
  misc_feature: GYAE6OF01DFZQB.35.11.A11.1.454.CMB.1.raw
  modified_base (216)..(216): a, c, t, g, unknown or other
  misc_feature (216)..(216): n is a, c, g, or t
tcagtacagatcgtcacgaccggtgctcgatttagctacgactgcagggggggctcagggaggcagagctctgggaatctcaccatggcctggacccctctcctgcctcccctcctcactttctgcacagtctctgaggcctcctatgagctgacacagccaccctcggtgtcagtcgtccccaggacagacggccaggacttacctgctctgganatgacattgacaagtaaagtattttgggtttttagaacctaaggaagtaagtcgaaggccgtaacggtccccttgtccgttggtacctagttcggttacggaacggaaccgacgaaacggtccgtaaccccgtcgggaactcccgtaggacgacgtactttccgtaccgtcggtcctccgagtccgttacggaagggtactagtcggtctaccgttgactcacgtcgacgtcggggaccctagggtggaggtagtcggacggtcgtagtaacctttagtttacgtttagttacgttacgaaaacgtaacgtacctaaagttacgttaattttaacgtttttacggtttcgggtttacgggttaccgggtacggggtaaccgggtaacgttaacggtttacggtacgttacggttaccgtacgggtaccgtaaccggtacccggtaaacgggtcccgtacccggtccccccgttacggttacccttacccgttacccggttccccgttacccccgtccccttcccgtccgtaacccgg

SEQ ID NO: 122983 - DNA, 632 bp, Homo sapiens
  misc_feature: GYAE6OF01DHCOZ.35.11.A11.1.454.CMB.1.raw
  modified_base (332)..(332): a, c, t, g, unknown or other
  misc_feature (332)..(332): n is a, c, g, or t
tcagtacagatcgtcacgaccggtgctcgatttagctacgactgcagggggggctcaggaggcagagctctgggaatctcaccatggcctggacccctctcctgctccccctcctcactctctgcacaggctctgaggcctcctatgagctgacacagcccaccctcggtgtcagtcgtccccaggacagacggccaggattacctgctctggagatgcattgtcaagtaaagtattttggtttttggaccaagaagaagtcaggccaggcccctgtcttggtcatgttcgaggacgacaagcgaccctccgggatcccgtgagagtattcnctggctccagctcagtgactagtcggtcaccgttgactcaattccacgttcgggggaccctagggtcgggaaggtatagggaggtcttagaactttatttagtttgtttacggttacaaactaaagttcccaaagttcgtaatttaaattttttcgttaggggtttgttacgggcgggtaacgggtaccctaaggttcgtaaccttcggttacctagggttcgaacggtaccccaaggtaccttcccggccccccgttacggtccctacttcccgttaccgttcccccgccccttacccg

SEQ ID NO: 122984 - DNA, 694 bp, Homo sapiens
  misc_feature: GYAE6OF01EZYSY.35.11.A11.1.454.CMB.1.raw
tcagtacagatcgtcacgaccggtgctcgatttagctacgactgcagggggggctcaggaggcagagctctgggaatctcaccatggcctggacccctctcctgctcccctcctcactttctgcacagtctctgaggcctcctatgagctgacacagccaccctcggtgtcagtcgtccccaggacagacggccaggacttacctgctctggagatgcattgtcagaaagtgttttggttttggtaccagaagaagtcaggccaggcccctgtcttggtcatgttcgaggacgacaagcgacccgtcggatccctgagagattctctggctccagctcgagggactagtggtctaccttgatcatcacgtcggggccctagggtggacggagtcggaggtcgttagaactttagtttagtttaggtttcgtttaacgtaaaccgttaaacggtaccctaaagtttacgtaattttaagttttttacgtttaggggtttacggtttaccgggtacggggtaacggggtaacccgttaaaggtttcggtaacgttcggttaccgttacgggttaccgaaccggttaccccggaagggtacccgttccggtcccccccgttaccgggttacccgtaaccctttcccggtttcccggtttacccccccggtccccctttccccgtcccgtaaacccgg

SEQ ID NO: 122985 - DNA, 505 bp, Homo sapiens
  misc_feature: GYAE6OF01DKK55.35.11.A11.1.454.CMB.1.raw
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgaccaaagcaatatacttattggtaccagcagaagtcaggccaggccccctgtattgatgatgtataaagacactgagaggccctcagggactccctgagcgattctctggctccagctcagggacaacagtcacgttgaccatcagtggagtcgaggcaagaagacgaggctgtattattactgtacaattcagcagacaccaacatacgtccgttgttcggcggaggaccaaggtctagaccgtccctaggtcacgtccaaggcctcgccccgtgtacccg

SEQ ID NO: 122986 - DNA, 730 bp, Homo sapiens
  misc_feature: GYAE6OF01ANV9Y.35.11.A11.1.454.CMB.1.raw
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacagacggccaggattacctgctctggagatgcattgtacagaaagtattttggttttgaccagaagaagtcgagccacgccctgtcttggcatgttacgaggacgacagccgacccgtcgggatcccgtgagagtacttcgtcgtggcctccgacgcttcgaagggtacttagtcggtacctacgttcggaattccgaacgttccgaccggttccgggggaccccgtaaggggttacgggaacggtagttcgggaacgggtaccgttagtaaccgtttagttttagttacgggttttacggttaacctaaaacgtaaacgttaacccgtaagttacgttaattttaacgtttttcggttaggggtttcggtccggggtacgggtaacgggtacttaaggttacgtaacgttcggtaccgttacgggtacctaccggtacccggtaacgggccgttacccggtacccccccggtttaggtacccgttaccgtttaccccggtttcccggtttacccccccgtcccgttcccgttaaccccgg

SEQ ID NO: 122987 - DNA, 690 bp, Homo sapiens
  misc_feature: GYAE6OF01B39K7.35.11.A11.1.454.CMB.1.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (397)..(397): a, c, t, g, unknown or other
  misc_feature (397)..(397): n is a, c, g, or t
tcagtacagatcgtcacgaccggtgctcgatttagctacgactgcagggggtgggctcaggaggcagagctctgggaatctcaccatggcctggacccctctcctgcctcccccctcctcacttctgcacagtctctgaggcctcctatgagctgacacagccaccctcggtgtcagtcgtccccaggacagacggccaggattacctgctctggganatgctattgtcaagtaaagtnttttggttttgaaccagaagagtcaggccagccctgtattgatgatgtataaagacacgtgagacggccctcgaagggactccctgacgtcgtattctacgtggctccgagcgtacgaacgggacaacgagtccgtacgttacgacctatacgtaggnggtacgtcccgtaagggctaaaggaaacggaaccggtagggactaacggtaatttaacgttaacgtcggttacaaacgttacgaacgtaccaacggtaaaccaaaccctaaaaccgtaacgttaacccggttacccggtttacgggttttacggggaccggggtaaacgggtaaccgaaacggtccgtaaccggtacccggttacccggttagggtacccgaaccggaccccggaaacggtccccgtaccgggtacccccgttaccggtacccgtcccgttcgttacccccgg

SEQ ID NO: 122988 - DNA, 304 bp, Homo sapiens
  misc_feature: GYAE6OF01DQCXU.35.11.A11.1.454.CMB.1.raw
  modified_base (289)..(304): a, c, t, g, unknown or other
  misc_feature (289)..(304): n is a, c, g, or t
tcagtacagatcgtcacgaccggtgctcgatttagctacgactgcaggggtagctggaattttgagtcctggggccagggaaccctggtcatcgtctcctcacgcctccaccaacgggcccattccggtccttccccccgtggccgcccctggcctccgagggacgccaaccctccggagagccaacgacggccggcccctggggcctggccctgggtaccaaaggaccttacttccaacgtattccgtgtacctggacggccggggtctgggacaagggcgacatagnnnnnnnnnnnnnnnn

SEQ ID NO: 122989 - DNA, 736 bp, Homo sapiens
  misc_feature: GYAE6OF01C1Q0J.35.11.A11.1.454.CMB.1.raw
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacacgccaccctcggtgtcagtcgtccccaggacagaccggccaggtacttacctgctcgtggagatgctagtttcgtacaaggtaaagttgttttttgggtttttacggaaccaaggtaaaggtaacggtccgaacgggcccacgggtcccccttggttccgtttggtcctagtttcggttaccggagggaaccgaacgaacggcccgtaccccggtccgggactcccgtaggacgtacgtactttccgtcgtcggtcctccgagtccgttacggaacgggtacttacgttcggtacctaccgttgaacttccagtccgtacggtccggggaccctaggggtacggaaggtacgtgggaacggtcgttagttaactttagtttacgtttgtttacgtaacctaaacgtaacgtactaaatttgttaatttttagtttttcggttgggttacggttcgggtacgggtacggtacgttagttcgtacgtcgttacgtgtccgtacgtacccgacgtcccgtcccggtccccgttaggtccttaccgtttccgttcccgttccccctccccttcgtcccgtacg

SEQ ID NO: 122990 - DNA, 664 bp, Homo sapiens
  misc_feature: GYAE6OF01BENZV.35.11.A11.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
tcagtacagatcgtcacgaccggtgctcgatttagctacgactgcagggggtgggctcaggaggcagagctctgggaatctcaccatggcctggacccctctcctgctcccccctcctcactttctgccacagtctctgaggcctcctatgagctgacacagccaccctggtgtcagtcgtccccaggaccagacggccaggattaccngctctgganatgcattgcagaaagtgttttggttttacgaccagaagaagtctaggccaggcccctgtctggtcatgttgaggtacacaacgcgaccccgtcgggatcccgtggagtagtacttctacgtggcctccgagtccttacgaggtactacgtcggtacctaccgttggtaactcgtaacgtccgaccggttacgggggacccgtacgggtagggacgggtagtacggacggtacgttacggtaactttacgtttagtttacgtttcgttaacgaaactaaacgtaccgtaaacgttgtaacgttttaatttttccgggttagggttacggtcgggttacgggacggtaactaaggttcgagttcgtacgttaggccgacgtccgtaaggccctccggtccccgtcgttaccctccgttcccgtaccgtccccctcccgttcctaccgg

SEQ ID NO: 122991 - DNA, 650 bp, Homo sapiens
  misc_feature: GYAE6OF01A6AUD.35.11.A11.1.454.CMB.1.raw
  modified_base (99)..(99): a, c, t, g, unknown or other
  misc_feature (99)..(99): n is a, c, g, or t
  modified_base (170)..(170): a, c, t, g, unknown or other
  misc_feature (170)..(170): n is a, c, g, or t
  modified_base (214)..(214): a, c, t, g, unknown or other
  misc_feature (214)..(214): n is a, c, g, or t
  modified_base (288)..(288): a, c, t, g, unknown or other
  misc_feature (288)..(288): n is a, c, g, or t
tcagtacagatcgtcacgaccggtgctcgatttagctacgactgcagggggggctcaggaggcagagctctgggaatctcaccatggcctggacccctntcctgctccccctcctcactttctgcacagtctctgaggcctcctatgagctgacacagccaccctcggtntcagtgtccccaggacagacggccaggatcacctgctcgtgganatgcattcgaccaaagcaatatacttattggtaccagcagaagtcaggccaaggcccctgtattgatgatgtanaaagacactgaagaggccctcagggactcccgtgagcgattctctggactccagctacgagggacaacgagtacgtaccgttacgaacctacgtcgtaagtacgggaacgttcccgaacgggacgaaaggaaacggaccggaacgggccgttaaggtaacttttaagtttaaccttaggttacctaaagttaccgaagaccaaacggaaccaaacccgtaaaactaaacgttaacggttaccccggttagggttttacgggacccgggtaaagggtaacccgtaaacggtaccgtaggtaccccggttaccgtaacggtcgaacgccccgtaaggaccctcccggccccgttccggtacccg

SEQ ID NO: 122992 - DNA, 720 bp, Homo sapiens
  misc_feature: GYAE6OF01EVWD8.35.11.A11.1.454.CMB.1.raw
  modified_base (99)..(99): a, c, t, g, unknown or other
  misc_feature (99)..(99): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (706)..(706): a, c, t, g, unknown or other
  misc_feature (706)..(706): n is a, c, g, or t
  modified_base (713)..(713): a, c, t, g, unknown or other
  misc_feature (713)..(713): n is a, c, g, or t
tcagtacagatcgtcacgaccggtgctcgatttagctacgactgcagggggggctcaggaggcagagctctgggaatctcaccatggcctggacccctntcctgcctccccctcctcactttctgcacagtctctgaggcctctatgagctgacacacgcccacccgtggtgtcagtccgtccccgaggacacggaccggccaaggtacttaccgngctcgtggganattggactagttgacaaggtaaagttagtttttgggttttacgaactaaggaagtaagtcgacggccacggtccccttagttccttggtactagttcggttacggaacgggtaccaacgaacggcccggtaaccccgtccggggaacctcccgtggaacgtacgtactttcgtcgtcggaccctcgagtccgtacggaagggtaccttagtcggtaccctaccgtttagacttaccgagttccgacggggtccggggacccgtaggggttagggacggtagtggacggtcgtagtacttagtttagtttcgttacgttaacaaaacgtaacgtacctaagttagttaattttaacgtttttcggttgggtttaggttcgggacgggttacggtaaccttaggttcgtacgttcgtacgttacggcacgtaccgacgtcccgtaccgtccccgtcgtcctccgttccgtacccttacccncccttcnccgtacg

SEQ ID NO: 122993 - DNA, 769 bp, Homo sapiens
  misc_feature: GYAE6OF01CU13X.35.11.A11.1.454.CMB.1.raw
tcagtacagatcgtcacgaccggtgctcgatttagctacgactgcgagggggtgggctcaggaggcagagctctgggaatctcaccatggcctggacccctctcctgcctccccctcctctactttctgcacagtctctgacggcctctatgagctgacacgacgcccaccgtggtgtcagtccgtacccgaggacacggaccggcaggacttacctgctcgtaggatacgtgactagttgacgaaggtaaagtttgttttgggttttacgacgagtaaacggaagtcggacgaccgtacggtccctgttcgtggtactagtcgtcggaggactacgacgtccgacccgtcggacctctaggacgtatcttcgcggtacgtcctacgacggtccgtacggtagggtacttagtcggtaccttacgtgtactacgtacgtcgtacgggtccgggaccggtaggggtacggacgggtagtagggacggtccgttaagttaacgtttagttacggtttgtaaccgttaaacaaaccgttaacgtacgttaaaagtttcgttttaaagttttaacggttttttcgggttaaggggttcgggtttaacccggggaggggttaaaccggggttaacttaacgggtttccgtacgggttacggttaccgggtaaccggtcggtaaacccggtcccggtaacgggttccgtccccggttaccccgtcgtttacccgtacgttccccggtcccgtttacccccgcctttccgtacccg

SEQ ID NO: 122994 - DNA, 674 bp, Homo sapiens
  misc_feature: GYAE6OF01DGDR7.35.11.A11.1.454.CMB.1.raw
  modified_base (103)..(103): a, c, t, g, unknown or other
  misc_feature (103)..(103): n is a, c, g, or t
  modified_base (127)..(127): a, c, t, g, unknown or other
  misc_feature (127)..(127): n is a, c, g, or t
  modified_base (410)..(410): a, c, t, g, unknown or other
  misc_feature (410)..(410): n is a, c, g, or t
  modified_base (480)..(480): a, c, t, g, unknown or other
  misc_feature (480)..(480): n is a, c, g, or t
  modified_base (566)..(566): a, c, t, g, unknown or other
  misc_feature (566)..(566): n is a, c, g, or t
  modified_base (655)..(655): a, c, t, g, unknown or other
  misc_feature (655)..(655): n is a, c, g, or t
tcagtacagatcgtcacgaccggtgctcgatttagctacgactgcagggggtgggctcaggaggcagagctctgggaatctccccacatggcctggacccctntcctgctccccctcctcactttcngcacagtctctgacggcctctatgagtctagacacgacgccctacccgtggtgtcacggtccgtaccccgaaggaccagaccggcctaaggactccacctgccgtccgtggatactcgacctagttccggaaccaaaagacctaaattacttaccgtttaagttcggtaaccgagacgaaggtaacgtcgaacggtcccgtaccggtccccttagttacttgagtagtattaggtaactaacggactacggtagaacggtacgcccgtagacggtactcccgngacgtctattccgtacggtcgtcctacgacgtccgacgaacggtaacaacttacggtacctaccggttanaactaaccgttcgaacggtcggaaccgtaccagggaacaaagggtacgacgtagtacgtacgtaattacgttctagacttacgacnggtaaccacgtacaccaatacgtcgttaccggttgtacgacgggacgtacgacgtcgtacgtccgtaccgtagaccacggacccgtacncccgtcccgtcccggtacc

SEQ ID NO: 122995 - DNA, 785 bp, Homo sapiens
  misc_feature: GYAE6OF01AMLEE.35.11.A11.1.454.CMB.1.raw
  modified_base (126)..(126): a, c, t, g, unknown or other
  misc_feature (126)..(126): n is a, c, g, or t
  modified_base (175)..(175): a, c, t, g, unknown or other
  misc_feature (175)..(175): n is a, c, g, or t
  modified_base (644)..(644): a, c, t, g, unknown or other
  misc_feature (644)..(644): n is a, c, g, or t
  modified_base (654)..(654): a, c, t, g, unknown or other
  misc_feature (654)..(654): n is a, c, g, or t
  modified_base (667)..(667): a, c, t, g, unknown or other
  misc_feature (667)..(667): n is a, c, g, or t
tcagtacagatcgtcacgaccggtgctcgatttagctacgactgcgaggggggctcgaggaggcagagctctgggaatctcaccatggcctggatcctctacttcctccctcctcactctctgcanacgctctgaggtcctcctatgagcctgacacacgaccctaccgtcggtntacgacgttcgtcccccgaagggaccacggaccggaccgtaagggtaacttccaaccgttggaccgttcgtaggggactattcggacctagttcggaaccctaaaggaccttaaacgttaattaaactttacggttacggtaacccgtaagaccgtaagtaacggtcgaaccgggcccgtaaacggtcccccgttaggttaacgttaccggtacgtaagggtaactttaacggttaaaacgttaaacggaaccgttaacgttacgggaaaccggtacgggtaccccggttaacggaacgggttacccgttaacccgtacgggtaacgttaaccggttacctttaccggtaccttaccggggtaccctaccggtaacgtccggtacggtaacggaaaccgtactaacggtacgtaccgttacggactacgtcgaacgtcggactacggagtacgaagaacggagcggtanagttaacgtnttaactgaactancggaacagtaacgaaccaacgtaatacgttacgacggttcgtacggtacggaacggtacgtcgacgtacggtaccgacggtactcggaccgacgtaacggctaccccgcggttacccg

SEQ ID NO: 122996 - DNA, 891 bp, Homo sapiens
  misc_feature: GYAE6OF01DPRX5.35.11.A11.1.454.CMB.1.raw
  modified_base (219)..(219): a, c, t, g, unknown or other
  misc_feature (219)..(219): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggccctcctatgagctgacacagccaccctcggtgtcagtcgtccccaggacagaccggccaggattacctgctcgtgganatgctattgcaagtaaagtagttttggtttttggaacctaaggtaagtaacgtccgaacggccgtaacggtccccttggttccgttcgggtactagttcggtttaccggaaggggtaacccgtaaacgaacgggtccccggtacccccggttaccgggggtaccttacccccgtagggaacgtaacggttaaccttttccgtccgttacgggtcccttaccgacggtccgttaacgaagggggtaccttagttaccgggtaccctaccgtttacggaactttccgaacttacccggtaacgggtcccggggggtaccccgtaagggggttacgggaagggtaacgttacgggaacgggtcgttaacggtaaccgtttaagtttacgttttaggtttaccgtttaaacgtaaaaccgttaaacgttaacccgttaaagtttaccgttaaagtttttaacgtttttttgggttacggggtttacgggtttaccggggtacggggttaacggggtaaccgtttaacgggtttacggtaaccgtttacgggttacccgttacgggttaccgaaccggtaacccggtaaccggtccgttaccccggtcccccgttacggttaccccttaacccggtttcttaccccggtttccccctccccgttcccgtaaacccgg

SEQ ID NO: 122997 - DNA, 705 bp, Homo sapiens
  misc_feature: GYAE6OF01CTM48.35.11.A11.1.454.CMB.1.raw
tcagtacagatcgtcacgaccggtgctcgatttagctacgactgcagggggtgggctcaggaggcagagctctgggaatctcaccatggcctggacccctctcctgcctccccctcctctactttctgcacagtctcgtggacggcccttcctatgagctagacaccagcccctacccgtcggtgtctacggtccgtccccaagggacacggaccggaccaggtacttacccgtgactcgtaggagtattgactattcgaaccaaaagctaaatacttactttagttaggtaccagacgaagaacgtcgacgccgacgcccctagtacgttgagttgtaagttagtaaagtaaacgtacgtaacgtacggaaggaccgaccgttacgacgggtactcccgtgtacgcgtaacttcgtcgtcgtacctaccgagttccgacggtaacggaccaaagacgttactacgttacgacctaacgtcgaaggtacgtacggtcggaacggacgaaacggtaacgacggacggtacgttagttaactttaacgttacgttacgtactaaacgtcgaaccttacaacgaacccaactaactaacgtacggttcccgttagggtacggacgggacgaccggacgtcggtacgtccggttaccgtccgaccgaccggtacccgtacggcccgtaccccgtcccggtcgtaccccg

SEQ ID NO: 122998 - DNA, 790 bp, Homo sapiens
  misc_feature: GYAE6OF01CD1NF.35.11.A11.1.454.CMB.1.raw
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctagacacagcccaccgtcggtgtcagtcgtcccaggacacggacggccaggtacttacctgctcgtggagatgctagttcgacaagtaagttagttttggtttttacggaaccaaggaaagtaagtcgacggccacggtccccttaggttcgttggtctagttggtacggaaggacgaacgacggccgacccgtcgggtactccgtaggacgtagtacttcgtcgtcggcctaccgacgtccgtacggagggtacttaggttcgggtactaccgtttgacttccgtatccgtacggggtccggggacccggtaggggtaggacggtagtacggtacggtacgtacggttaacgtttaagtttcgtttagtttaccgttaacgtaaaccgtaaacgttaccttaaagttacgttttaacgttttaacggttttttcgggtttaggggtttacgggtttacggggtaacggggttaacgggttaaccgttaacgggttacggttacggttacggttaccggttacggtaacccgtaccggtacccggttacggtacccggttccccgttcccccggttaacggttcccgttacccggtttcccgttaccccggtttcccccgtccccgttccgtacccgg

SEQ ID NO: 122999 - DNA, 757 bp, Homo sapiens
  misc_feature: GYAE6OF01EWRIY.35.11.A11.1.454.CMB.1.raw
  modified_base (131)..(131): a, c, t, g, unknown or other
  misc_feature (131)..(131): n is a, c, g, or t
  modified_base (456)..(456): a, c, t, g, unknown or other
  misc_feature (456)..(456): n is a, c, g, or t
tcagtacagatcgtcacgaccggtgctcgatttagctacgactgcagggggtgggctcaggaggcagagctctgggaatctcaccatggcctggacccctctcctgcctccccctcctcactttctgcacngtctcgtgacggcctctatgagctgacacacgccaccgtcggtgtcaggtccgtacccgaggacacggaccggccgtaaggtacttaccgtgcttacggtggaagtagtcgacttagtttagacgtaaaggttaaaggttttggtttttaggggttttaccggaacaaggtaagtaaccggtcgaacggccgtaccggtcccttaggttcgttcgggtacctaggttcgggtaccggaaggtaaccgaacggtaaccggccccggtaacccgttcggggacctccggtagaacgtagtccttcgacgtccgactcgagtaccggngaggtactggtccgtacctaacgtgtactcgtaacgtcggaccgggtcggtaccggagggtaggaacgtagtaggacggtacttagggtactttaaggtttacgttaggttaacttaaacaaacgtttaacgaactagtttaagttaacgttttagtttccggttaggggttcggtacggtacggggaacgttaacgaggttacggtgttaggaccttaacgggctaccgggtcacggtcccgttaccccggcccgttacgtaccctggttaccccttcccgtccccctccgtcgttaccg

SEQ ID NO: 123000 - DNA, 650 bp, Homo sapiens
  misc_feature: GYAE6OF01D8J5X.35.11.A11.1.454.CMB.1.raw
  modified_base (216)..(216): a, c, t, g, unknown or other
  misc_feature (216)..(216): n is a, c, g, or t
  modified_base (310)..(310): a, c, t, g, unknown or other
  misc_feature (310)..(310): n is a, c, g, or t
tcagtacagatcgtcacgaccggtgctcgatttagctacgactgcagggggggctcaggaggcagagctctgggaatctcaccatggcctggacccctctcctgctccccctcctcactctctgcacaggctctgacggcctcctatgagctgacacagcccaccctcggtgtcagtcgtccccaggacagacggccaggatcacctgctctgganatgctattcgacaaagacaattactacttattcggtaaccagacaagaagtcgacggaccacggtccccgtagtattcgatacgagtagttaanaaacgactacgtggaggaccggaccctacgacgggtacttcccgtagtacgcgtactttcgtcgtcggtctccgacgtctacggaacgggaactaacgtacgtacgtacgttacgaacctagtacgaagggtcggacggtaccgacgggacaaggaacggacgaggtactagttattaacgttacgttagtacaatcgaatacgacgtaaccaactaaactaacgttaccggttaccgttaggttacgggaccggtaacgggaccgtaacggtcgtaccgtaccgttaccgtacggtacccgaacgtacccggaacggtcccgtcccgtccccgtaccgg

SEQ ID NO: 123001 - DNA, 798 bp, Homo sapiens
  misc_feature: GYAE6OF01A7SNP.35.11.A11.1.454.CMB.1.raw
  modified_base (126)..(126): a, c, t, g, unknown or other
  misc_feature (126)..(126): n is a, c, g, or t
  modified_base (279)..(279): a, c, t, g, unknown or other
  misc_feature (279)..(279): n is a, c, g, or t
  modified_base (581)..(581): a, c, t, g, unknown or other
  misc_feature (581)..(581): n is a, c, g, or t
  modified_base (735)..(735): a, c, t, g, unknown or other
  misc_feature (735)..(735): n is a, c, g, or t
tcagtacagatcgtcacgaccggtgctcgatttagctacgactgcagggggtgggctcaggaggcagagctctgggaatctcaccatggcctggacccctctcctgctccccctcctcactttccngcacagtctctggaggccctcctatgagctgacactagcccacctcgggtgtcaggttccgtaccccgaggaccacggaccggcctaagggtaccttacccgtggcttccgtagggagtacgtcggactagtttcgacaaggtaaaacggttnttttttacggggtttttcgaaaccgaggtaagtaagttaccgaggaccccgagggtcccccgttgttcgtttggtaccgtagttgggttcggaacggtaacgtacgtaaacggccccgtaacccggttacggaaccgttcccgtaggacgacgttaacgtttcctccggtggtaccctaccgaaccgtcgtacggtaaccgggtaactcggttacgttaccgtaccttggtaacctactcgtaccggtaccgggttaccggggccgtaaggggtacggacgggtagtacggacgtcgttaanacgtttaacgtttcgttacgtttacggttaaccaaacggtaaactctaaacggttattaagttttacgttttcggtagggttcgttaaggggtcgggtaagttacgtaggttcgacttcgggtagttacggcgaccggtaccgtagggtacccnccggttcccccgtggtacccctacggtttcccttacccggtcccccttcccgtcggttacccg

SEQ ID NO: 123002 - DNA, 700 bp, Homo sapiens
  misc_feature: GYAE6OF01D4U5U.35.11.A11.1.454.CMB.1.raw
tcagtacagatcgtcacgaccggtgctcgatttagctacgactgcagggggtggctcaggaggcagagctctgggaatctcaccatggcctggacccctctcctgcctccccctcctcactttctgcacagtctctgaggcctcctatgagctgacacagcccaccctcggtgtcagtcgtcccaggacagaccggccaggtacttacctgccttcgtggagatgctattgtacaaggtaaagttagttttgggttttacgaccaagtaagtaagtcgacggccgacggtccccttgtcgttggtactagttcggttacggaacggtaccgaacgtaacggccggtaccccgtccgggacttcccgtaggaagtacgtactttccgtcgtcggctccgacgtcctacggagggtactagtcggtcctacgttgatctacgtcgacgtcggggaccgtagggtaggaggagtaggacggtctacgtacgttagttagtttgttacgttaacaaacgtaacgtactaagttagttaactttagttttcggttagggttacggtcgggtacgggtaacggtaccgttaaggttcgtacgttacggtccgttacggtacaccggtaccgtaacggtccctcccggtccccgtaccggttaccctaccgttcccgttcccgttcccccgtcccgttccgtacccg

SEQ ID NO: 123003 - DNA, 536 bp, Homo sapiens
  misc_feature: GYAE6OF02GUXSG.35.11.A11.1.454.CMB.1.raw
  modified_base (456)..(456): a, c, t, g, unknown or other
  misc_feature (456)..(456): n is a, c, g, or t
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacagccaacctcggtgtcagtgtccccaggacagacggccaggattacctgctctggagatgcattgtcagaaagatttggttttggtaccagaagaagtcaggccaggcccctgtcttggtcatgttcgaggacgacaagcgaccctccgggatccctgagagattctctggctccagctcagggactagtggtcaccttgatcatcacgtggggcccagggtggaggatgaggctgacttagttattgttgttcaaactaaagtccaattgtaatttaatttttcgttgggttgttcggnggtagggaccaagttgactgtctaggtcagcccgaaggctcgccccgtcgtcacttcgtccgttccccgccttcctcacg

SEQ ID NO: 123004 - DNA, 586 bp, Homo sapiens
  misc_feature: GYAE6OF02I6KMQ.35.11.A11.1.454.CMB.1.raw
  modified_base (326)..(326): a, c, t, g, unknown or other
  misc_feature (326)..(326): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagatttggttttggtaccagaagaagtcaggccaggcccctgtcttggtcatgttcgaggacgacaagcgaccctccgggatcccgtgagagattcnctggctccagctcgagggactatggtcaccttgatcatcgacgtggggcccaggtggaggagtggaggctgactattagttgttgttacaactaaagtccaaatagtaatttaactttttcgttgggttcgtttacgggtacggtaggggtaaccgtaaggtttcggaacgttgttccgttaggtacgacggtccctaagggtcctacggtcccccgttggtcctacgttccttccggttccccgtccccttccgtaccg

SEQ ID NO: 123005 - DNA, 529 bp, Homo sapiens
  misc_feature: GYAE6OF02HSQF9.35.11.A11.1.454.CMB.1.raw
  modified_base (407)..(407): a, c, t, g, unknown or other
  misc_feature (407)..(407): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagatttggttttgaccagaagaagtcaggccaggcccctgtcttggtcatgttcgaggacgacaagcgaccctccgggatccctgagagattctctggctccagctcagggactatggtcacttgatcatcactgggcccaggtggaggatgaggctgactattattgttgttacaanaaagttccaaatgtaattaatttttcgttgggttgttcgggcggtagggtacctaaggttgaacttgtctaggtcacggcccaaggctcgcccctcggtcactctcgttcccaccctcctcc

SEQ ID NO: 123006 - DNA, 490 bp, Homo sapiens
  misc_feature: GYAE6OF02F6MVF.35.11.A11.1.454.CMB.1.raw
  modified_base (325)..(325): a, c, t, g, unknown or other
  misc_feature (325)..(325): n is a, c, g, or t
tcagtacagatcgtcacgaccggtgctcgatttagctacgactgcaggggggctcaggaggcagagctctgggaatctcaccatggcctggacccctctcctgctccccctcctcactctctgcacaggctctgaggcctcctatgagctgacacagcccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctntggctcagctcagggacaacagtcacgttgaccatcagtggagtccaggcagaagacgaggctagattatactgtcaatcagcagacaccaacaatacgtccgtgtttggcgagggacgaagactcggaccgtctaggtcacgacccgaaggctcgccccctcgg

SEQ ID NO: 123007 - DNA, 667 bp, Homo sapiens
  misc_feature: GYAE6OF02I0BN3.35.11.A11.1.454.CMB.1.raw
  modified_base (315)..(315): a, c, t, g, unknown or other
  misc_feature (315)..(315): n is a, c, g, or t
tcagtacagatcgtcacgaccggtgctcgatttagctacgactgcagggggggctcaggaggcagagctctgggaatctcaccatggcctggatccctctacttctccccctcctcactctctgcacaggctctgaggcctcctatgagctgacacagccaccctcggtgtcagtcgtccccaggacagacggccaggatccacctgctcgtggagatgcattgaccaaagcaatatacttattggtacagcagaagtcaggcaggccctgtattgatgatgtataagacactgagaggccctagaggactccgngtagcgtattctcgtcggctccagcgtacgaggacaacgcgtactacgttcgaaccacgttacgaagtcgggtacgtaccgaggacgaaacggaacggaacggacggtacgtacggttaagttttaacgttacgttaacgtacgtaaacgttccgaaaggtaccgtaaacgtaaaccgaaaccccgtaaacgtaaacgttaaccggttacccgtttaacgggtttacggggaccgggtaacgggtaacccgaaacggtaccgttacggtaaccccgggtaccgttaacgggtaccgaccgggaacccccgtaacggggtaccccttacccggtaccccccgtttaacccggg

SEQ ID NO: 123008 - DNA, 470 bp, Homo sapiens
  misc_feature: GYAE6OF02H2156.35.11.A11.1.454.CMB.1.raw
  modified_base (304)..(304): a, c, t, g, unknown or other
  misc_feature (304)..(304): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
  modified_base (447)..(447): a, c, t, g, unknown or other
  misc_feature (447)..(447): n is a, c, g, or t
tcagtacagatcgtcacgaccggtgctcgatttagctacgactgcagggggggctcaggaggcagagctctgggaatctcaccatggcctggatccctctacttctcccctcctcactctctgcacaggctctgaggcctcctatgagctgacacagccaccctcggtgtccagtgtccccaggacagacggccaggatcacctgctctggagatgcattgaccaaagcaatatacttattggtaccagcagaagtcaggcaggccctgtattgatgatgtataaagtacactgagaggccctnagggatccctgagcgattctctggctcagctcgaggacaacagtcacgttgacatcagtgagtcaggcaagagacgngctgattatangtacaatcatcagacacaanatacgtccgtgttgcgaggacagctcgccgttacngtcacgccaggctcgccctccgg

SEQ ID NO: 123009 - DNA, 734 bp, Homo sapiens
  misc_feature: GYAE6OF02GGMFQ.35.11.A11.1.454.CMB.1.raw
  modified_base (175)..(175): a, c, t, g, unknown or other
  misc_feature (175)..(175): n is a, c, g, or t
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
tcagtacagatcgtcacgaccggtgctcgatttagctacgactgcaggggtgggctcaggaggcagagctctgggaatctcaccatggcctggacccctctcctgctccccctcctcactttctgcacagtctctgaggcctcctatgagcctagacacgcgccctaccgtggtntacgtgtccnccgagacagccgcgagtacttacgngtctcgtaggatgtcgactagttcgtacgaaagaagtttggtttttggttttacgacgtaaggaaagtacgtacgaccggacgacccggtcccgttgttcggttcgtactagtttcggtacggacggaaccgaacgacgcccgtaccccggtacggtacctcccggtagaacgacgtttacgttcctcggtcggtccctaccgacgttccgtacgggtaacggtaccttagggttccgtaccttaccgttgtactactacgtaccgtacggggtccggaccggtagggtaggagtagtggacgtactacgtattatttagttggtttactaaactaaacgtaccgtaactaagtagttaatttttacgttttcggtagggtttcgttacgggacggtaggtaaccttaggtcctaggtcgtttcggtacgtacgaccgtaaccggtaggtcccgttaccccgcccgttacggtacccttacgttcccggtttccccggtaccccccgttcccttacgtaacccg

SEQ ID NO: 123010 - DNA, 573 bp, Homo sapiens
  misc_feature: GYAE6OF02GKE1R.35.11.A11.1.454.CMB.1.raw
  modified_base (234)..(234): a, c, t, g, unknown or other
  misc_feature (234)..(234): n is a, c, g, or t
  modified_base (542)..(542): a, c, t, g, unknown or other
  misc_feature (542)..(542): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagcccaccctcggtgtcagtgtccccaggacagacggccaggattacctgctctggagatgcattgtcagaaagtnttttggttttggaccagaagaagtcaggccacggcccctgtcttggtcatgttcgaggacgacaagccgacccgtccgggatccccgtgagagtattctcgtggctccagctcgagggactagtggtcaccttgactcatcacggtcgggccagggtggaggatggagtctagtacttatttattgttgttacaaacgtaaagtaccaaatgtaatttaagttttcgttagggttgttcgggcggtaggtaccgtaagttgacttcgtcgtaggtcacggcctaaggtcctaccgtccccgtggtacnccgttccgttccgtccccgtccctcctaccg

SEQ ID NO: 123011 - DNA, 598 bp, Homo sapiens
  misc_feature: GYAE6OF02IPDSI.35.11.A11.1.454.CMB.1.raw
  modified_base (329)..(329): a, c, t, g, unknown or other
  misc_feature (329)..(329): n is a, c, g, or t
tcagtacagatcgtcacgaccggtgctcgatttagctacgactgcagggggtgggctcaggaggcagagctctgggaatctcaccatggcctggacccctctcctgctcccccctcctcactttctgcacagtctctgaggcctcctatgagctgacacagccaccctcggtgtcagtgtccccaggacagacggccaggattacctgctctggagatgcattgtcagaaagtattttggttttgaccagaagagtcaggccaggccctgtcttggtcatgttcgaggacgacaagccgacccgtcgggactcccgagagagtacttcncgtggctcagtcctacgagggacttagtggtctacgttgatcatcgacgtcggggccgtaggtggaggagtggaggcgtagacttatttattgtttagttacaacgtaaagttacctaaagtagtaatttaatttttcgttagggttagttcgggtacggtacgggtaacctaaggttcgaacgttgtaccgtaggtcacggtcccgaacggtcgtccgtcccccgtacggtcctaccttccgtaccggttccccgtcccgtcctaccg

SEQ ID NO: 123012 - DNA, 656 bp, Homo sapiens
  misc_feature: GYAE6OF02G49XH.35.11.A11.1.454.CMB.1.raw
  modified_base (338)..(338): a, c, t, g, unknown or other
  misc_feature (338)..(338): n is a, c, g, or t
tcagtacagatcgtcacgaccggtgctcgatttagctacgactgcagggggggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagtattttggttttggaccagaagaagtcaggccaggcccctgtcttggtcatgttcgaggacgacaagccgaccctccgggactccccgtagagagattctctggctccngctcgagggactagtggtcacgttgatcatcgacgtcggggcccagggtggaggatggaggctagtacttattagtttgttgttactaaacgtaaagttaccaagttagtaatttaacgttttttcgttggggtttacggtttccgggacgggtaacgggtaaccgttaaggtttacggacgtttacggtaccgttacgggttacgtaccggtacccgtaaacgggtcccttaccgggtaccccccgttacgggttaccctaaccgtttcccgttcccggttaccccccgtccccgtttacccgtacccgtaacccgg

SEQ ID NO: 123013 - DNA, 779 bp, Homo sapiens
  misc_feature: GYAE6OF02J0088.35.11.A11.1.454.CMB.1.raw
  modified_base (125)..(125): a, c, t, g, unknown or other
  misc_feature (125)..(125): n is a, c, g, or t
tcagtacagatcgtcacgaccggtgctcgatttagctacgactgcagggggtgggctcaggaggcagagctctgggaatctcaccatggcctggacccctctcctgctccccctcctcactttcngcacagtctctgaggcctcctatgagctgacacagcccacccgtcggtgtcagtcgtaccccaggacacgacggccaggattacctgctcgtggagatgctattgacgaagtaaagttgtttttgggtttttacggaaccaagtaagaagttccgaaggcccacggtccccttgttcgtttggtctattggttaccggaagggacgtaacgaacggtcccgtaccccggttaccgggaacttccccggtaggaacggtagttaccgtttcgttccggtacggtcccttacccgaggtcccgttacgaacgggttacctaggtttccggttaccacgtttgaacttcgaacttccgtacggtcgggtaccgtgggtacgaggtagtacggtagtaccgtattaacgttacgtttagtttacggttacgttaacgaaaccttaaacgtaccttaaagttcgttaaattttttacgttttacgggttagggtttacggttacggggtacgggttaacgggttaactttacgggtttacggaacgtttccggttaacgttcggtaaccgttacccggtaaccccgaggttccctcccggtaccccgttcggtacgttacccgttcgttcccggtaccccgttccccgtacttacccgg

SEQ ID NO: 123014 - DNA, 831 bp, Homo sapiens
  misc_feature: GYAE6OF02IX26W.35.11.A11.1.454.CMB.1.raw
  modified_base (131)..(131): a, c, t, g, unknown or other
  misc_feature (131)..(131): n is a, c, g, or t
  modified_base (181)..(181): a, c, t, g, unknown or other
  misc_feature (181)..(181): n is a, c, g, or t
tcagtacagatcgtcacgaccggtgctcgatttagctacgactgctaggggggttgggctcaggaggcagagctctgggaatctcaccagtcggcctggacccctctcctggcctccccctctcactttcngcacagtctctggagtcctcctatgagctgacaccagcccaccctcggtntccagtcgtccccaggaccaggacggccaggtactccacctgcctcgtgggacatcggcaattgacccaaaagtcctaaatttactacgttactttaggtaacccaagtcaaggtaacggtccgaacggacccagggtccccctaggttacttggaactcgtatagttaataaacgtacgtacgttacggaaggtacgggtaccccctacgtacgggggacttccccggttaggacggccgtacgttacgttccgtcggtccgtacccgacgtaccgttacgaacggggtacccaaacgtaacggtccttaaccggttaggtaaccctaacttaccgaacgtacggggtaggtacccgtaagggtaccgtaaggtaaacggtaccggtaagggtacctaacgtaacgttttaatttaacccgttagtttaccgtaaacgttaccgtaacgggtacctaaccggaacccaaacccgttaaaacgtaaaccgtttaaaccggtttaccccgggttagggttttaccgggacccgggtaacggggtaacccgaacggttacccgttacggtaacccccgggtttacccgttaccgggttaccgtaccggtaaccccgtaacggggtcccttacgggcccccccttaaccgggg

SEQ ID NO: 123015 - DNA, 708 bp, Homo sapiens
  misc_feature: GYAE6OF02IS4HX.35.11.A11.1.454.CMB.1.raw
  modified_base (176)..(176): a, c, t, g, unknown or other
  misc_feature (176)..(176): n is a, c, g, or t
  modified_base (359)..(359): a, c, t, g, unknown or other
  misc_feature (359)..(359): n is a, c, g, or t
tcagtacagatcgtcacgaccggtgctcgatttagctacgactgcagggggtgggctcaggaggcagagctctgggaatctcaccatggcctggacccctctcctgcctccccctcctcactctctgcacaggctctgacggcctcctatgagctgacacagcccaccctcgggtntcagtcgtcccccaggaccagacggccaaggactcacctgctctggagatgcattcgaccaaaagctaatatacttatggtaccagacagaagtcagccaggccctgtattgatgatagtataaagactactagacgaaggtcccctgaagggtactccgtaggacgtcggtaatttccgtcncgggtccctaccgtaagccttaacggaacggggtaaaccaaacgtaccggtttaccgtaacggtttacggaaccctaataccgtaacgggtacgggtacgttacccggaaggaccggaaacggtaaacggaaccggaacggtacgtaggtaactttaaacgttacgttacgtaaccgtaagttaccgacgtaccaacggtaaccaaccgaaactaaacgttaaccggttacccgtagggttttacgggacggggtaaccgggaaccgtaacggtaccgtaaccggttaaccgtaccggttaacggtccgaaccggtacccggaacggtacccgtacccgtaccccccgg

SEQ ID NO: 123016 - DNA, 636 bp, Homo sapiens
  misc_feature: GYAE6OF02GRYKV.35.11.A11.1.454.CMB.1.raw
  modified_base (214)..(214): a, c, t, g, unknown or other
  misc_feature (214)..(214): n is a, c, g, or t
  modified_base (466)..(466): a, c, t, g, unknown or other
  misc_feature (466)..(466): n is a, c, g, or t
tcagtacagatcgtcacgaccggtgctcgatttagctacgactgcagggggggctcaggaggcagagctctgggaatctcaccatggcctggacccctctcctgctcccccctcctcactttctgcacagtctctgaggcctcctatgagctgacacagccaccctggtgtcagtcgtccccaggacagacggccaggattacctgctctgganatgcattgtacaagtaaagtgttttgggttttacgaaccagaaagtaagtcgaggccaggccccctgtcttggtcagttgttcgaggacgacaaggccgaccccgtcgggactcccgtgagagtattcctcgtggcctccgagctacgagggtactagtcggtacaccgttgactcatcgacgtcggggacccagggtcggaggagtggaggctgtactagttgttagttagttacaaataacgtctaattntaatttaagtttttcgtagggtttggttcgggtagggtacgggtaaccgtaagttcgtacgttcgtaccgttaggtacgtacggtacccgtaaggtccgttccggtcccccgttacggttacctaccgttccgttcccgttacccccgtacccttcccgtaccgtaccgg

SEQ ID NO: 123017 - DNA, 656 bp, Homo sapiens
  misc_feature: GYAE6OF02IA2I7.35.11.A11.1.454.CMB.1.raw
  modified_base (336)..(336): a, c, t, g, unknown or other
  misc_feature (336)..(336): n is a, c, g, or t
tcagtacagatcgtcacgaccggtgctcgatttagctacgactgcagggggtgggtccaggaggcagaactctgggtgtctcaccatggccctggatcccctctacttctccccctcctcactctctgcacaggctctgaggcctcctatgagctgacacagccacccctcggtgtcagtcgtccccaggacagacggccaggatccacctgctctggagatgcattgaccaaagcaatatacttattggtaccagctagaagtcaggccaggccccctgtattgatgatgtataaagacactgagaggccctgaggactccctgacgcgattctntaggctccgagtctacgagggtaacaacgtagtacaacgtttcgaacctatccgaaggttagggaacgttcccgaaggacaaggaaacgacggaaggtccttaggtaatttaacgttaacttaggtacaaagtcgaacgtacgagaacccaaccgaaacgtaaacgttacggtacccgtaggttttaccggggacgggtaacggggaacccgtaaacgggtccgttacgggaacccggttaccccggttaaacgggtcccgtaacggacccccgtaaacgggtaccctcccgggtaccccccccgttggttaacccccgg

SEQ ID NO: 123018 - DNA, 508 bp, Homo sapiens
  misc_feature: GYAE6OF02HWXO4.35.11.A11.1.454.CMB.1.raw
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
tcagtacagatcgtcacgaccggtgctcgatttagctacgactgcagggggggggctcaggaggcagagctctgggaatctcaccatggcctggacccctctcctgctcccccctcctcactttctgcacagtctctgaggcctcctatgagctgacacagccaccctcggtgtcagtgtccccaggacagacggccaggattacctgctctggagatgcattgccaaagcaatatacttattggtaccagcagaagtcgaggccaacggccccctgtattgatgatagtataaaagacactgagacggccctcgagggntcccgtgagcgtattctctggctccagctcgagggacaacgatcgacgtgaccatcagtgacgtcaggcagaagacgagntgaattatacgtagtacatcagactagaccaacaacaagtactccgtgttggcgaggacagcgtgaccgtcgtagtcacgccgaggcctaccggcccctcggctaccg

SEQ ID NO: 123019 - DNA, 1089 bp, Homo sapiens
  misc_feature: GYAE6OF02HCQ1E.35.11.A11.1.454.CMB.1.raw
tcagtacagatcgtcacgaccggtgctcgatttagctacgactgcagggggtgggcttcgaggaggctagaggctcgtgggaatctcaccatggcctggacccctctcctgctccccctctcactttctgcacaggtctctgacggcctctatgagcctgacacacgccacccgtggtgtcgaggtcgtccccgagggacaggacggaccgagggtacttaacccgtcggcttcccgtaggggaacgtagtcggaccttagttttcggtaccgaaagggtaaaacggttggttttttacgggttttttacgggaaacccaagggtaaaacggtaaacggttccggtaaacggggttaccctaaccggggtccccccgtttagggttcccgttttacgggaacctttacccgtaacggtttacggggttttaacccggggaaacggggtaaacccggtaaaccggtaaaacggggtacccccgggttaaaccccccggggtttaccccggggggtaaacctttaccccccggttaaggggtaaaccggttaaacgggtttaaaccgtttttaccccggtcccggggtttaaccggggtacccctttaaccccgggaacggggttaccccgttttaacccgggaaacggggggtttaaaccctttaacgggttccgggggtttaaccccttaaacccccggttttaggtaaacctttaacccgtaaccggtttaaccggtaacccggggttaccggggggtaccccgtaacgggggtacggggtaaaccgggtacgtttacgggtaaccgggtaccttaacggtaacgtttaagtttacgtttcggtttaccggttaaccgaaacgtaaacgttaccgtaaagtttacggttaacttttaacggttttttcggttaggggttacgggttacggggtaacgggtaaccgggttaacgtaacggttagtacgttccggttaaccgtcggttaccgtaccggtacccggtaacggtcccggtacccgggtacccccggttagggttacccttaccggttcccgtacccgtttacccccgtaccccgttacccgg

SEQ ID NO: 123020 - DNA, 726 bp, Homo sapiens
  misc_feature: GYAE6OF02JTTMD.35.11.A11.1.454.CMB.1.raw
tcagtacagatcgtcacgaccggtgctcgatttagctacgactgcaggtggggctcaggaggcagagctctgggaatctcaccatggcctggatccctctacttctccccctcctcactctctgcacaggctctgaggcctcctatgagctgacacagccaccctcggtgtcagtcgtccccaggacagacggccaaggactccacctgctcgtggagatgcattcgaccaaagcaatatacttattcggtaaccagacaagagtacaggtccaacggccctgtactagagtcgtatacgtaataaacgactacgtgaaggacggcccttacggacgggtaccttcccgtaggacgacgtactttccacgtcgccttcgagtccgtacgaacggaccaacgtacgtacgtacgtacgacctagtcgtaaggtcggaccgtacgaagtacgaaggtaacgacggtacggtacttacggtaactttaacgttacctacggttaaacgtaccgtaacggtaacgaccgggttaacaaacccgtaaacccgtaaaccgtaaacgttaccgggttttaaacccgggttcgggtttaccggggaaccgggtaacccgggtaaaccggttaaaccgggcctttaaaccgggtaaccccggtacccggttaagggtaccccgacccgggttaaaccccggacggttaccccggtaccccggttaccccccgggg

SEQ ID NO: 123021 - DNA, 669 bp, Homo sapiens
  misc_feature: GYAE6OF02IAMSY.35.11.A11.1.454.CMB.1.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
  modified_base (497)..(497): a, c, t, g, unknown or other
  misc_feature (497)..(497): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacagacggccaggattacctgctctgganatgcatgtcagaaagtatttggttttggaaccagaaagaagtcaggccagcccctgtcttggtcattgtgagacgacaagcgacccgtcggactccgngagngattcnctggctcagctgagggcttagnggtacacttgactcagttcacgttcggggccctagggtacggaggacgtggacggtcgtacgaacttaacgttaagtttggttacgttacctaaaacgtaaacgttacctaaagttggtaaactttaattttttaccggttaggggtttntttaccgggggtacggtaacggggtaaaccgttaacgggttagtaacgttcgttaaccgtacgggtaccgtaacggaccccggtaacggtccgtacccggtaccccccgttacggttacccgtaaccgttcccgttaccgttaccccccggtacccccttccgttaaccccg

SEQ ID NO: 123022 - DNA, 783 bp, Homo sapiens
  misc_feature: GYAE6OF02HC9PJ.35.11.A11.1.454.CMB.1.raw
  modified_base (235)..(235): a, c, t, g, unknown or other
  misc_feature (235)..(235): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtcgtccccaggacagacggccaggattacctgctcgtggagatgcattgcaagaaagtntttggttttgacagaagagtcagccgacgccctgtcttggtctatggttcgaggtacgacgaacgccggacccgtcgggacttcccgtggaacgagtacttcgtcgtacggtcctccgacgtcctacggtagggacttaacggttcgggttacctaccgtttaggacttacctaagtccgaccggttcgggggacccgtaggggtacgggaaggtaaggtcggacgggtacgtaggtaactttagtttagttttcggtttaacgtttaaccgtaaaacgttaaaccggttacctaaagtttacggttaaactttttaacgttttttacggtttacggggtttacgggttttaccggggtacgggggttaacgggttaaccggttaaacgggttttacggaaaccgttttacgggttacccggttacgggttaccgtaaccgggtaccccgtaaacgggtcccgttcccggtaaccccccggttcggttacccgttacccggtttcccgttaccccggtttcccccgtaccccgttccccttaacccgg

SEQ ID NO: 123023 - DNA, 766 bp, Homo sapiens
  misc_feature: GYAE6OF02I63TO.35.11.A11.1.454.CMB.1.raw
  modified_base (201)..(201): a, c, t, g, unknown or other
  misc_feature (201)..(201): n is a, c, g, or t
tcagtacagatcgtcacgaccggtgctcgatttagctacgactgcagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccgccaggntccacctgctcgtgggagatcgctagttcgaccaaagcaaatacttaacttattcgggttaaccagcaagaaagtcgaacggccacggtcccctgttacttgtactagtatacgtaagtaaacgactacgtgaaggacgtacccgtacgtaacgggtacttcccgtaggacgaccgtatttaccgtcgttcggccgttacccgacggtcgttacggaacgggaaccaaaccgtacggttccgtaaccggtttacgaaccgtagttaccggtaggttacgggtacgtacccggtaagggacgaaacgggaacggtaacgggacggtacgttaaggttaacttttaacgttaaccgttagttaaccaaacgttacgtaacgtaaccgaaacggtaacccaaaccgtaaaccgttaaacgttaccggtttaccccggttagggttttaaccggggaccgggtaacgggaaccgaaccggtaccgtaccggtaacccggtaccggttacggtaccgtaccggacccggtaaccgggtcccggtacccgtacccccggtcggtaaccccg

SEQ ID NO: 123024 - DNA, 558 bp, Homo sapiens
  misc_feature: GYAE6OF02FILOQ.35.11.A11.1.454.CMB.1.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagccaccctcggtgtcagtgtccccaggacagacggccaggattacctgctctgganatgcattgtcagaaagtnttttgggtttttggaccagaagaagtcaggccaggcccctgtcttggtcatgtcgaggacgacagcgaccctcgggatcccgtgagngattcgtctggcctccagctcgagggactagtggtcacttgatcatcgacgtcggggccagggtggaggtanggtaggctggtacttnttagttgtttgttacaaactaagtccaatgtattaagtttttcgtgggttgtttacgggcggtacgggtaccgtaagttgacgttgtccgtaggtcgacgtccgagtccgtcgccccgttggtccactccttcgtcccaccctcctaccg

SEQ ID NO: 123025 - DNA, 877 bp, Homo sapiens
  misc_feature: GYAE6OF02I28YB.35.11.A11.1.454.CMB.1.raw
tcagtacagatcgtcacgaccggtgctcgatttagctacgactgcaggggggggctcaggaggcagagctctgggaatctcaccatggcctggacccctctcctgctccccctcctcactttctgcacagtctctgaggcctcctatgagctgacacagcccaccctcggtgtcagtcgtccccaggacagaccggccgaggacttaccgtgctctggagatgctattgtacgaagtaaaggttagtttttgggtttttacggtaaccaaggtaaagtaacggttacgaacgggacccgtaaccgggtccccccttaggttccgttttgggttacctagtttcgggtttaccggaagggtaacccgtaacgaaacggtcccggtaacccccggtcccggggacttccccgtaggacgtagtactttccgtcgtcggtcctaccgacgtcctacggacgggtactaggttcggtactaccgttgtactcctaacgtccgtacggtccgggggaccctaggggtagggaacggtagtacgggtaacggtaccgtaggttaactttaagtttaacgttttaggtttacgtttaaaccgtaaaacgtaaaccgttacctaaagttaacgttaaagtttttaaacggttttttcgggtttacggggtttacgggtttaccggggtaccggggtaaacggggttaaccgttaacgggtttaggttaaccggttcggttaaccggtttacggtacccgtaaccggtaacccggtaacgggtccccgttaccccggtccccccggttaccggttaccccgttacccggtttcccggtttccccggttaccccccgttcccccgtttaccccgtacccgtacccgg

SEQ ID NO: 123026 - DNA, 570 bp, Homo sapiens
  misc_feature: GYAE6OF02GHDPC.35.11.A11.1.454.CMB.1.raw
  modified_base (414)..(414): a, c, t, g, unknown or other
  misc_feature (414)..(414): n is a, c, g, or t
tcagtacagatcgtcacgaccggtgctcgatttagctacgactgcagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacagacggccaggatcactgctctggagatgctattgaccaaagcaatatacttatggtaccagcagaatcaggccaggccctgtacttgatgatagtaataaagacacgtagagacgacctacgagggactcctgacgacgtatctgtgctacagctcgaagggaacaacgacgtcacgttagacctatacaggtcgggagtaccgagtacgaagaagacgaggntagtaattacgttactgtacaatcaacgtacgaagaccaacctaaagaacttaacgttcccggttagtttcgggacggtaacgggaccgaagtccgtacgtacccggtacgtaggtaccacggtacccggtagacccgttccggaccccttaccgg

SEQ ID NO: 123027 - DNA, 903 bp, Homo sapiens
  misc_feature: GYAE6OF02G9GQ1.35.11.A11.1.454.CMB.1.raw
tcagtacagatcgtcacgaccggtgctcgatttagctacgactgcagggggtgggctcaggaggcagagctctgggaatctcaccatggcctggacccctctcctgctccccctctcactttctgcacagtctctgacggcctcctatgagctgacacacgccacccgtggtgtcagtcgtccccaggacagacggtcaggattacctgccttcgtgggagatgactagttcgacaaggtaaagttgttttcgggtttttacggaacctaagtaaacggtaagttccgaagggaccctaacgggtccccttagttccgttggtacctagtttcggtacggacggacgtacgaacgtcccggacccgtaccggactcccgtaggaacgtagtacttccgtcgtcggcctccgagtccgtacgtagggtaccttaggtcggtacctaccgtttagaactcctacgtaccgtaacggggtccggggtacccgtaagggggttaggaacgggtagtacggggtaccggggttacttaacggttaaccgtttaaaggtttttacgttttacgggttttaaccgggttaaactaaaaacggttaaaccgtcccgtttaaaagttacgtttaaacggttttttaacgtttttttccgggggttaggggttttaccggggtttacccggggtaacggggttaaaccgggtttaaccgttaaggggtttacttaacccgggttttacgttacccggtttagggttaacccggtaccgggttaaaccccggaacggggttttcccccgtaccccgggtttaccccccgttacggggtttaacccttaaccccgggttttcccgtttacccccgggttacccccccttacccggtttaccccgttaaccccggg

SEQ ID NO: 123028 - DNA, 797 bp, Homo sapiens
  misc_feature: GYAE6OF02JHDIE.35.11.A11.1.454.CMB.1.raw
tcagtacagatcgtcacgaccggtgctcgatttagctacgactgcagggggggctcaggaggcagagctctgggaatctcaccatggcctggacccctctcctgcctccccctcctcactttctgcacagtctctgaggcctcctatgagctgacacacgccaccctcggtgtcagtcgtccccaggacagacggccaggattacctgctctggagatgctattgtacagtaaagtagttttaggttttaggtaccaaggaaggtaagttccgaagggcccgtacggtcccccttaggttccttggggtacctaagttcggtttaccggaagggtaacccggaacgtaacggtcccgtaaccccggttaccggggaaccttccccgtagggacgaacgttacgtttcccgtcggtacggtacctaccgagtcctacgaaggggtaccttaagtcgggttaccacgtttagaacttccgaacttccgtaacggtttccggggacccgtaaggggtacgggtaacggtaggtacggaacgggtccgttaagtacgtttaacgtttagtttacgttacgtttaaccgaaacgtaaacgttacgtaaatcgttaaattttagttttcggttagggttcggttacggggtaccggggggttaactcgggttacttacgggtaacccgttacgttaacgtcgtaccgtacccggaggtcccgtaccgccccggtttacggcccttaacgttccccgttaccggttaccccccgtcccgttacccgttaccgtacccgttaccg

SEQ ID NO: 123029 - DNA, 732 bp, Homo sapiens
  misc_feature: GYAE6OF02HZ71G.35.11.A11.1.454.CMB.1.raw
  modified_base (124)..(124): a, c, t, g, unknown or other
  misc_feature (124)..(124): n is a, c, g, or t
tcagtacagatcgtcacgaccggtgctcgatttagctacgactgcagggggtgggctcaggaggcagagctctgggaatctcaccatggcctggaccctctcctgcctcccctctctactttcngcacagtctctgacggtcctcctatgagctcgacacacgccctacccgtggtgtcagttcgcccgaaggacacggaccggccgaaggtacttaccgtgtccttcgtgggacgtatggactagtttcggaacgaaggttaaaggtttagttttttcggggttttacggaaccgtaagggtaaacggtaacgttaccggaacgggtacccgtaacgggtcccccgtttggttaccggttcggtaccttaggttacggtaccggaacgggtaaccgacgtaacgggcccgtaccccggttaccgggactcccgtaggacgtacttcttccgtcgcgacttaccgatccgtagggacggtattacggtcgtactacttgactacgtcgtacgaccgggtcgggtaccgtagggtacggaggacgtggacgtcgtagtacttagttgtttacggttactaacgaactaacgtactagtacgttatttcgttttggtaggttcggtacgggtacggacggtacgtaggtcgtacgttcgtacgttacggacgtacggtcgtaccggctcccgtcccttcggtacctccgtacgttcccgtcccgtccctctccg

SEQ ID NO: 123030 - DNA, 871 bp, Homo sapiens
  misc_feature: GYAE6OF02JHHK1.35.11.A11.1.454.CMB.1.raw
  modified_base (206)..(206): a, c, t, g, unknown or other
  misc_feature (206)..(206): n is a, c, g, or t
tcagtacagatcgtcacgaccggtgctcgatttagctacgactgcagggggggctcaggaggcagagctctgggaatctcaccatggcctggacccctctcctgcctccccctcctcactttctgcacagtctctgaggcctcctatgagctgacacacgccaccctggtgtcagtcgtccccaggacagacggccaggattaccngctcgtggagatgactattcgtacaagtaaagttgtttttgggttttaggaaccaaggtaaaggaagttcgaacggccaacgggtcccccttggttaccgttggtaccgtagttcggtttaccgggaagggtaaccgaaaccgtaaccggtccgggtaaccccccgttaccggggggtaaccttacccccggtagggtaaacggtaaccggttacgttttacccgtacggttccggggtacccttacccggtacggtaccgttaccgggaaacgggggttaccttaacggttcggggttaaccctacggttttacgaacgttacctaacggttaccgtaccgggttaccgggggacccgtaggggtacgggtaacgggtagtacgggtaacgggtcttacggttaactttaagtttacgtttcgttaacggttaacctaaaacgtaaaccgttacctaagttaactttaagttttaaacgtttttccgggttagggtttacggttaccggggtaacgggttaacgggtaaccgttaaaggtttccggtaaccgttaccgttacgtaccggtacgaaccgtaccggtaacggtccgtacccggtcccgttaccggtaccttaccgttccgttcccggtaccccgtcccgttacccgtcgtaacccg

SEQ ID NO: 123031 - DNA, 661 bp, Homo sapiens
  misc_feature: GYAE6OF02HR2JJ.35.11.A11.1.454.CMB.1.raw
  modified_base (118)..(118): a, c, t, g, unknown or other
  misc_feature (118)..(118): n is a, c, g, or t
  modified_base (124)..(124): a, c, t, g, unknown or other
  misc_feature (124)..(124): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (411)..(411): a, c, t, g, unknown or other
  misc_feature (411)..(411): n is a, c, g, or t
tcagtacagatcgtcacgaccggtgctcgatttagctacgactgcagggggtgggctcaggaggcagagctctgggaatctcaccatggcctggacccctctcctgcctcccctctcnctttcngcacgagtctctggacggcctctatgagtctgacacagtcccaccctggtgtacagtcgcccgaggacacggacggccaggtacttccngcctgnggagatgcagttcgacaagtaaaagttgtttttgggttttnaaaccgagtaaaagacgtacgaggtccacggtcctgtcgtttcggntagtcgttacgaaggacgaacgaagccaccggttcggacttccgaggtanacgtnttcgcgtcgcttacgntccgtgaaggtctaggttcgtacacgttgaatcngtacgcgggtccgggcgagggtcggaggagtggagcgtacgatttaagttacgttgttactaaacgaaacgttaaagtacctaagttactaaggttttacttttacgggttaggtcggtttacgggagggttaaccgtaggttaagtacgttacgttcgtaccgtaaggtcgtacccggacggtaaggtcccgcccgttacccggtgttaacccgccgttccttcccggtacccctcccttcctaaccgg

SEQ ID NO: 123032 - DNA, 764 bp, Homo sapiens
  misc_feature: GYAE6OF02JMWJE.35.11.A11.1.454.CMB.1.raw
tcagtacagatcgtcacgaccggtgctcgattagctacgactgcagggggggcgtcgaggaggcagagctctgggaatctcaccatggcctggacccctctcctgcctcccctcctcactttctgcacagtctctgagcctctatgagctgacacacgcccacccgtcggtgtcgagtcgtaccccgaggacacggaccggtacccgaggaactccgaccgtgccttcgaggacgatcgactaagttcgaccaaagcctaaatacttactttagtttacgggtaaccacggacgtaagaaacgttcgaacggaccgaacgggccccttagtaacgttcgaagttgaactagtaactaaacgcgtaactagacggtaccggccgttacgaacgggtacttccggtacgaacggtcgttaactttcgtaccgtacgggtaccctaacccgaggtaccgttaggaaaccgggggaacccttaaaacgccgggttaacccgttaaccgggtttaacacccgtacggtaacccgtaggttaaacgggacggttaccggaagggccgtaaacgaaagggaccgtaaggacgttagttaaccttagttaacgagtttaacacgttaacgcgtacgtacgaacccaactaacgaaccgttacggttaccgttacggtcgggaacgggtacggaacgacggtccgaaggtacccggtaaccggtacggtacgaccgtaccggacggtcccgtccggaccccgtacggtacccg

SEQ ID NO: 123033 - DNA, 793 bp, Homo sapiens
  misc_feature: GYAE6OF02JB227.35.11.A11.1.454.CMB.1.raw
  modified_base (236)..(236): a, c, t, g, unknown or other
  misc_feature (236)..(236): n is a, c, g, or t
  modified_base (330)..(330): a, c, t, g, unknown or other
  misc_feature (330)..(330): n is a, c, g, or t
tcagtacagatcgtcacgaccggtgctcgatttagctacgactgcagggggtgggctcaggaggcagagctctgggaatctcaccatggcctggacccctctcctgctccccctctcactttctgcacagtctctgaggcctcctatgagctgacacacgcctaccctcggtgtcaagtcgtccccgaggaccagacggccaggtaacttacctgctcgtggagactgcattcganaagaaagtgttttggttttacgaaccagaagtagtacgagacacgccctgtcttggtactatgttacgacggtacgagaaccggggggtacccncgggtaactcccgtgtacgacgtaacttcgtctacggtaccttccgaacgtccgccgtaacgggtaaccgtaagttcggtacctaaccgtttcgaacttaccgtacgtacccgtacgggttaaccgggtaccggtaacgggtacgggtaaggaacgttaggtaacggtcccggtaaagtacgttaaacgtttaaggtttcggtttaatttaacgaaaaccgtaaacgtaccgtaaaacgttaggtaaacctttttaaaggtttttccggtaacgggttttaggtcccggggttaaagggtaaccggggtaaaccgtttaaagggttaccggtaacgttagtaacccgggttttcggaacgtttacggaacccggtaaggtcccgttaacccgacccccggtttggtaacccgttaacccgttcggttttccccgaaccccggtttccccgttacccgtaacgg

SEQ ID NO: 123034 - DNA, 765 bp, Homo sapiens
  misc_feature: GYAE6OF02IU8OY.35.11.A11.1.454.CMB.1.raw
tcagtacagatcgtcacgaccggtgctcgatttagctacgactgcaggggggggctcaggaggcagagctctgggaatctcaccatggcctggacccctctcctgcctccccctcctcactttctgcacagtctctgacggcctcctatgagctgacacagcccaccctcggtgtcagtcgtaccccgaggacacggaccggccgaggtacttaccgtgctcgtaggagtatcgactagttcgtacaagtaaagttagttttagggttttcggaaccaggtaaagtaagtcgacggaccgtacggtccccgtggttccgttggtactagttggttacggaacggacgtacaacgtccggacccgtccgggtactcccgtaggagacgttacttccgtgtcgactccgactccgtcgaaggtctagtcggtacctacgtagtactctagtaccggacggtccggggaccctaggggaggtacggtaggtacgggacggtacgttacgttaacgtttacgtttagtttcggttaacgtttaaccaaaacgttaaacgtacgttaaagttacgtttaacttttaacgtttttcggttagggtttacggttaccggggtacggggtaaccggtaaccggttaacgttggttaaccgtaggttaccgttacggtaccgtaaccggtacccggtaacggtcccgtaccggtcccccgtacggttcctaccggtttccgtacccgttcccctacccgttccctaccgtaccg

SEQ ID NO: 123035 - DNA, 797 bp, Homo sapiens
  misc_feature: GYAE6OF02GP6JZ.35.11.A11.1.454.CMB.1.raw
  modified_base (222)..(222): a, c, t, g, unknown or other
  misc_feature (222)..(222): n is a, c, g, or t
tcagtacagatcgtcacgaccggtgctcgatttagctacgactgcagggggtgggctcaggaggcagagctctgggaatctcaccatggcctggacccctctcctgcctccccctcctcactttctgcacagtctctgacggcctcctatggagctagacacagcccacccgttcggtgtcacggtcgtaccccgaggacaggaccggcgaggtacttccgngcctctagggacagtgctagttacgactaaggtaacgttgtttttcgggttttacggaacctaaggaacggtaacgtccgaacgggacccgtaccgggtccccgttaggttaccgttagggtacctagtttcggttaccgggaaggtaccggaacgaaaccgggtcccggaccccggttcgggaccttcccggaggacggtaacgttctttcgtaccggtcgacctaccggtagccttacgggaaggaaccctacgacggttacaccgttacgaaccgtatccggaggtaccggacgtccgagggaccaaggaacggtacgggacgttacgttacgttacggttacttacggtacgaacgttaacgtacgacgaccgtaaacgaccctaaaccgtaacgttaaccgttaccggttaccgggtttgggtacccggggacggaccgggtacctaggtccgtaccggtacccgttagggtaccgacggtaaccggtacccggaccggttcccggtacccggtaccccgttacggtaccgttacccgttacccgtcccggttacccccacgttccccgg

SEQ ID NO: 123036 - DNA, 855 bp, Homo sapiens
  misc_feature: GYAE6OF02GHODU.35.11.A11.1.454.CMB.1.raw
tcagtacagatcgtcacgaccggtgctcgatttagctacgactgcagggggtgggctcaggaggcagagctctgggaatcgtcaccatggcctggacccctctcctgctccccctcctcactttctcgcacagtctctgaggcctcctatgagctgacacacgcccacccgtcggtgtcaggtcgtacccccgaggaccaggaccggcccaagggtactttaacccgtggccttcgtgggtacgagttcggacctattcggtacaaggtaaaaggttcgttttttgggttttttacggaaccgtaaggtaaaggtaacggttccgaacgggaccccgaacgggtccccccttagggttaccctttcgggttacctagtttcggttaccggaagggaacccgaaccgtaaaggccccggtaacccccggttccgggggaaccttccccggtaggtaacggtagttaccgtttaccgtccggtacggtaccctaccgacggtaccgttaccggtaaggggtaccttagttacggtacctaaccgttagacttacgtacttccggaccggtcggggacccgtagggtcgggaggtagtaggacggtcgtagtacttagtttagttcgttacgttaaccgaaacgttaacgtacctaagttacgtttaacgtttacgtttttcggttagggtttacggttacggggtacgggtaaccgggttaaccgttaacggttccggtaaccggttccgtacggtccgtaaccgtacccgtaacggtacccgtcccggtacccccggttaccggtaccgtaccgttccgttacccggttaccccgtcccgttcgtacccgtaaccg

SEQ ID NO: 123037 - DNA, 692 bp, Homo sapiens
  misc_feature: GYAE6OF02HEBVK.35.11.A11.1.454.CMB.1.raw
  modified_base (163)..(163): a, c, t, g, unknown or other
  misc_feature (163)..(163): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
tcagtacagatcgtcacgaccggtgctcgatttagctacgactgcagggggtgggctcaggaggcagagctctggggaatctcaccatggcctggatccctctacttcctccccctcctcactctctgcacaggctctgacggcctcctatgagctagacacngccctacccgtcggtgtctaggtcgtcccgaggacaggtaccggccaggactcacctggctccgtgggaacatcgctattcgaaccaagctaaattactacgttattaggtaccagacaagtagtacacggccgtaacgccctagttactagtacgtatagtagtaactaacgacagtcggaactcggacctacgtacggggcctccnggtaacgacgttctttancgtacggcctacgtacgccgtgaaaccgtaacaacgtacgtacgtcggtacgtaccgtagtacgtaggtacgggtactacgaacgggacgtaaagggaacgtaacgggacggttacgtaacggtttaattaaccggttaacgtaccggtaacttaacgaacgttacgaacgtaacgtaacctaaccgaaacgtaacgttaccgtaccgggtttggttaggaaccgggtacggcgaaaccgtcgaacggttaacccgtacgttcggaacgtcggaacccgtaccgggtacctcccggtaccccg

SEQ ID NO: 123038 - DNA, 455 bp, Homo sapiens
  misc_feature: GYAE6OF01BCH99.24.68.G02.1.454.CMB.1.raw
  modified_base (445)..(455): a, c, t, g, unknown or other
  misc_feature (445)..(455): n is a, c, g, or t
tcagactactatgtcacgaccggtgctcgatttagtcgatagtgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctcgtggggccagggtaccctggtcaccgtctcctcagcttccaccaacgggcccatccggtccttcccccgtggccgcccctgcctccaggacgcacctcgtcgggggcacgacgcggccctgggctgcctggtcaaggactactccacatagtagtctgacgcgggctggcaaggcgcatagnnnnnnnnnnn

SEQ ID NO: 123039 - DNA, 433 bp, Homo sapiens
  misc_feature: GYAE6OF01ETKB6.24.68.G02.1.454.CMB.1.raw
  modified_base (429)..(433): a, c, t, g, unknown or other
  misc_feature (429)..(433): n is a, c, g, or t
tcagactactatgtcacgaccggtgctcgatttagtcgatagtgaagggaaaggggctggagtggctgggagttacttggtctgacagacaaatgacatatcaagcggagtccgtgaggggccgattcaccatctccagggacaattccaagagaaccctctatctgcaaatgaacaacttgagagtcgaggatacggccgtttattactgtgtgacctcaggagtggctggaaaaagtcgtagtctcattcccgtgacctctggggccagggtaccctggtcaccgtctcctcagcttccaccaagggcccatcggtcttccccctggcgccctgctccaggagcacctctggggcacagcggccctgggctgcctggtcaggactacttccacatagtagtctgagcgggctggcaaggcgcatagnnnnn

SEQ ID NO: 123040 - DNA, 443 bp, Homo sapiens
  misc_feature: GYAE6OF01AEZ06.24.68.G02.1.454.CMB.1.raw
  modified_base (433)..(433): a, c, t, g, unknown or other
  misc_feature (433)..(433): n is a, c, g, or t
  modified_base (437)..(443): a, c, t, g, unknown or other
  misc_feature (437)..(443): n is a, c, g, or t
tcagactactatgtcacgaccggtgctcgatttagtcgatagtgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaagtcgtagtctcattcccgtcgacctctggggccagggtaccctggtcaccgtctcctcagcttccaccaagggcccatccggtcttccccctggccgccctgcctccaggacgcaccctctcgggggcacacgcggccctgggctgccctggtcaaggactactccacatagtagtctgagcgggctggcaaggcgnatgnnnnnnn

SEQ ID NO: 123041 - DNA, 549 bp, Homo sapiens
  misc_feature: GYAE6OF01EP61A.24.68.G02.1.454.CMB.1.raw
  modified_base (517)..(518): a, c, t, g, unknown or other
  misc_feature (517)..(518): n is a, c, g, or t
  modified_base (520)..(520): a, c, t, g, unknown or other
  misc_feature (520)..(520): n is a, c, g, or t
  modified_base (522)..(549): a, c, t, g, unknown or other
  misc_feature (522)..(549): n is a, c, g, or t
tcagactactatgtcacgaccggtgctcgatttagtcgatagtgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctctggggccagggtaccctggtcaccgtctcctcagcttccaccaagggcccatccggtcttcccccgtggccgccctcgcctccaggacgccacccgtcgtcgggggccaccgacggcccgggccccgtggggcctcggcccgttcgggtaccgaaacgggtaccttaccgtttccccgaactacgttaaggttaacgttccgtaggacggccggggtcgtcggggaccgaaacgggccgaccgtaagttacggnngngnnnnnnnnnnnnnnnnnnnnnnnnnnnn

SEQ ID NO: 123042 - DNA, 549 bp, Homo sapiens
  misc_feature: GYAE6OF01DDWL3.24.68.G02.1.454.CMB.1.raw
  modified_base (269)..(269): a, c, t, g, unknown or other
  misc_feature (269)..(269): n is a, c, g, or t
  modified_base (374)..(374): a, c, t, g, unknown or other
  misc_feature (374)..(374): n is a, c, g, or t
  modified_base (511)..(511): a, c, t, g, unknown or other
  misc_feature (511)..(511): n is a, c, g, or t
  modified_base (514)..(515): a, c, t, g, unknown or other
  misc_feature (514)..(515): n is a, c, g, or t
  modified_base (517)..(549): a, c, t, g, unknown or other
  misc_feature (517)..(549): n is a, c, g, or t
tcagactactatgtcacgaccggtgctcgatttagtcgatagtgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcgaggagtggctaggaaaaagtcgtagtctcacttcccgtcgaccttcgnggggccacgggtaccctggtctacccgtctccctcacgtccttccaccgaacgggccctagtccggttccttcccccgtggcccgtccctcgcctccgacggacncctaccgtcggtcggggcacgacggccggcccgtgggcctcgccgtggaccgaacggtacctacgtacccacgtaagttacgtcgtcttagggacggtccggggtcgtacgggaccgagggcgacgaacgtagacgnganngnnnnnnnnnnnnnnnnnnnnnnnnnnnnnnnnn

SEQ ID NO: 123043 - DNA, 707 bp, Homo sapiens
  misc_feature: GYAE6OF01BUCVE.24.68.G02.1.454.CMB.1.raw
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (674)..(676): a, c, t, g, unknown or other
  misc_feature (674)..(676): n is a, c, g, or t
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
  modified_base (682)..(707): a, c, t, g, unknown or other
  misc_feature (682)..(707): n is a, c, g, or t
tcagactactatgtcacgaccggtgctcgatttagtcgatagtgaagggaaaggggctggagtggctgggagttacttggtctgacagacaaatgacatatcacgcgggagtccgtgacggggccgagttccaccatctcccaggggacaattccaagacgaaccctctatctgactaaatagaaccaacttgagacggtcgagggattaccggtcccgttttaattacgtggtacgccgtacctcgtaggacgttggacgtaaggtaaaaacgtcgttaagtccgttcctacgttttccccggcgtaccgttcggttccgggggacccgtaacggggtaccccgttgggtaccgtaaccccgttccttcccgtaacgtacgtccccgttaccgaacccggtaacgggtaccccacggttccgggttcccctttacccccgtcgggtcccgtacccgtcgtcccgtaccacgggtaacgccgtaacccgttcggggtacggggacctaccggacgggtccccgggtccgtacgggggccgtcggccgggttaccggtaacgtaaacgggtacctttaaccggtacctagtaacggttaacgttacggtcgttacggaacggtccgggagttacgggacggaaccggcggtaactaagaggcacgnganctaggnnncncngnnnnnnnnnnnnnnnnnnnnnnnnnn

SEQ ID NO: 123044 - DNA, 452 bp, Homo sapiens
  misc_feature: GYAE6OF02GOX3W.24.68.G02.1.454.CMB.1.raw
  modified_base (434)..(452): a, c, t, g, unknown or other
  misc_feature (434)..(452): n is a, c, g, or t
tcagactactatgtcacgaccggtgctcgatttagtcgatagtgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctctggggccagggtaccctggtcaccgtctcctcagcttccaccaagggcccatcggtccttccccctggccgccctgcctccaggacgcacctcgtggggcacagcggccctgggctgctggtcaggctactccacatagtagtctgagcgggctggcgaaggcgcagtagnnnnnnnnnnnnnnnnnnn

SEQ ID NO: 123045 - DNA, 437 bp, Homo sapiens
  misc_feature: GYAE6OF02FKA2W.24.68.G02.1.454.CMB.1.raw
  modified_base (429)..(437): a, c, t, g, unknown or other
  misc_feature (429)..(437): n is a, c, g, or t
tcagactactatgtcacgaccggtgctcgatttagtcgatagtgaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtcgacctctggggccagggtaccctggtcaccgtctcctcagcttccaccaagggcccatcggtctccccctggcgccctgctccaggagcacctctggggcacagcggccctgggctgcctggtcaaggactactccacatagtagtctgagcgggctggcaaggcgcatagnnnnnnnnn

SEQ ID NO: 123046 - DNA, 502 bp, Homo sapiens
  misc_feature: GYAE6OF02H09NK.24.68.G02.1.454.CMB.1.raw
  modified_base (266)..(266): a, c, t, g, unknown or other
  misc_feature (266)..(266): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (469)..(502): a, c, t, g, unknown or other
  misc_feature (469)..(502): n is a, c, g, or t
tcagactactatgtcacgaccggtgctcgatttagtcgatagtgaagggaaaggggctggagtggctggggagttacttggtctgacagacaaatgacatatcacgcggagtccgtgaggggccgattcaccatctccagggacaattccaagagaaccctctatctgcaaatgaacaacttgagagtcgaggatacggcgtttattactgtgccgactcaggagtggctaggaaaaagtcgtagtctcattcccgtcgacctcgnggggccagggtaccctggtccaccgtctcctcacgcttccaccaacgggcccacgtcggttccttccccccgtggccgccctcgcctcccgaggacgccacctcgtcgggggaccacgacgccgggtccctgggctcgcctggtacagactactccacatagtagtcgtgacggccgggntcggngaaacggcgcaagtacgnnnnnnnnnnnnnnnnnnnnnnnnnnnnnnnnnn

SEQ ID NO: 123047 - DNA, 544 bp, Homo sapiens
  misc_feature: GYAE6OF02IM7JV.24.68.G02.1.454.CMB.1.raw
  modified_base (358)..(358): a, c, t, g, unknown or other
  misc_feature (358)..(358): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (510)..(512): a, c, t, g, unknown or other
  misc_feature (510)..(512): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (519)..(521): a, c, t, g, unknown or other
  misc_feature (519)..(521): n is a, c, g, or t
  modified_base (523)..(526): a, c, t, g, unknown or other
  misc_feature (523)..(526): n is a, c, g, or t
  modified_base (528)..(537): a, c, t, g, unknown or other
  misc_feature (528)..(537): n is a, c, g, or t
  modified_base (539)..(544): a, c, t, g, unknown or other
  misc_feature (539)..(544): n is a, c, g, or t
tcagactactatgtcacgaccggtgctcgatttagtcgatagtgaagggaaagggggctggagtggctgggagttacttggtctgacagacaaatgacatatcacgcggagtccgtgaggggccgattcaccatctccagggacaatttccaagagaaccctctatctgcaaatgaacaacttgagagtcgaggatacggccgtttattacgtgtgcgacctcaggagtggctaggaaaaagtcgtagtctcattcccgcgacctcgtggggccagggtaccctggtcaccgtctcctcagcttccaccaacgggccagtccggtcttccccgtggccgtccctgcctaccgaggacncacctcgtcggggcacgacgccggcccgtgggcctcgccgtggtacgaacggtacctaccttccaacgtagttaacggtacgttacgtacggaacggcgggtacgtacgggacgaagggccgaccgaagtacganagacncgngacncgtannnancangnnngnnnnannnnnnnnnncnnnnnn

SEQ ID NO: 123048 - DNA, 818 bp, Homo sapiens
  misc_feature: GYAE6OF01DSCGV.25.8.A08.1.454.CMB.1.raw
  modified_base (178)..(178): a, c, t, g, unknown or other
  misc_feature (178)..(178): n is a, c, g, or t
tcagactgtacagtcacgaccggtgctcgattttagcatactctactaacgtacacgaaaggggcaggagtcgagtccctaacgacggacgacacgacgacttcggactagtgaggtccctgctcgagctcctgggctccctgctggctcggtggctactcgtagggtttgtctaggnttagtttagacgtattcccaggtattcggaacccgtagtcctaccgtagttcccgtcccttggcgtggtcgtttcgtgggtcgggaagaccgtaggaaactacctaccctagtacctaccgtttcgacccgagggtccgaacgttcgaacggtaccgttaagtttaacgttccttaacgtttaggttaagttaaagtttgggtaactcgaaacgtaacgtaaaccggtaaccgggtaaacccctttaaacgtccgtacggtaacggtacgtacgtacgtcgtaccgtacgaacgtttacggaacgtaaccgacgggtacctaaggtaaacgtaaaacgtcgtaagtagggtaagtcggtactggtagggaacttagttaattttacgtacgtacctactacgagacgtacgtacgtacgaaccgtaacgtagtaaacgtttatttacgaacgttaatagttttaacctttacgacgttaaaccacccgttaaaagtcgtacgtaacgttcccgttacctaccccggttactaaaccgttacgttttccgaccggtacgggtaacctaaggggacggtaaacgttaacgttaacccggtaaacgttggttaaccgtggtttaacccgtgtccgttaaaccg

SEQ ID NO: 123049 - DNA, 798 bp, Homo sapiens
  misc_feature: GYAE6OF01B7M71.25.8.A08.1.454.CMB.1.raw
  modified_base (212)..(212): a, c, t, g, unknown or other
  misc_feature (212)..(212): n is a, c, g, or t
tcagactgtacagtcacgaccggtgctcgatttagcatactctacaacacacgaaagggggcaggagtcagtcccaacgaggacacagcatggacatgaggtccctgctcagctcctgggctcctgctgctctggctctcaggtggcagatgtgacatccagatcgaccctagtctccactcccgtccgtggcttgccttcgtaggtggganacagaactcacctatcacttgccgaggcgagtcgaaggactattagactacgttgtagtaaagttggtaactacgaaacgaacggaaaccgaaccgggtaaaccccttaaacgtccctagtacgttacgtaaccgagtaccgtaccgttaacctaagtttacgggacgtaccggtaccgggtacctaaacgttaacgtaaaacgtttcgaacggttacgggaaggttaggtacgtttacggacgggttaactaaaggtttaacgttttttacggtttacgtaaccgttaacgttaccgtaaggaaccgttaccggtacgtttaaccggaaccgttaaaccgtaggttaaaccgttagtttttaacgaaccttaaacgttaactttacgtttaaccgtttaccgaacctaaacccttaagtttacgtaacggttaaccttccgttaccctacccgttaccgtaacctttaccggtttaccgggaacccggtaaaccgggggtaacgttaaaccggggagttaaacggtaaccttaaacgtaaaccgttaaacgtcggtaccgggtacttaacccggacttaaacccg

SEQ ID NO: 123050 - DNA, 880 bp, Homo sapiens
  misc_feature: GYAE6OF02J2X6Q.25.8.A08.1.454.CMB.1.raw
  modified_base (204)..(204): a, c, t, g, unknown or other
  misc_feature (204)..(204): n is a, c, g, or t
tcagactgtacagtcacgaccggtgctcgatttagcatactctacaacacacgaaagggggcaggagtcagtcccaacgaggacacagcatggacatgagggtccctgctcagctccgtgggctcctgctgctctggctctcaggtggcagatgtgacatccagactgacccagtcctccactccctccgtggctgcctttcgnggtagggacacacgaactccacctattccacgttcgacccgaggccgacgttccaaggtacctagtttaacgtcctaaccgttaggttaaggttaaaacgttgggtaaccttaaccgaaaaccggtaaaccggtaaaaaccccggtaaccgggggttaaaaccccccttttaaaacgtcccgttaacggtaacctttaccgtaaccggtacttaccggtacccttaccggttaaaggtttcggggaaccgggtacccggtaacggggttacccctaaggttaccgtaaaacggttttccgaaacggttacggggtaaacggttcgggtaacgtttaccgggtaacggggttaaccttaaggttttaacgtttttaaccggtttaccgacccgtaacgttaccgaacgtaccgtaaccggtcccgttaacggtaaccctaaaccgttaggttaaacgtttacttttaaccggaacttaaaccttagttttaccgtttaccgtaacgttaacctaaccgttaaactttacgttaccgttaaccgtttccccggttaacccttacccgttaccgttaaccgttaccgggtttaccggaccgggtaacgggtaaccgtagggtaccgtaacgtacgtaaccgtaacggtacgtcggtacgaccgttacgacccttaaccg

SEQ ID NO: 123051 - DNA, 632 bp, Homo sapiens
  misc_feature: GYAE6OF02FKB8C.25.8.A08.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
tcagactgtacagtcacgaccggtgctcgatttagcatactctacaacacgacaaagggggcaggagtcagtccccaacgaggacacagcatggacatgagggtccctgctcagctcctgggctcctgctgctctggctctcaggtggctagatgtgacatccagatgacccagtctccatcctccgtggctgcttntgtgggancagaatcaccatcacttgccaggcgagtcacggacattagtactactgtgtaattggtatcaacagaaccagggaaccccttaaacgtcctagatctacgagtgtcctactaatttggagtacagggtaccatactaaagttacacgtaggacgtaggactcggtgggactagtatttagttacgtctatcagactacgccgtagtaccaacctagtaacgtattttacgactaacctattaacttttcgtagttacctaaccgtaattaacgttacgtatttaccgttaccgttacccttaccgtaccttacccgtttttacggaacccggtaacgggggtaacccgtaagggttaccgggaacgttaacgttaaccgtaaacggtacccgttacgggtacggtccggttacgaccgttaaccccg

SEQ ID NO: 123052 - DNA, 722 bp, Homo sapiens
  misc_feature: GYAE6OF02G61X6.25.8.A08.1.454.CMB.1.raw
  modified_base (249)..(249): a, c, t, g, unknown or other
  misc_feature (249)..(249): n is a, c, g, or t
  modified_base (584)..(584): a, c, t, g, unknown or other
  misc_feature (584)..(584): n is a, c, g, or t
tcagactgtacagtcacgaccggtgctcgatttagcatactctacaacgacacaaagggggcaggagtcagtcccaacgaggacacagcatggacatgagggtccctgctcagctcctgggctcctgctgctctggctctcaggtggcagatgtgacatccagactcgacccagtctccacttccctcccgttggcttgctttcgtggtgggacgactagaactcaccatctacttcgaccgtaggcgngtacgacggactattacggtcctacgtaggttagttaaagttggttaacttacaaacaacggaaaaccgaacggggttaaaacccccttaaacgtaccgtagtacgttaccgtaacggtactcgtacccttactaacgtttgggaacggtcggtacgggtccacgtaactaacgtactaacgtaggtaacggtagtacgttacgtacggtaacgtagtttaagttttacgttacgtacctaagtccgagacttacgcgtacgtaacctacgttagtaacgtttattacgtactaactacgtttactttacgtacttacctaaacgttacgtttanacgttaactccgttcctaaccgttccttaacgttccggtttacggacccggtaacgggtaacccggtagggtaacggtaacgtaaccgtaacgttaaaccggtacgttaggttaccggtacgttacgaccgtaaccgg

SEQ ID NO: 123053 - DNA, 285 bp, Homo sapiens
  misc_feature: GYAE6OF01D3UBY.4.1.A01.1.454.CMB.1.raw
  modified_base (283)..(285): a, c, t, g, unknown or other
  misc_feature (283)..(285): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcatcttccgccatctgactacagtgctctgagcgggctggcaaggcgcatagnnn

SEQ ID NO: 123054 - DNA, 539 bp, Homo sapiens
  misc_feature: GYAE6OF01AVUVW.4.1.A01.1.454.CMB.1.raw
tcagagcactgtagcacgaccggtgctcgatttagacgtctcatcgagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaacctggccaggctcccggtctcctcatctctgctgcgtccatcagggccactggtactccctgccctaggttccgtggcaggtgggtctgggacagagttcactctcaccatcagcagcctgcagtctgatgatgttgctagtttatactgtcatcaatatggtacgacccggtccctacggttcggacccaaaggggacccaagggttacggaaaacttaccgaaaacggtaacttgggtcggaccttggaccctaccgtattccgttgttccgttctaccg

SEQ ID NO: 123055 - DNA, 549 bp, Homo sapiens
  misc_feature: GYAE6OF01DJHR8.4.1.A01.1.454.CMB.1.raw
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtatggtcacagcttagcctggtaccagcagaaacctggccaggctcccggtctcctcatctctgctgcgtccatcagggccagtggtactccctgcctaggttccgtggcaggtgggtctggggacaggagttcactctcaccatcagcagcctgcagtctgatgatgttgctagttttatacgtgtacatcaagttagtgggtacgacccggtccctaacggtttccgggaccgtaaaggggaccctaaagggtacggaaaacttaccgaaaacgtacgttggtacggcttacgacctaccgtattccttcgttccttcgtaccg

SEQ ID NO: 123056 - DNA, 287 bp, Homo sapiens
  misc_feature: GYAE6OF01B0R84.4.1.A01.1.454.CMB.1.raw
  modified_base (283)..(287): a, c, t, g, unknown or other
  misc_feature (283)..(287): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcatcttcccgcatctgactacagtgctctgagcgggctggcaaggcgcatagnnnnn

SEQ ID NO: 123057 - DNA, 494 bp, Homo sapiens
  misc_feature: GYAE6OF01DC2WU.4.1.A01.1.454.CMB.1.raw
  modified_base (486)..(486): a, c, t, g, unknown or other
  misc_feature (486)..(486): n is a, c, g, or t
tcagagcactgtagcacgaccggtgctcgatttagacgtctcatcgagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtcatcaggccactggtatccctgcctaggttccgtggcagtgggtctgggacagagttcacgtctcaccatcagcagcctgcagtctgaatgatgttgctagtttattactgtcatcaatatggcgaccggtccctagttccggacctaagggaccaagggtgaaatcgaaacgactgtggctgctacatcngtctctac

SEQ ID NO: 123058 - DNA, 551 bp, Homo sapiens
  misc_feature: GYAE6OF01B6OSX.4.1.A01.1.454.CMB.1.raw
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctcccggtctcctcatcctctgcctgccgtccatcgagggccactggtactccctgccctaggttccgtggcaggtgggtctgggacaggagttcacttctacaccatcagcagcctgcagtctgatgatgtnctagtttatatgtnatcaatagtggtacgaccggtcctacggttcggaccgtaaacgggacctaaagggtaggaaaacttaccgaaaacggtaaccgtgggtccggacgttaggaccctaaccctagttaccttcgttccttcgtaaccc

SEQ ID NO: 123059 - DNA, 523 bp, Homo sapiens
  misc_feature: GYAE6OF01B6UOW.4.1.A01.1.454.CMB.1.raw
  modified_base (333)..(333): a, c, t, g, unknown or other
  misc_feature (333)..(333): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcaagaacctggccaggcctcccggtctcctcatctctgctgcgtccatcgaggccactggtactccctgccgtaggttccgnggcaggtcgggtctgggacaggtagttcactctacacatcagcacgcctgcagtctgatgatgtgctagtttatctgtcatcaatagtggtacgacccggccgtacggttccggaccgaagggaccgaagggtagaaactacgaaacgtagtggtcggctggacctaccgtatacgttcgtcttctaccg

SEQ ID NO: 123060 - DNA, 527 bp, Homo sapiens
  misc_feature: GYAE6OF01D0KTL.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccagggggagagagccaccctctcctgcagggccaattagagtattggtcacagcttagcctggtaccagcagaacctggccaggctccggtctcctcatctctgctgcgtccatcagggccactggtactcccctgcccaggttcccgtggcaggttggggtctggggacaggtagttcactctcaccatcagcagcctgcagtctgatgatgttgctagtttattactgtcatcaatagtggtcgacccggtcctacggttccggaccgaagggaccaagggtagaaactacgaaaacggtacgtggtcggctagccacctatcctgttcttcgcttccccg

SEQ ID NO: 123061 - DNA, 595 bp, Homo sapiens
  misc_feature: GYAE6OF01BUJLA.4.1.A01.1.454.CMB.1.raw
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacagcttagcctggtaccagcaagaacctggccaggcctcccggtctcctcatctctgctgccgtccatcgagggcccacgttcggtactccccgtgcccgtacgggtttccgtggctagggtcggggtcgtggggacaggtagttcactctcaccatcagcagcctgcagtctagatgtatgttgcttagttttacttacgtgtactaattacaaagttagttcgggtaccgtaccccggtacccgttacgggttccgggacccaaacggggacccgtaaaggggtacggaaaactaccgaaaacggtacgtgggtcggacctcggaccctaccgtacttaccgttcgttccttcgtacccg

SEQ ID NO: 123062 - DNA, 516 bp, Homo sapiens
  misc_feature: GYAE6OF01EVZ4P.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtcatcaggccatggtactccctgccaggttccgtggcaggtgggtctgggacaggagttcactctcaccatcagcagcctgcagtctgatgatgttgctagtttatactgtcatcaattatggtcgaccggtccctacggttccggaccgaagggaccaaagggtcggaaaacttcgaaaacgtagtggtcggctagacctaaccattactgttcttctacg

SEQ ID NO: 123063 - DNA, 523 bp, Homo sapiens
  misc_feature: GYAE6OF01EG8Y5.4.1.A01.1.454.CMB.1.raw
  modified_base (191)..(191): a, c, t, g, unknown or other
  misc_feature (191)..(191): n is a, c, g, or t
  modified_base (395)..(395): a, c, t, g, unknown or other
  misc_feature (395)..(395): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccagggganagagccaccctctcctgcagggccaatcagagtattggtcacagcttagcctggtaccagcagaaacctggccaggctcccggtctcctcatctctgctgccgtcatcagggccactggtactccctgcctaggttccgtggcaggtgggtctggggacaggagttcactctcaccatcagcagcctgcagtctgatgatgttnctagttttatactgtcatacaattatggtcgacccggtccctacggttcggaccgaagggaccaagggtagaaaactcgaaaaccggtatcggtcggactggacctaccatccttgttccttgtaccg

SEQ ID NO: 123064 - DNA, 285 bp, Homo sapiens
  misc_feature: GYAE6OF01DV9ST.4.1.A01.1.454.CMB.1.raw
  modified_base (283)..(285): a, c, t, g, unknown or other
  misc_feature (283)..(285): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcatcttcccgcatctgactacagtgctctgagcgggctggcaaggcgcatagnnn

SEQ ID NO: 123065 - DNA, 609 bp, Homo sapiens
  misc_feature: GYAE6OF01CXMZX.4.1.A01.1.454.CMB.1.raw
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtcctccgaggggagagacgcccaccctctcctgcagggccaatcagagtatggtcacagtcttagcctaggtaccagcagaacctggccaggcctcccggtctcccgtcacttcctcgtgtcctcgccgtccagtccgacgggtcctagtcggtactcccgtggccgtaggttccgnggccgtagggtcgggtcgtgggactaggtcttcactctcacatcagcacgtcctgctagtctgactgtatgtatcgttagtttactactgtanactactaagttcgtcggtacccgtacccggtcccgtacggttacccggaccgtaaacgggacctaaagggtacggtaaactaccggtaaaacggtcgttgggtaccggtctaacggacctaacccgttagttaccgttaccgttccgttaccgtacccg

SEQ ID NO: 123066 - DNA, 518 bp, Homo sapiens
  misc_feature: GYAE6OF01BCQ9W.4.1.A01.1.454.CMB.1.raw
  modified_base (192)..(192): a, c, t, g, unknown or other
  misc_feature (192)..(192): n is a, c, g, or t
  modified_base (393)..(393): a, c, t, g, unknown or other
  misc_feature (393)..(393): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccagggganagagccaccctctcctgcagggccaatcagagtattggtcacagcttagcctggtaccagcagaaacctggccaggcctcccggtctcctcatctctgctgcgtccatcaggccatggtactccctgcctaggttccgtggcaggtgggtctgggacagtagttcactctcacatcagcagcctgcagtctgatgatgttnctagtttatactgtcatcaatgtggtcgacccggtcctacggttccggaccaaggggtaccaagggtacgaaatccgaaaacgtacgtggtcggactcgacctacctattctcgtcttcgtaccg

SEQ ID NO: 123067 - DNA, 490 bp, Homo sapiens
  misc_feature: GYAE6OF01BHUJO.4.1.A01.1.454.CMB.1.raw
  modified_base (412)..(412): a, c, t, g, unknown or other
  misc_feature (412)..(412): n is a, c, g, or t
  modified_base (482)..(482): a, c, t, g, unknown or other
  misc_feature (482)..(482): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccatggtatccctgcctaggttccgtggcagtgggtctgggacagagttcactctcaccatcagcagcctgcagtctgatgatgttgctagtttatctgtcatcaatntggtgtaccgcctacgttcggaccaagggaccaagggtgaaatcgaaacgatggtggctgactacatctntcttctac

SEQ ID NO: 123068 - DNA, 530 bp, Homo sapiens
  misc_feature: GYAE6OF01CRWGC.4.1.A01.1.454.CMB.1.raw
  modified_base (332)..(332): a, c, t, g, unknown or other
  misc_feature (332)..(332): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccagggggagagagccaccctctcctgcagggccaatcagagtatggtcacagcttagcctggtaccagcagaaacctggccaggcctcccggtctcctcatctctgctgcgtccatcagggccactggtactccctgccaggttccgnggcaggtgggtctgggacaggagttcactctcaccatcagcagcctgcagtctgatgattgtgctagtttatactgtcattcaatgtggtacgaccggccctacggttccggacgtaaacggggacctaagggtacggaaactacgaaaacgtagtggtggacctggacctaaccgtattccgtcgttccttcgtacc

SEQ ID NO: 123069 - DNA, 572 bp, Homo sapiens
  misc_feature: GYAE6OF01BYX8L.4.1.A01.1.454.CMB.1.raw
  modified_base (193)..(193): a, c, t, g, unknown or other
  misc_feature (193)..(193): n is a, c, g, or t
  modified_base (343)..(343): a, c, t, g, unknown or other
  misc_feature (343)..(343): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccgaggggganagagccaccctctcctgcagggccaatcagagtattggtcacagcttagcctggtaccagcaagaacctggccaggcctcccggtctcctcatctctgctgccgtccatcgagggcccagtggtactccccgtgcccgtagggtttccgnggctagggtcgggtctggggacaggtagttcactctcaccatcagcagcctgcagtctgatgatgtgctagttttatactgtacattacaagttagtcgggtacgaaccccgggtccctaacgggttccggaccgaaacggggtacctaaaggggtacggaaaacttacgaaaaccggtagtggtacggcttaggaccctaaccgattccgttcgttcctttactaccg

SEQ ID NO: 123070 - DNA, 536 bp, Homo sapiens
  misc_feature: GYAE6OF01ARQYA.4.1.A01.1.454.CMB.1.raw
  modified_base (192)..(192): a, c, t, g, unknown or other
  misc_feature (192)..(192): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccagggganagagccaccctctcctgcagggccaatcagagtattggtcacagcttagcctggtaccagcagaacctggccaggctcccggtctcctcatctctgctgcgtcatcagggccactggtactcccctgcccaggttccgtggcaggtgggtctgggacagagttcactctcaccatcagcagcctgcagtctgatgatgttgctagtttattctgtcatcaattagtggtacgacccggtccctacggttccggaccgaacggggaccgaaagggtacggaaaactccgaaaaccggtacgtggtcggctaggacctaaccctattccgttgttccttcgtaccg

SEQ ID NO: 123071 - DNA, 587 bp, Homo sapiens
  misc_feature: GYAE6OF01DA60T.4.1.A01.1.454.CMB.1.raw
  modified_base (286)..(286): a, c, t, g, unknown or other
  misc_feature (286)..(286): n is a, c, g, or t
tcagagcactgtagcacgaccggtgctcgatttagacgtctcatcgagggggggaactgctcagtttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctcccggtctcctnactctcgtgctgcgtccatcgagggccaactggtactccctgccctagggttccgtggccagggtcgggtcgtgggactaggagtttcgactctcgaccatcagcacgctgcagtctgaatgactgtgtctagtttatacgtgtcgattacaagttcgtcgggttacgacccgggttcccaagggtttacccggaccgtaaacggggtacccaaaggggtacgtaaactaccggtaaaaacgacttagggtcggtaccgtacggactacccgtaattccgtttaacgtcgttacctaaccg

SEQ ID NO: 123072 - DNA, 629 bp, Homo sapiens
  misc_feature: GYAE6OF01AUV4O.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagcccaccctctcctgcagggccaatcagagtattggtcacagcttagcctggtaccagcagaaacctggccaggcctccccggtctcctcatctctgctgccgtccatcgagggcccacgtggtactccccgtgccctagggttcccgtggccgtaggttcggggtctggggaccagggtacgtttccacgttcctccgaacctattccgaagccagccctgcctagtctgatgattgttgctagttttatactgtctattacaattagtcgggttacgaccccgggtccctaacgggtttccgggaccgtaaacggggaccctaaaggggttacggaaaaaccgttaccgaaaaaccgggtaaccgttggtcgggtaccgttacggaccctaaccccgtaagtttacccgttggtttccccttcgttaacccg

SEQ ID NO: 123073 - DNA, 753 bp, Homo sapiens
  misc_feature: GYAE6OF01DLZVP.4.1.A01.1.454.CMB.1.raw
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacagcttagcctggtaccagcagaaacctggccaggcctcccggtctcctcatctctgctgccgtccagtcgacgggccctagttcggtactcccctcggcccgtacgggttccggtggcgtaggttggggtccgtggggaactaggacgtttccaccgtttcctccgaacccgtactccgagccgaacgtcccgttaggcctaggttcttaggtagttcgagttttcggttagtaccgtttaagtttttactttaaccgtttggttaacctaagtttactaaaaggtttacggttaccgggggtttaaccggtaccccccggggttaccccttaacccgggggtttaccccggggaacccgggtaaaaccggggggtaaccctaaaagggggtaccgggtaaaaacgttaacccggaaaaaaccgggtacgtttacggggtaccggggtacccttaccggaacccgttaacccgttaacggtttcccgttttaccggttaccctttcgttaacccccg

SEQ ID NO: 123074 - DNA, 552 bp, Homo sapiens
  misc_feature: GYAE6OF01A4H6I.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctcccggtctcctcatctctgctgcgtccatcagggccacgtggtactcccctgcccaggttccgtggctaggtggggtctggggacaggtagttcactctcaccatcagcagcctgcagtctgatgattgttgcttagttttattactgttcattactaattagtcgggtacgacccggtccctacggttaccggacctaacggggaacctaagggtacggaaataccgaaacggtacgtaggtcggactacgacctaacctattccgttgtccttctaccg

SEQ ID NO: 123075 - DNA, 498 bp, Homo sapiens
  misc_feature: GYAE6OF01BLHVM.4.1.A01.1.454.CMB.1.raw
  modified_base (496)..(496): a, c, t, g, unknown or other
  misc_feature (496)..(496): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgctagtttatactgtcatcaatatggtgacccggtcccacggttcggacccgaaagggtaccaagggtgaaactcgaaacgatggtggctgcaccatctcgtcttnac

SEQ ID NO: 123076 - DNA, 546 bp, Homo sapiens
  misc_feature: GYAE6OF01AZU6U.4.1.A01.1.454.CMB.1.raw
  modified_base (191)..(191): a, c, t, g, unknown or other
  misc_feature (191)..(191): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccagggganagagccaccctctcctgcagggccaatcagagtattggtcacagcttagcctggtaccagcagaacctggccaggctcccggtctcctcatctctgctgcgtccatcgagggccagtggtactccctgccctaggttccgtggccgtaggtgggtctggggacagtagttcactctcaccatcagcagcctgctagtctagatgattgttgacttagtttattactgtactatacaattagtggtaccgacccggtcctacggttcggaccgaagggaccctaagggtcgaaataccgaaacggtactagggtgtccgtagtacctacctacttacctcgttcctttcgtacccg

SEQ ID NO: 123077 - DNA, 651 bp, Homo sapiens
  misc_feature: GYAE6OF01EI82C.4.1.A01.1.454.CMB.1.raw
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcacgggccaatcgagagttattggtcacagtcttagcctggtaccagcaagaacctggccaggcctcccggtctcctcatcctctgctgccgtccagtcgacgggccacgttggtactcccgtgcccgtagggttccgtggccgtagggtcgggtcgtggggacaggtacgttccaccgtcctacgaacctagtccgacgtcacggtcccgtgctacgttctagacttggtattggttcgtactttagttttattacgttgtactagtactaagttcggtcgggtaccgtaccccggcccgttaacggtccggaacccggtaaagggacccgtaaagggtacggaaaaccgttacgaaaaccggtaccgttagggtccggtacctaccggacccttaacctacgttacccggtttactttcccgttacccgttacccg

SEQ ID NO: 123078 - DNA, 591 bp, Homo sapiens
  misc_feature: GYAE6OF01EBB5C.4.1.A01.1.454.CMB.1.raw
  modified_base (341)..(341): a, c, t, g, unknown or other
  misc_feature (341)..(341): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggtcacagcttagcctggtaccagcaagaaacctggccaggcctcccggtctcctcactctctgctgccgtcatcgacgggccacgtggtactcccgtgcctaggttccgnggctaggtcgggtcgtaggggacaggtcgttcactcgtccacctatcacgcacgcctagctagtctgactgtattgtgtcttagttttactctgttcattactaagttgtaggtcccggtacccggtcccgttacggttacccgggaccgtaaacggggtaacccgtaaaggggttacgaaaactaaccggaaaacgtagttcgggtacgctaccgacctaaccgattccgtgttcccttcgtaaccccg

SEQ ID NO: 123079 - DNA, 286 bp, Homo sapiens
  misc_feature: GYAE6OF01BKB4Y.4.1.A01.1.454.CMB.1.raw
  modified_base (281)..(286): a, c, t, g, unknown or other
  misc_feature (281)..(286): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcatctccgcatctgactacagtgctctgagcgggctggcaaggcgcatagnnnnnn

SEQ ID NO: 123080 - DNA, 664 bp, Homo sapiens
  misc_feature: GYAE6OF01DB61G.4.1.A01.1.454.CMB.1.raw
tcagagcactgtagcacgaccggtgctcgatttagacgtctcatcagggggggaactgctcagttaggacccagacggaaccatggaagccccagcgcagcttctcttcctcctgctactctggctcccagaatccgctggagaatcgtagtgacgcagtctccagccaccctgtctgtgtctcgaggggagagagccaccctctcctgcagggccaatcagagtattggtcacagtcttagccgtggtaccagcagaaacctggccaggcctcccggtctcctcactctcgtcgctcggcgtccactccgacggggccctacgttggtacctccccgtcggtcccgtacgggttccgtggtcgtagggttcgggtcgtggggaactaggtacgttccacgtcctacacctatcgacgcacgtcctggacctaggttctagacgttaggtattgggtttagtacgtttaaggttttacttaccgtgttacctattacgtaagtttacggttcgggtaccggtaaccccgggtccgttaaccgggtttacccgggaccggtaaacggggaccgtaaaggggtacggtaaaactaccgtaaaaccggtacgttcgggtacggccgtacgaaccctacgtacttccgtacgtttcccgtctaacccg

SEQ ID NO: 123081 - DNA, 511 bp, Homo sapiens
  misc_feature: GYAE6OF01B8H3U.4.1.A01.1.454.CMB.1.raw
  modified_base (278)..(278): a, c, t, g, unknown or other
  misc_feature (278)..(278): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagcccaccctctcctgcagggccaatcagagtattggtcacagcttagcctggtaccagcagaaacctggccaggctcccggtntcctcatctctgctgcgtccatcgagggccacgtggtactccctgccctaggttccgtggcagtggtctgggacagagttcactctcaccatcagcagcctgcagtctgatgatgtgctagtttatactgtcatacaattagtcgggtcgacccggtccctacggttccggaccgaagggaccaagggtaggaaactcgaaacgtatggtgctagctacatctgtcttcgtac

SEQ ID NO: 123082 - DNA, 660 bp, Homo sapiens
  misc_feature: GYAE6OF01EGM60.4.1.A01.1.454.CMB.1.raw
  modified_base (238)..(238): a, c, t, g, unknown or other
  misc_feature (238)..(238): n is a, c, g, or t
  modified_base (345)..(345): a, c, t, g, unknown or other
  misc_feature (345)..(345): n is a, c, g, or t
tcagagcactgtagcacgaccggtgctcgatttagacgtctcatcagggggggaactgctcagttaggaccctagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggcacngcttagcctggtaccagcagaacctggccaggcctcccggtctcctcattcctctgcctggccgtccatcgacgggccacgtggtactcccgtgcctacggttccgnggcaggttcggtcgtgggacaggtacgttcactctacacctatcacgcacgtcccgtgctacgttccgtagtacttggatttggttgtaccttaagtttttactaccgtttgtactagttaacctaagttacgttcgggtaccggtaccccgggttaccccgtacggtttacccggggacccgtaaaacgggggtacccgtaaaggggttaacggaaaaaccttaccggtaaaaaccgtaacggttcggttacgggtaccctacgggaacccctaaccgtatttacccgttcgttttcccgttccttaaccccgg

SEQ ID NO: 123083 - DNA, 316 bp, Homo sapiens
  misc_feature: GYAE6OF01A9NEW.4.1.A01.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (281)..(288): a, c, t, g, unknown or other
  misc_feature (281)..(288): n is a, c, g, or t
  modified_base (290)..(316): a, c, t, g, unknown or other
  misc_feature (290)..(316): n is a, c, g, or t
tcagagcactgtagcacgaccggtgctcgatttagacgtctcatcagggccactggtatccctgccaggttccgtggcagtggggtctgggacagagtttcactctcaccatcagcagcctgcagtctgatgatgttgcagttttattactgtcatcaatatggtgaccggcccagttcggccaagggtaccaaggtgaaatcgaaagactgtgctgcaccatctgtctcatctccgcatctgactacagtnctcngagcgggtctggcaaggcncatagnnnnnnnncnnnnnnnnnnnnnnnnnnnnnnnnnnn

SEQ ID NO: 123084 - DNA, 789 bp, Homo sapiens
  misc_feature: GYAE6OF01CD6IC.4.1.A01.1.454.CMB.1.raw
  modified_base (193)..(193): a, c, t, g, unknown or other
  misc_feature (193)..(193): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaatcgtagtgacgcagtctccagccaccctgtctgtgtctccgagggganagacgcccaccctctcctgcgaggccaatcagtagtattggtcacagtcttacgcctaggtaccagtacaacgaaaccgtggccacggtccgtcccggtctcctacactctcgtcgctcgccgtaccagtcgacggcctagttcggtacctcccgtcgtccgttacgggttcccggtggacgtagggttcgggtacgtacggggaactaggtacgttccaccgtttaccaccgaaccctagtaccgaacggtacaacggtacgttacgggacgtaccgttaaggtaacggtttacgttttaggaccgttaggttacgtttaactttaccgtaggttacgtacggtacggttaggttagggttacggttaacgtcccgttaacccgggtaacccgggttaccgggtttacccgggaacccggtaaacgggggtaaacccggtaaacggggttaaacgggaaaaccgttaaaccgggtaaaaaccgggttacccggtttaaggggtaccgggtacccgttaaccggtaacccgttaacccgttaacgtttacccgttacggttttaccccttaaccggttacccgttttaccccccgg

SEQ ID NO: 123085 - DNA, 638 bp, Homo sapiens
  misc_feature: GYAE6OF01AQD8U.4.1.A01.1.454.CMB.1.raw
  modified_base (347)..(347): a, c, t, g, unknown or other
  misc_feature (347)..(347): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgccaccctctcctgcagggccaatcagagtattggtcacagcttagcctggtaccagcagaacctggccaggcctcccggtctcctcatctctgctgccgtccagtcgacgggcctacgtcggtactccccgtgcccgtacgggttccgnggaccgtagggttcggggtcgtacggggacaggtacgttccacttcctaccaaccctagtaccgacgccacggtcccgttagccgtagtcctagtagtcgtagtttggttcgtactttagttttacttacgtcgtactatacgtaagttggtcgggtaccgaccccggtcccgttacgggttccggaaccggtaacgggtaccgtaaagggttaccggaaaacgttaccgaaaacggtacgtcgggtcggacctacgaccctaccgtacttcgtacgttccttcgtacccg

SEQ ID NO: 123086 - DNA, 602 bp, Homo sapiens
  misc_feature: GYAE6OF01BLBVV.4.1.A01.1.454.CMB.1.raw
  modified_base (339)..(339): a, c, t, g, unknown or other
  misc_feature (339)..(339): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggggagagagccaccctctcctgcagggccaatcagagtattggtcacagcttagcctggtaccagacagaaacctggccaggcctcccggtctcctcatctctgctgccgtccatcgagggccatggtactcccgtgccgtaggttccgnggcgtagggttcgggtctaggggacaggtacgttcacttcgtcaccagtccagcacgcctgcgacgtctagatgtagttgttacgcttaagttttacttacgtgtactattacgtaattagtcggtaccggtaccccggtccgtaccgggttaccggaccgaaacggggtaccgtaaaggggttacggaaaacttacgaaaaccgtagttcgggtacggccttcggacctaaccgtacttaccgttcgttcccttcgtacccg

SEQ ID NO: 123087 - DNA, 626 bp, Homo sapiens
  misc_feature: GYAE6OF01A9KHS.4.1.A01.1.454.CMB.1.raw
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctcgaggggagagagccaccctctcctgcagggccaatcagagtattggtcacagcttagcctggtaccagcaagaacctggccaggcctcccggtctcctcacttcctctgcctcgccgtccatccgacgggccacgtggtactccccgngcccgtaggttccggnggcgagggttcgggtcgtaggggacaggtacgttcgacctcgtcaacctatcacgcacgtccgtagcgagttcgtgagtggtacttggttacgtacttagttttattaccgtgttctaatacgtaaagttagtcgggtaccgacccccgggtaccttaccgggtttacccggaacccggtaaacgggaccggtaaacgggttaggaaacctaaccggaaaccggtacgttaggtcgggcctaggaccctaacctattaccgttgttccttacgtcccg

SEQ ID NO: 123088 - DNA, 289 bp, Homo sapiens
  misc_feature: GYAE6OF01A15AD.4.1.A01.1.454.CMB.1.raw
  modified_base (285)..(289): a, c, t, g, unknown or other
  misc_feature (285)..(289): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaaagggaccaaggtggaaatcaaaacgaactgtggctgcaccatctgtcttcatccttccgcatctgactacagtgctctgagcgggctggcaaggcgcatagnnnnn

SEQ ID NO: 123089 - DNA, 831 bp, Homo sapiens
  misc_feature: GYAE6OF01D3UMC.4.1.A01.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
tcagagcactgtagcacgaccggtgctcgatttagacgtctcatcgaggggggaactgctcagttaggacccagacggaaccatggaacgccccagcgcagcttctcttcctcctgctactctggctcccagaatccgctggaagaaatcgtagtgacgcagtctccagcccacctgtctgtcgtctcgagggganagacgccctaccctntcccgtgccgacgggacctaatcgaggtagttagttcggtaccaacgacgtacgtttacgccgttacggtaccgacgaccaacggaaacccgtcggacccgtacgggtcccgtcccggttccttccctactacgtttccttcgtcggtccgttcggttcccgtaacgttccaacggggtcccggtaaccttacggttacgttacccctccggtttaccccaaggggttttccccgtggggtaccgaacggtttgggggtacccttggggggaacctacgggtaaacggtttccctaacccgttaccctaccgtaaccccgaaagttcccgaacgggtacccgtaaccggtacccgttacggtaccgtacggttaccgtttacggtaacgttacggttaagttcggttacggttacgttaacgttttaaacgttttacgttacgttacgtaacgtaacgtaacgtaacggttacgggtaccgggtaacccggtacccggttaccggttaccgggtaaccggaacgggtaacggtaacggtaaacggtaaacgtaacgtaacgtaacgtacggtcggaccgtacgtaccgtaccttacgttacttccgttccgtccgtaccg

SEQ ID NO: 123090 - DNA, 637 bp, Homo sapiens
  misc_feature: GYAE6OF01EQY27.4.1.A01.1.454.CMB.1.raw
  modified_base (291)..(291): a, c, t, g, unknown or other
  misc_feature (291)..(291): n is a, c, g, or t
tcagagcactgtagcacgaccggtgctcgatttagacgtctcatcaggggggaactgctcagttaggacccagacggaaccatggaagcccccagcgcagcttctcttcctcctgctactctggctcccagaatccgctggagaaatcgtagtgacgcagtctccagccaccctgtctgtgtctccgagggggagagacgcccaccctctcctgcagggccaaatcagagttattggtcacagcttagcctggtaccagcaagaaacctggccaggcctcccggtctcctnactctctgctgccgtccagtccgacgggcctagtggtactcccgtgcccgtacgggttccgcggcgtagggtcgggtccgtaggggacctaggtacgttccacgttccgtaccaacctatccgagtccgacggtccctggcctacgttctagagttcgtattggttacgacgtttaagttttacgttacgttgttaccagttactaagttacggtcgggtaccgaccccggtaccgttaccggttaccggaccgtaaacgggaaccgtaaggggtacgaaaactaccgaaaacggtagtcggtcggaccgtacgaccctacctagttccttcggttcctccgtacg

SEQ ID NO: 123091 - DNA, 617 bp, Homo sapiens
  misc_feature: GYAE6OF01D4X7L.4.1.A01.1.454.CMB.1.raw
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggganagacgccaccctctcctgccagggccaatcagagtattggcacngcttagcctggtaccagcaagaaacctggaccaggcctcccggtctcctcatctctgcctgccgtccagtcgacgggccagtggtactcccgtgcctaggtccgtggcctaggtggtcgtgggacaggtacgttcacttcaccacacgtcgacgcacgtcctgcctagtctagtagtgtattgttagtcgttaagttttacttacgttagtactacttactaagttacgtcgggttaccggtacccggtaccccgttaaccgttccgggacccgaaacggggtacccgtaaagggtaccggtaaaagtaccgtaaaacggtaccgtggtcgggacctacgacccgtaacgtagttaccgtcggtttccctcgttaacccg

SEQ ID NO: 123092 - DNA, 865 bp, Homo sapiens
  misc_feature: GYAE6OF01AHPFP.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgccacctctcctgcgagggccaatcagagtattggtcacagcttacgccgtggtaccagcaacgaacctggaccacggcctcccggtctcctcactctctcgctcgtcgtccagtcgacgggcctaacgttcggtactcccgtgaccgtacgggtttccgtggacgtagggttcggggtcgtacggggaactagggtactttacccgtaccttcgtacccgaacctacgttaccggacgccgaacggtccccgtggaccctaggtttccaggttacgttggttaagttcgggtttacgtacgtttaacggtttttaactttaccgttacggttaccttaattaccggttaaaagtttacgggttaccggggttaaccccgggtaaccccccggggttacccgtttaacccggggggttacccccgggtaaacccgggtaaaaccggggggttaaacccggtaaaacggggggtttaaaaccgggtaaaaaacccgggtttaaaccccgggaaaaaaaaccccgggttttaccggggttaaccgggggtttaaaccccgggttaccgtttaaacccccggggtaacccctttaaaccccgggttaacccgtttttaccccggttaacccggttttttaacccccgtttaacccccgtttaaacccccgg

SEQ ID NO: 123093 - DNA, 607 bp, Homo sapiens
  misc_feature: GYAE6OF01CDR4A.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcgagggccaatcagagtattggtcacagtcttagccgtggtaccagcacgaacctggccaggcctcccggtctcctcatcctctcgctgccgtccatcgacgggcctacgtcggtactcccgtgcccgtaggttccgtggacgtaggtcgggtcgtgggactaggtacgttccacgtctacacctatccgacgtcacgtcctgacctagttcgtagtatgtattggttgtacttagttttacttacgtgtactatactaagttacgtcggtaccgtacccggtacccgtacggttccgggaccgtaacgggaccgtaagggtacgaaaactaccgaaaacggtcgtagggtcggcctacgaccctacctagttaccgtcggttccttcgtacccg

SEQ ID NO: 123094 - DNA, 694 bp, Homo sapiens
  misc_feature: GYAE6OF01CFOR1.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggggagagacgccaccctctcctgcagggccaatcagagttatggtcacagcttagcctggtaccagcaacgaaccgtggccgaggcctcccggtctccctcactctctcgctcgccgtccatccgacgggcctagtcggtactcccctggccgtacggttccgtggcgtaggttcggggtcgtggggacaggtacgttccacctcgtaccaccgtataccgacgccgtaccgtcccttggacctacggttctaggtacgttgtagttcggttcgtacttaagtttttacttacttggtacctaattaaccgtaagtttcgtacgggttaccgggtaacccccgggttacccgttaaccgggtttacccgggaacggtaaaccgggggtaaccttaaagggggaaaccggtaaaacttaacccggaaaaacggttaccggttagggttaccggcgttacccgaacccttaccgtacttccgtttacggtttccttacgttaccccg

SEQ ID NO: 123095 - DNA, 717 bp, Homo sapiens
  misc_feature: GYAE6OF01BWAWD.4.1.A01.1.454.CMB.1.raw
  modified_base (192)..(192): a, c, t, g, unknown or other
  misc_feature (192)..(192): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccacctgtctgtgtctccgagggganagacgcccaccctctcctgcgacggccaatcagagtattggcacagcttagcctggtaccagcaagaaaccgtggccaggcctcccggtctcctcatctctgctgcgtccagtcgaggccacgtggtactcccgtgcccgtagggtttccgtaggccgtagggttcggggttaccgtaggggaactaaggtacgtttcccaaccgttcctaccgaacctacgtccacggcccaacggtccctggaccttaaggttcccgtagtaagttgtaagtttcggttacgtaacgtttaacgttttttaattccgttacggttactaacttacgtaaagttacgttaccggggttaccggaacccccgggttacccgttaacgggtttcccgggaaacccggtaaaacggggttaacccggaaagggttaaccgggaaaaccgttaccgtaaaaaccgggtacgtcgggttacggaccgttacggaccctaaacccgtacgtttaccgtcggtttccctttaacgtacccg

SEQ ID NO: 123096 - DNA, 650 bp, Homo sapiens
  misc_feature: GYAE6OF01AC344.4.1.A01.1.454.CMB.1.raw
  modified_base (193)..(193): a, c, t, g, unknown or other
  misc_feature (193)..(193): n is a, c, g, or t
  modified_base (354)..(354): a, c, t, g, unknown or other
  misc_feature (354)..(354): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccacctgtctgtgtctccgagggganagacgcccaccctctcctgcagggccaatcagagtattggtcacagcttagccttggtaccagcaagaacctggccaggcctacccggtctcccgtcattcctcgtgctcgcgttccagtcgacgggtccacgtggtactccccgtagccctaggttccgnggcgtacggttcgggtctggggaactaggtacgtttccacgtcaccaacctgtaccgagtcacgtccgtagctacggttctacgaagtcgtattgggttcgacttaggtttactacgtgtactaagttacaagttcgtacggtaccgtacccggtacccttacgggttaccggaccgtaaacgggtaacccgtaacggggttacggtaaaaccgtacgtaaaacggtaccgttaggtccggtaccgttacggaacccttaccgttagttacccgttacgttccgtttacgtacccg

SEQ ID NO: 123097 - DNA, 559 bp, Homo sapiens
  misc_feature: GYAE6OF01AOT38.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaacctggccaggcctcccggtctccctcatctctgctgcgtccatcgagggccacgtggtactcccctgccctagggttccgtggcctagggttcggggtcctgggggaccaggtacgtttccaccgttctaccaccatccgagcacgtccctgctagtctgatgtagtgttgcttagtttattactgtcatactaagtagtggtcgtacccggccctacggttccgaccgaacgggaccgaaggtacgaaactacgaaacgtacgtggtcggctacgactaccgtattactcgttcttcgtac

SEQ ID NO: 123098 - DNA, 285 bp, Homo sapiens
  misc_feature: GYAE6OF01AYRS5.4.1.A01.1.454.CMB.1.raw
  modified_base (284)..(285): a, c, t, g, unknown or other
  misc_feature (284)..(285): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcatcttcccgccatctgactacagtgctctgagcgggctggcaaggcgcatagnn

SEQ ID NO: 123099 - DNA, 798 bp, Homo sapiens
  misc_feature: GYAE6OF01CTM84.4.1.A01.1.454.CMB.1.raw
tcagagcactgtagcacgaccggtgctcgatttagacgtctcatcgagggggggaactgctcagttaggacccagacggaaccatggaagccccagcgcagcttctcttcctcctgctactctggctcccagaatccgctggagaaatcgtagtgacgcagtctccagccaccctgtctgtcgtctccagggggagagagccaccctctcctgcacgggccaatcagagttatcggtcacgagcttagccgttggtacccaggaccaacggaaaccctcgggaccaacgggccttcccggtcctaccctctactccttctcggcctcggccgttaccagtccgaagggtccctaacgttcgggtacctccccgtacggtccgtacgggttcccggtggccgttacggggtcgggttacggtacggggtaactacgggtacgtttcccgaccttaccgtaccgtaacccgtaacgtccgacggtacccgtaccgggtcccctacgggacttaaccgggttcttacgggtaacgttaggtacgtttcgggttacgttaacccgtttaggttttttaacctaccgtttacgtaccttaattaccgtaaaggttggttaccgggtaccggtacccccggacccggtttaacccgggttaccggggaccccgtaaaggggtaaaccccgtaaggggttaaacgggaaaacccttaccggaaaaacggttacggttagggtacgggtccttaccggacctaacccgttaccttacgggttacccttaccgtttccgttaacccg

SEQ ID NO: 123100 - DNA, 663 bp, Homo sapiens
  misc_feature: GYAE6OF01CSY5U.4.1.A01.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
tcagagcactgtagcacgaccggtgctcgatttagacgtctcatcgaggggggaactgctcagttaggacccagacggaaccatggaacgcccagcgcagcttctcttcctcctgctactctggctcccagaatccgctggaagaaatcgtagtgacgcagtctccacgccacctgtcttgtctccgaaggggaanacgcccacctctcctgcgaggccagtcagtagtgtancagctactagcctaggtaaccaacagaaaccgtggccgaggcctacccgaggtcctcctcacttcgtatcgatgacactccgagacgggtccaacgtggaccaacgtccccgaagtaccccgtaaggttaccgaggtcggacgtaggggtttcggtccggtaagggaacctaacggtccttacgtaacctcttacccgaacctacgtacccaccgtacgtcccgttagggaacctcgttaggaacgtttatttcgacttagttttaactgatcgagtccgaagtcggaagtaccgtaagtccggtcttccggtactacccgttacgttaccgggttacgggacgggaacggtaaccgaaagggtagaaacggtaacgaacgaaacggtaacgtgggtacgacctacggctaaccgtctcgttgttaaccc

SEQ ID NO: 123101 - DNA, 796 bp, Homo sapiens
  misc_feature: GYAE6OF01BL8D5.4.1.A01.1.454.CMB.1.raw
  modified_base (627)..(627): a, c, t, g, unknown or other
  misc_feature (627)..(627): n is a, c, g, or t
  modified_base (746)..(746): a, c, t, g, unknown or other
  misc_feature (746)..(746): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggaagaaatcgtagtgacgcagtcctccagcccacctgtctgtgtctccgaggggagagacgcccaccctctccgtgcgagggaccaatcgaaggtagttacgttcggacaacgacgtcgtttacgccgttacgggtaaccacggaccaaacggtaaacccgtcgggacccgtaaccgggtcccgttccccgggttaccttcccgtaccgtactttcccgtccgtggtcccgttcggtacccgtttacccgaacgttaccgggaccgggtaccccttaacggttccgggttaacccttccccggtcgtacccggttacgggttcccggtaggcgtacggggttcggggttcgacggggtactaggtaccgttccaacgttctacctaaccgtataccggaacgtccgtacggacccgtgacgttaacgtttgaagggtacttagttagtttcggttacgttaacgttttaaagttttactaccggttnttaactaactttaacgtaagttccgggtcggtaacccggtacccggtacgtaccgggttaccgacggtaaacggtaacgtaacggtaaacggaaactaacggaaacgttaggtcgggtntaccgaaccgtactaacgttccttaagtttccccgtgtttaccgtacccg

SEQ ID NO: 123102 - DNA, 649 bp, Homo sapiens
  misc_feature: GYAE6OF01EFUQ5.4.1.A01.1.454.CMB.1.raw
  modified_base (193)..(193): a, c, t, g, unknown or other
  misc_feature (193)..(193): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggganagacgcccaccctctcctgcgagggccaatcagagtattggcacagtcttagcctggtaccagcagaaaccgtggccaggcctcccggtctcctcacttctctcgccgtggccgtcagtccgacgggcctacgtggtactcccgtcgccgtacggttccggtggcgtagggtgggtcgtggactagtacgttcacgtctcaccatcgagcacgtccgtgacgtagttcgtagtactggtattggttacgtacgttaagtttttacttacgtttcgttactattacgtaaagtttaggtccgggttaccgggaccccggttacccgtaccgggtttaccggaacccggtaaacggggaaccgtaaagggttacggaaaacctacccggtaaaacggtacgttagggtacgggcctaggaccctacccgtagttccgttacgttacccttcgtacccg

SEQ ID NO: 123103 - DNA, 972 bp, Homo sapiens
  misc_feature: GYAE6OF01DO1HU.4.1.A01.1.454.CMB.1.raw
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggggagagacgcccacccgtctccgtgccgacgggccaaatccgaagtagttagttcggtaccacgacgtccttaacggcccgttagggtaacccaggaccaaacggaaaaccccgttcgggacccgtaaccggggtcccttacccccgggttcccttccccgttaccgtaacctttcccgttccgttcggtcccgtttcggtaccccgttcccgtaaccgttccgggaaccggggtaccccttaacgtttccggggttaacccttccccccggttaggtacccccggtttaacgggggtttccccccggttggggtaccccggttaacggggggttttccggggggtacccggttaacgggggtaaacccgttaacgggtttaccggttttacccaaaccccggttttccgtaacccccgtaacccgtaacgttacccgtaacgggccctaaccggtcccggtacggtacccgttaggttaccgtacggtacgttacggtacgtttggttacggttaacctttaaggttttttaccgtaacgtttacgttaacaaccgtttaaacttaagggttaaccggttcgggtaaccccggtaacccccgggttacccggttaaccgggttacccgggaacccggtaaacggggtaaaccggttaagggtaaaccggtaaaaacgttaacccggtaaaaccggttagggttaccggtcggggtaaccctagggtaaccccttaacccttacgttaacccggtttaccttccgtttacccttaccccgg

SEQ ID NO: 123104 - DNA, 763 bp, Homo sapiens
  misc_feature: GYAE6OF01DZNVS.4.1.A01.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
tcagagcactgtagcacgaccggtgctcgatttagacgtctcatcgaggggggaactgctcagttaggacccagacggaaccagtggaagccccagcgcagcttctcttcctcctgctactctggctccagatccgctggagaaatcgtagtgacgcagtctccagcccacctgtctgtcgtcctcgagggganagacnccctacctctccngcgacgggaccaagtcagtagttatggtaccagtagcgttaagccgttaggaaccagacaaacgaaccgtcggacctacgggtccttcccggtccttcctctactccgtcgtcgtccgttgtccgtaccagtccgacggtcctacggtcgtactcccgtagcccgtaggttccgaggcgtaggttcgggtcgtaggactaggttcttaccacgtacctaccgactagtccgaagaccgtaccggtaccgtacgtaccgttagtcccggttaaagtagttacggttaacgtttcgggttacgttaaccgttttaaaggtttttacttaaccggtttagtaacttaacgtttaaacgtaaaaggttttcgggacccgggtttaaccccggacccggttacccgggttaacgggtaacccggacgggtaaaacccggggtaacgttaaaagggaaaccgtaaaaacctaacgggtaaaaccgttgttacgggtccgtacgttaacgtacccgaaccgttgttacccgttacgtttccctacccgttaaccccgg

SEQ ID NO: 123105 - DNA, 379 bp, Homo sapiens
  misc_feature: GYAE6OF01BAG15.4.1.A01.1.454.CMB.1.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (314)..(379): a, c, t, g, unknown or other
  misc_feature (314)..(379): n is a, c, g, or t
tcagagcactgtagcacgaccggtgctcgatttagacgtctcatcaggggccactggtatccctgccaggttccgtggcagtgggtctgggacagagttcactctcaccatcagcagcctgcagtctgatgatgttgctagtttattactgtcatcaatatggtgacccggccacggtttcggccaaaggggaccaagggtggaaaatcgaaacgactggtggctgcaccatctgtcttcattccttccgcatctgactcagtgctctggacncggggctgggctaagggccgacatagngnangangcngngnnnnnnnnnnnnnnnnnnnnnnnnnnnnnnnnnnnnnnnnnnnnnnnnnnnnnnnnnnnnnnnnnn

SEQ ID NO: 123106 - DNA, 809 bp, Homo sapiens
  misc_feature: GYAE6OF01BMFGY.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtcgtctccgaggggagagacgcccaccctctccgtgccgacggggacccaatcgaaggtagttagttcggtccaacgtaggtccttaacgcccgttaggtaacccaaggaccgaaacggtaaaacccgtcgggacccgtaacgggtcccgttccccgggttctccccttacctacttccctcgtcggtccgttacggtccccggttaccacgtccggaaccggggtcccctacgttaccgggttaccttccccgtacggtacccggttacgggtttcccggtaggtaccgtaggggttcgggtacgtaggggacctagggttaccgtacctaccgttccgtaaccacccgtagtccgaacgtcccgtaacgtcccgtagtacctacggttacacggttaattcggttaagtttcggttagtaaccggttttattttaacctttcgttacgtactaacgttacttaaaggttacggttaccgggtaacccggtaccccgggtacccttacgggttaacccggaaccggtaaacggggtaaccgtaaagggtacgtaaaacgtaaccggtaaacgggactttgggaccgtactacgaccctacgtacttccgttacttccgtaccgttacccg

SEQ ID NO: 123107 - DNA, 728 bp, Homo sapiens
  misc_feature: GYAE6OF01C6LQB.4.1.A01.1.454.CMB.1.raw
  modified_base (147)..(147): a, c, t, g, unknown or other
  misc_feature (147)..(147): n is a, c, g, or t
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (427)..(427): a, c, t, g, unknown or other
  misc_feature (427)..(427): n is a, c, g, or t
  modified_base (532)..(532): a, c, t, g, unknown or other
  misc_feature (532)..(532): n is a, c, g, or t
tcagagcactgtagcacgaccggtgctcgatttagacgtctcatcgaggggggaactgctcagttaggacccagacggaaccatggaacgccccagcgcagtcttcctcttcctcctgctactctggctcccagaactccgctgganaatcgtagtgacgcagtccnccacgccacccgtgtctgtcgtcctcggagggganacgaccgccctaccctctccgtgacgacgggacctaagtcaagtagtaagttggtcacgagtccttanccgtggtaccagcaacgaacgtcgacncggcctccgtctcctatcgtctcgtncgtcgacctccnctacggacggccttacgtcgtcttcccgcgtcccgtacggtttccgcggtcgtggggtacgggttcgtacgggacgtaacgtcgtttacccncctttacccgacgactaccgacgtaccgaccgacgtaccgtggaccctagttcgttgtataagggtctttcgttagttacgtttagttttaacttccgttaagtntaacgttaacgtaggtttccgtccgggttaacccgcccgggtaacccgtttccgggtaacgggacccgggtaaacggtaacggttaacgggaaagtaaaccctaaccggttaaacggtccggttaggtcccggacgttaccgtaacccgtacttttaccggtatttacccggttcccgttaacctttacccccggg

SEQ ID NO: 123108 - DNA, 677 bp, Homo sapiens
  misc_feature: GYAE6OF01C40LM.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgccaccctctcctgcgacgggaccaatcagagtatggtcacagcttagcctggtaccagacagaaacctggaccaggcctcccggtctcccgtctacgttctccgtgcctcgccttccataccgacggtacctaccgttaggtaccttcccgtcgacccgtacgggttccggtacgggtacgtacggggttcggggtacgttacgggggaacctaggtaccgttacgaacctccgtaccaacccgtatcgacgacctaacgcccttacgctaacgggttctaggtacgtgtacgttgttcggacttttaattactttacgtcgtactaattacaaagtttcggtccggtaccgtacccgggttccaacgggtttccggaaccggaacggtaccggtaagaccggtaaactaacgtaaaaccggtgtacggtggaccgttagaaccctcgttaacttccttcgttaccgttgttacccccg

SEQ ID NO: 123109 - DNA, 284 bp, Homo sapiens
  misc_feature: GYAE6OF01EAXFR.4.1.A01.1.454.CMB.1.raw
  modified_base (279)..(284): a, c, t, g, unknown or other
  misc_feature (279)..(284): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgctagtttattactgtcatcaatatggtgaccggccacgttcggccaagggaccaaggtgaaatcaaacgactgtgctgcacatctgtctcatctcccgcatctgactacagtgctctgagcgggctggcaaggcgacagtagnnnnnn

SEQ ID NO: 123110 - DNA, 875 bp, Homo sapiens
  misc_feature: GYAE6OF01BCK9T.4.1.A01.1.454.CMB.1.raw
  modified_base (195)..(195): a, c, t, g, unknown or other
  misc_feature (195)..(195): n is a, c, g, or t
  modified_base (838)..(838): a, c, t, g, unknown or other
  misc_feature (838)..(838): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggganacgacgcccaccctctccgtgacgagggaccctaaattccgaaggtaagtttaacgttcggggtaccaacgacgggttaccttttaacggccccgttagggttaacccaaggaccgaaacggtaaaaaccccggttgggaccccgtaaacgggtccccgttaccccggggttaccttaccccgtaccgtaacctttcccgtttacggtacggtaccgttaccgggtcccggttacccgtaacggttaccggaaccggggtacccctaacggttcgggttaacccttcccccgttaccgggtaaccccgggttaacggggtttcccggggtacgggtaccgttaacgggggttacgggggttacccgtacgggggtaaaccgtaacggttaaccggtttaccgtaaccctaaccgttacccaaacccgtaacgttacccgaacgggtacccgtaacggtacccgtttaggaccgttaacggttccgttaacggtagttaacggttacgtttacgggttacgttaaccgttttaagtttttaacccgtattaccggttacaagttaacgtaattacggtcggtaccggtacccgtacgtacggtacgacgtaaacggacgtaaggtacgtaaactcggaaacgtntggacgtcgtacgactacgtataccgtgtctcgtacc

SEQ ID NO: 123111 - DNA, 715 bp, Homo sapiens
  misc_feature: GYAE6OF01C04SR.4.1.A01.1.454.CMB.1.raw
  modified_base (347)..(347): a, c, t, g, unknown or other
  misc_feature (347)..(347): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggtcacgagcttagccgtggtaccagacagaaacctggccaggcctcccggtctcctcactctctgctcgcgtccatcgagggccacgtggtactccccgtgccgtacgggttccgnggtcgtagggttcgggtctacggggactagggtacgtttaccaccgttctaccctaaccgtactacgacggtccgtaacggtcccttaggtcccgtaggttacccgtggtaacgttaggtaacgttttgggtttacgtacgttttaacggtttttaacgtttaaccgtttcggttactaacttaccggttaaattacgggttccgggtaccgggtacccccggtacccggttacgggttaccgggacccggtaaacgggtacccgtaaggggttacggaaaacgttaccgaaaaccggtacgttagggtaccggttacctacggtaccctaacccgtagttccgttacgttcccgtttacgtaccccg

SEQ ID NO: 123112 - DNA, 643 bp, Homo sapiens
  misc_feature: GYAE6OF01B092K.4.1.A01.1.454.CMB.1.raw
  modified_base (291)..(291): a, c, t, g, unknown or other
  misc_feature (291)..(291): n is a, c, g, or t
  modified_base (482)..(482): a, c, t, g, unknown or other
  misc_feature (482)..(482): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccgagggggagagacgcccaccctctcctgcacgggccaatcagagtattggtcacagctagcctggtaccagcaagaaacctggcccaggcctcccggtctccctnactctctgctgccgtcatcacgggtccacgtggtactcccgtgccgtacggttccgtggccgtaggttcggggtctaggggactaggtacgtttccacgttcctaccgacctaagtccgacgtccacggcccttggaccgtagttcgtagtattgaagtttcggttgtacttaagttttacttaaccgttntactaataacgtaattaggcgggtacccgaccccggtaccgttaccggtaccggaaccggaaacgggtaaccgtaaaggtaaccgtaaaacgtaccgtaaaacggtacgtaggtcgtacctacggacctaaccgttattaccgtcgttcccttctaacccg

SEQ ID NO: 123113 - DNA, 558 bp, Homo sapiens
  misc_feature: GYAE6OF01E0KRM.4.1.A01.1.454.CMB.1.raw
  modified_base (418)..(418): a, c, t, g, unknown or other
  misc_feature (418)..(418): n is a, c, g, or t
  modified_base (552)..(552): a, c, t, g, unknown or other
  misc_feature (552)..(552): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagcccaccctgtctgtgtctccgaggggagagagcccaccctctcctgcagggccaatcagagtattggtcacagcttagcctggtaccagcagaacctggccaggcctcccggtctcctcactctctgctgccgtccatcgagggccactggtactcccgtgcccgtaggttccgtggcctaggtcgggtcgtcgggactaggagttccactcctcaccatcagcacgtcctgctacgtctgattgattgtntctttagtttattacctgtacagttacaattggtcggtccgacccggtccctacggtcggaccgaagggaccgtaagggttacgaaacttacgaaacgtaggtgtggaccgtgaccctacattctcgtttcctntacccg

SEQ ID NO: 123114 - DNA, 791 bp, Homo sapiens
  misc_feature: GYAE6OF01DD2Q2.4.1.A01.1.454.CMB.1.raw
  modified_base (743)..(743): a, c, t, g, unknown or other
  misc_feature (743)..(743): n is a, c, g, or t
tcagagcactgtagcacgaccggtgctcgatttagacgtctcatcagggggggaactgctcagttaggacccagacggaaccatggaagccccagcgcagcttctcttcctcctgctactctggctccagaactccgctggagtaaactcggtagtcgacgcagtctccagccacctgtctgtcgtctcgaggggcacgacgccacctctctgacgaggcctaagtcgagtacgttactcgggtaccacgtagtccgttacgccgttacggtaaccacgtacgtaacggaaaccgtcgggacccgtaacggtcccgttaccccgggtccttaccttcgtaaccttccgttccgtcgtaccgtccggtaccgttacccgtacggtacccggaaccgggtcctaacggtttaccggttaccttccccgacggttacccggttacgggttccgtacggtccgtaacggggttcgggtcgtacgggaactacggtaccgtttaccgtacccttcgtaaccctaccgtacgtaccgtaacgtaccgtaccgtaccgtacgtaccgtacggtttccgtaggtaaccttaggttaggtttccgtacggtttaactttacgttttaaccgttacgttacgtactaaccgttacggtaactcgggtttaacggccggtacccgtaccgttccggaacggtaccggaacggtaaccgtaaaggtccggttaaacacccggtaaagttacggtnttacggaccctacggtacctacgtagttccttacgtcgttcctacccg

SEQ ID NO: 123115 - DNA, 748 bp, Homo sapiens
  misc_feature: GYAE6OF01AN1ML.4.1.A01.1.454.CMB.1.raw
  modified_base (193)..(193): a, c, t, g, unknown or other
  misc_feature (193)..(193): n is a, c, g, or t
  modified_base (234)..(234): a, c, t, g, unknown or other
  misc_feature (234)..(234): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggganagagcccaccctctcctgcagggccaatcagatattgcacngcttagcctggtaccagcagaacctggccaggcctcccggtctcctcatcctcgtgctcgtccgtccatccgaggtccctacgtggtactcccctggccgtaggttccgtggccgtagggttcgggtccgtaggggacaggtacgttccacgttcctaccaacctattccgaacgtccgacggtcccttggacctaagttccgtaggtaacgttggtacgtttcgggtttacgtaacgtttaacggttttttaactttaccgttggttaccctaaacgttacgttaaagggtttaacggttccggggttaaccccgggtaaccccccggggttaccccgttaacccggggtttacccgggaaaccccgggtaaaacgggggtaacccggtaaaggggtttaaccggaaaaaccgttaacccggaaaaaccggttaacggttgggtacgggtaaccctcggaaaccccttaccggttaactttcccggttaaccgttccgttacccgtaaccccg

SEQ ID NO: 123116 - DNA, 892 bp, Homo sapiens
  misc_feature: GYAE6OF01BB5GK.4.1.A01.1.454.CMB.1.raw
  modified_base (189)..(189): a, c, t, g, unknown or other
  misc_feature (189)..(189): n is a, c, g, or t
tcagagcactgtagcacgaccggtgctcgatttagacgtctcatcgagggggaactgctcagttaggaccagacggaaccatggaagccccagcgcagcttctcttcctcctgctactctggctccagatccgctggagaaatcgtagtgacgcagtctccagccacctgtctgtgtctccgagggganagacgccctaccctcgtccgtgccgacgggccaaatccaagtagtagttcggtccaactaggtcctttaacggcccttagggtaaccccaggtaccaaacggtaaaaccccgtggggacccctaacggggtcccttaccccggggtccttcccctacgtaactttcccgttccgtcggccgtttggaccccgtttaccaacgttacccggaaccggggtccctaaccggtttcgggttaaccccttcccccggttagggtacccccgttaacgggggttttcccccgggtaaggggcccgttaagggggttcgggggttccgttaacgggggggaaacctaacggggttaaccgttttcccaaacccgtttccgttaacccaaaccggtaccttacggaaacggtccgtaaccggtccccgtacggttacccggtacgggtttaccctacggtaaagttcggtaacggtttgggtttacgttacgtttaagtttttacttacgttcgttaactacttaacgtaaagttacgggttacggtacccgggtaaccccgggtccgttaaccgggttaccgggacccgttaaaacggggacccgttaaaacgggtacggtaaaaacctacccggtaaaacggttcgttagggttaccggaccgtcgaacccgtacgttaacttcgtttacggttcttccgtaaccccg

SEQ ID NO: 123117 - DNA, 718 bp, Homo sapiens
  misc_feature: GYAE6OF01CYTJN.4.1.A01.1.454.CMB.1.raw
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagtagtattggtcacagcttagccgtaggtaccagacaagaacctggccacggcctcccggtctcctcactctctcgctcgccgtccagtcgacgggccacgttcggtactcccgtcggcccgtagggttccgtggcgtagggttcgggtcgtaggggactacggtacgtttaccaccttcctaccaaccgtactccacgtaccgaccggtcccgttacggaccgtacggttcgtacgtaacgttggttacgtttggtttacggtacgttttaacgttttactttaaccgttgttacctaactttaacgttaaagttacgggttaccgggttacccggtaccccgggttaccccggtaccgggtttacccggaaccgggtaaaccgggtaaaccggtaaggggtaacggtaaacgtaaccggaaaaccggttacgttcgggtacggtaccgtacgaccctaactacgttccgtttaccgttcctttccgtacccg

SEQ ID NO: 123118 - DNA, 725 bp, Homo sapiens
  misc_feature: GYAE6OF01BYFX9.4.1.A01.1.454.CMB.1.raw
  modified_base (395)..(395): a, c, t, g, unknown or other
  misc_feature (395)..(395): n is a, c, g, or t
  modified_base (528)..(528): a, c, t, g, unknown or other
  misc_feature (528)..(528): n is a, c, g, or t
tcagagcactgtagcacgaccggtgctcgatttagacgtctcatcgaggggggaactgctcagttaggacccagacggaaccatggaagccccagcgcagcttctcttcctcctgctactctggcctcccagaactccgctggaagaaatcggtagtgacgcagtctccacgccacccgtgtctgtcgtcctcggagggagagcgcccaccctctccgtgcgacggaccaatcgaagtagttagttacggaccacgtagttcgttacgtccgttacggaaccacgtacgaacgtaaaccgtggccgacggtcctcccggtctcctcattctcgtgtcgtcgtccgtcacgtccgacggtcctacgttcgtacctccgtcgaccggtggttccggngcgtaggtcgggtctagggactagtccgttacacctcgtaccacgtagtcgtaccgactccggaccgtacgcgtaccgttgtacggtagtacgttacgtttgttacgtaactttacgttttacgtacgtttanacgttacttaacgtaacggtttcggtcccgggttacggtacccccgggtacgttaccggtccgggaaacccgtaacggggaacgttaaacgggaaaccggttaaaccgtaaacgggaaacccgttagggttacgggcgtaacccgttaccgaacccgttacgtacctttccgttaccgtttctaaacccgttccccg

SEQ ID NO: 123119 - DNA, 766 bp, Homo sapiens
  misc_feature: GYAE6OF01A2DI7.4.1.A01.1.454.CMB.1.raw
  modified_base (287)..(287): a, c, t, g, unknown or other
  misc_feature (287)..(287): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtcgtctccgaggggagagacgccaccctctcctgcagggccaatcagagtattggtcacagcttagcctaggtaccagcaagaacctggccaggcctcccggtctcctnactcctctcgctcgccgtccagtcgacgggccctacgtggttacctcccgtgcccgtagggtttccggtcggccgtagggttcggggtcgtacgggggactaggtacgtttacaccttacctacccacgtacgtccacggtccgacgtcccgttagggccttaacgggttcgtacgtagttacgttacgttgggttttacggtccgtttaaagttttttaacttaccggtttacgttactaaatttcgttaaaacgtttagggttaccggggttacccgggaacccccgggttacccccggtaaccggggttttacccggggaaaccccggttaaaacgggggtaacccgggtaaaagggggttaacgaaaaaacgttacccgaaaaacccgggttaacgttcggggttacgggacccttacggaccctaaacccgtttacgtttacccttccgggtttaaccctttccgttaaccccg

SEQ ID NO: 123120 - DNA, 772 bp, Homo sapiens
  misc_feature: GYAE6OF01C7OWA.4.1.A01.1.454.CMB.1.raw
  modified_base (446)..(446): a, c, t, g, unknown or other
  misc_feature (446)..(446): n is a, c, g, or t
tcagagcactgtagcacgaccggtgctcgatttagacgtctcatcaggggggaactgctcagttaggacccagacggaaccatggaagccccagcgcagcttctcttcctcctgctactctggcctcccagaatccgctggaagaaatcgtagtgacgcagtctccagccaccctgtctgtcgtctccgaggggagagacgcccaccctctcctgcgacgggccaatcagagtattggtacacgagtcttagcctggtaaccagacaacgaaccgtggaccctaggccctcccggtctccgtactcttcctccgtgcctcggccgttcacgttccgaacgggtccctacgttcgggtacctccccgtggacccgtagggttccgtggacgtagggttcggggtcgtacgggaactacgggtcgttacccacttcgaccctaaccgntaccgacgccaccgtcccgtagtcctaacggttccttaggacgttaggtagtttcggttacgtacgttttaagttttattaaccgttcggttacctaagttacgttaaacggtttacggttcggggttaacccggtaccccgggtacccggttaaccgggtttacccgggaaccgggtaaaaccgggtaaccgggtaaaacgggtaaaccggttaaaacgtaacccggtaaaaaccgggtacccgtttaggggtcggttacccgttaaccggacccgttaacccgttaactttcccgggtttaacgttccctttaccgttaccccg

SEQ ID NO: 123121 - DNA, 663 bp, Homo sapiens
  misc_feature: GYAE6OF01CEY55.4.1.A01.1.454.CMB.1.raw
  modified_base (142)..(142): a, c, t, g, unknown or other
  misc_feature (142)..(142): n is a, c, g, or t
  modified_base (239)..(239): a, c, t, g, unknown or other
  misc_feature (239)..(239): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctgganaaatcgtagtgacgcagtctccagcccaccctgtctgtgtctccgaggggagagacgcccaccctctcctgcgagggccaaatcagagtatggtcanagtctagcctaggtaccagacaagaaacctggaccacggtcctcccggtctcctcactctctcgctcgcgtccatcgacggccacgtggtactcccgtgccgtaggttccgtggacgtagggtcggtcgtacgggacagtacgttcacgttctacgaactagtacacgcgacgtccgtgtaccgtaacgttgtacgtaagtacgttaagtttcggttgtaactttacgtttttaacgtttaccgtagttaaccttaataccgttaaagttacggttcgggttaacccgggtaccccggtaccccgtaacgggtttcccgggaacggtaaacgggaaccgtaaaggtaaacggaaacttaaccgaaaacgtacgtacggtcggtacctacgacctaacgtacttcgttacgttcttacctacccg

SEQ ID NO: 123122 - DNA, 975 bp, Homo sapiens
  misc_feature: GYAE6OF01ENXJH.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcgacgggcctaatcgagtagttagttcggtaccacgtagtcgtttaacgccgttacggtaacccaggaccgaaacggtaaacccgtcgggaccccgtaacgggtcccgttacccccgggttccttaccccgttactacgtttcccttcgtcggtccgttcggtcccgtaccctacgttccggaccggggtaccccttacggttccggtaacccttccccgtcggacccgttacggggtttcccggtaggtccgtaggggttcggggtacgtacggggaactacggtaccgttccaccgttcctacctaacccgtacgttaccgacggtacccgacggttcccgtacggtaccgtaacggtttacccgtaggtaacgtttagggttaacgttttcgggtttaaccgtttaacgtttttaagtttttaaaccgttttaccgtttaacggttaaccttaacgtttaaacgttaaagttttacggggttcccggggtaaccccgggttaaccccccgggtaaccccggtttaaccgggggtttaaccccgggaaaaccccgggggttaaaacggggtaaaacccggtttaaaaacgggggttaaacccgggttaaaaaaacccgttaaacccgggtaaaaacccggtttaacgggtttccggggtaaccggtacccgtttaaacccgggaaccccgtttaaaccccgttaccggtttttaccccggttttacggttttaacccccgttcccgttttaaaccccccgg

SEQ ID NO: 123123 - DNA, 846 bp, Homo sapiens
  misc_feature: GYAE6OF01DCFDL.4.1.A01.1.454.CMB.1.raw
  modified_base (195)..(195): a, c, t, g, unknown or other
  misc_feature (195)..(195): n is a, c, g, or t
tcagagcactgtagcacgaccggtgctcgatttagacgtctcatcgagggggggaactgctcagttaggacccagacggaaccatggaagccccagcgcagcttctcttcctcctgctactctggctccagaactccgctggagaaatcgtagtgacgcagtctccacgccacctgtctgtcgtctcgagggganagacgcctaccctctccgtgcgacgggaccaatcgaggtagttagtcggtcacgtagtcttacgccgtaggtaccagaccgaacggaacctcggaccacggtcctcccggtacctcctcgtacgttctcctcggtacctcggtccgtacctacgtaccggtaccgggtaccttaacgttccggttaacctccccgtaacgggtcccggtttcgggttccgggtagggtaccgttaggggttcggggttcggttacggggaaacgttacgggttaccgtttccctacctttaccggacctaaccgtacgtaccggacgtaccggaccggttaccgtacggtctaaaccgggtttctacgggttaagtttacgtaacggttttgggtttaacccgttacggttttaaacgtttttaacccgtttcggttacccgttaagtttaaccgtttaattaaaaccgggtttcgggttaacccggggtaccccgtaaccccgggttccggttaaacccggggttccggaaacccggtaaacggggttacccggtaaagggtaaaccgtaacgttaaaccccgaaaagggtttcgtcgggtaccggtacggttaccaccgttaccgtacgttccggttacgtttccctcccgggttaaac

SEQ ID NO: 123124 - DNA, 669 bp, Homo sapiens
  misc_feature: GYAE6OF01DOVXU.4.1.A01.1.454.CMB.1.raw
tcagagcactgtagcacgaccggtgctcgatttagacgtctcatcagggggggaactgctcagttaggacccagacggaaccatggaagccccagcgcagcttctcttcctcctgctactctggctccagaatccgctggagaaatcgtagtgacgcagtctccagcccaccctgtctgtgtctccgaggggagagacgcccaccctctcctgcagggccaatcagagtattggtacacagcttagccgtaggtaccagacaacgaacctggccaggcctcccggtctcctcatctctgctcgccgtccatcggacgggccacgttcggtactcccgtgcccgtaggttccgtggcgtagggttcgggtcgtgggactaggtacgttccacttcctaccaccctagtccgaacgcctaccggtcctcgaccgtagttccgtagagttagagtttggtcgttacgtttagtttttacttacgttacgttactaattactaagttcggttacgggtacccggtaccccggtacccgttaacgggttcccgggaaccgtaaacgggggaacccgtaaaggggtaacgtaaaactaaccggaaaacggtacgttacgggcggtacctacgaccctaaccgttacttccgttacggttcccttccgttaacccg

SEQ ID NO: 123125 - DNA, 712 bp, Homo sapiens
  misc_feature: GYAE6OF01EAXIM.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaactccgctggagaaatcgtagtgacgcagtctccagccaccctgtctgtgtctccgaggggagagacgccaccctctcctgcgacgggccaatcagagtattggtcacgagtcttagccgtggtaaccagacaagaaaccgtggaccacggtccgtcccggtctcctcgacttctctcggctcggtcgtccgtatcgaccgggcctacgtcggtactccctgtcgttacggtccgtggacgaggtcggtcggtgggactaggtcgttacacgtcactacatcgagcacggcctgcgtacgttcgtagtacgtgtacgttggttacgtactttaacggtttttactttaccgtggttaccttaagttaactaaagtttacgggttaccgggtaccgggtaccccgggttaacccgttacccggggtttacccgggaacccggtaaaaggggtaaacccgggtaaaaggggtaaacgtaaaaaacgtttaacccgggaaaaacggttacggttagggtacggtaccgttaccggaacccttaacccgaacgtttcgtttaccggtttccctccgttaaccccg

SEQ ID NO: 123126 - DNA, 685 bp, Homo sapiens
  misc_feature: GYAE6OF01BAYA8.4.1.A01.1.454.CMB.1.raw
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcgacgggccaatcagagtattggtcacagtcttagcctggtaccagacaagaaacccgtggaccacggcctcccggtctcctcactctctgccttgccgtccagtccgacgggtccacgtcggtactcccgtgcccgtacggttccggtgcgtagggtgggtcgtcgggactaggtcgttcactctaccacatccgagcgtacgccgtagactaggttcagtacgtgtagttggttagtaccgttagtttttaactacgttgtactaagttactaagtttcggttacggtaccgggtaaccccggttcccgttaaccgggtttcccggggaaacccgtaaaggggtaacccgtaaaggggttaaaccgtaaaagtaacccgtaaaaaccggttacggttaagggtcgggtacccgttacgaacccgtaacccggtttcgttaccgtttcggttaaccttccccgttaacccg

SEQ ID NO: 123127 - DNA, 865 bp, Homo sapiens
  misc_feature: GYAE6OF01B171Q.4.1.A01.1.454.CMB.1.raw
  modified_base (195)..(195): a, c, t, g, unknown or other
  misc_feature (195)..(195): n is a, c, g, or t
  modified_base (617)..(617): a, c, t, g, unknown or other
  misc_feature (617)..(617): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaatcgtagtgacgcagtctccagcccaccctgtcctgtcgtctccgaggggangacgcccaccctctccgtgcgacggccaatcgaagtagttagttggtccaacgtggtacttacgcccgttacggtaacccacggtaccaaacggtaaacccgtggacccgaacgggtcccgttaccccggtccttaccctcctaacgtcccgttcgttcgcccgttcggacccgttacccacgtacccggaccgggtaccctacggttacggtaccccttccccgtacggacccggttacgggtttcccggacggccggtacggggttcgggtacgtacggggtaaccgtagggttacgttaccctacccgttcttaaccgaaccttacgtacgacgtacacccgttaccgttcgacgtacgttcgtaagtacggttagtacgtttcggttagttaccgttttaagttttacttaacccgtnttaacgtaaacttacgtaaagtttaccgggtacgggttaccccgggtaaccccggttcccggtttaacccgggtaccgggtaaacccggaaaccgggggtaacccgttaaaaaagggggttacccgtaaaaaaaccgttacccggggaaaaaccggttacggttcggggtaaacccttacgggacccttaaccgtaaccgttttacgtaccccggtttttacgtttaccccgttactttaccccccgg

SEQ ID NO: 123128 - DNA, 676 bp, Homo sapiens
  misc_feature: GYAE6OF01CXZ0N.4.1.A01.1.454.CMB.1.raw
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagagcactgtagcacgaccggtgctcgatttagacgtctcatcgaggggggaactgctcagttaggacccagacggaaccatggaacgccccagcgcagcttctcttcctctgctactctgctcccagaactccgcgtaggaagaaacgtcggtagtgacgcacgtcctaccacgccaccctgtctgtcgtctcggagggagacgacgacccaccctctccgtgaccgaggaccaatcgaagtagttacgttcggacacgtagtcgtacgtccgtaggtaccagaaccaacggaaaccgtcggaccgacggtcccgtccccgtctacctcgacttctcgtagccgttcgaccgttcctagtccgacgggtacctacgtacgtaccgtcccgtcggcccggttagggttacccggtggtacgcgggttcgggtcgtacgggaacttaggtaccttcgacctcaaccgtactcgacgaaccgnaccgtcctagccgtaacgngttagtacgtggttaagtttagtcggttaacttttaacgtttatttacggtctaacgttactaacgtacttaggtcccgggttaccgacccgtacgtaccgtacgggacgtaaaggacgtaggactaaacgacgaagtcgtgcctagactacaacttctagttctctcgtaccg

SEQ ID NO: 123129 - DNA, 709 bp, Homo sapiens
  misc_feature: GYAE6OF01A7YCR.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctcgaggggagagacgcccacccttctcctgcgacgggaccaatcagtagtagttcggtacacgagtcttacgccttacggtacagacaacggtaaaccgtcggaccagggccttcccggtctccgtacacttctcgtgcctacgcccgtaccagtccgacgggtccctaagtcggttacctcccgtcgacccgtacgggttccggtcggcgtagggtcgggtaccgtgggaacaggtacgtcctacctctaccgaaccctagtccgacgaccgacgtccctacgggacgtcgttacgtagtacgttagtacggttcgtttacggttactttaacggtttttaacttcgtttacggttacctaagttacttaaacggttggtttaccgggtacccgtaccccgggtacccgttaccgggtaccggaaccggtaacggggaaccgtaaaggggtaactaaacgtaaaccgaaacggttcttagggcgtccgtaggaccctaccgtattccgtcgttaccgtcttacccg

SEQ ID NO: 123130 - DNA, 674 bp, Homo sapiens
  misc_feature: GYAE6OF01EL51A.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgagggggagagacgcccaccctctcctgcacgggccaatcagtagtattggtcacagtcttagcctggtaccagcaagaacctggccaggcctcccggtctcctcatcctcgtgctggtcctccacgtcgacgggtccctacgttcgggttacttccccgtaggtcccgtacggggtttcccgtgggaccgtagggttcggggtacgttgggggaactaggtacgttccaactcctaccaccgtatcgagcacgtcctaggtctagttctaggtattcggtagtttcgtttagttacgtttaacggttttacttacgttcgttacctagtttaacaaacgttttacggtcgggtacccgtacccgggtaccccgttaacgggttaccccgggaccgtaaacggggtacctaaggggttaaccgaaaagttaccgaaacgtacgtaggtcgaccgtacggacctaccgtattacgttcgttctactcccg

SEQ ID NO: 123131 - DNA, 688 bp, Homo sapiens
  misc_feature: GYAE6OF01D6PNH.4.1.A01.1.454.CMB.1.raw
  modified_base (376)..(376): a, c, t, g, unknown or other
  misc_feature (376)..(376): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtcgtcgtccgaggggagacgacgccctaccctctcctgcacggccaatcagagtattggcacgagtcttagcctggaccagcaacgaaccgtcggccacggtcctcccggtctccctctacttccttctcgcttcgccgttccacgtccgacgggccctacgtcggttacctcccgtaggcccgtacgggttccggnggcgtacgggttgggtccgtaggggacaacggtcgttccacttccgcctacgactcgacgaccgtcgaccgtcgactagttcgtgtagttgacgttcgttagtaccttagttttactacgttgtactaactacgtaagttaaggtcggtacccgggtccccggtacccgtaacccgggtttaccggaaccgggtaaccggtaaccggtaaagggtaacgtaaaaccgtacgtaaaaccggttacgttcgggtaccgaccgttaacggaccctaacggttacctttcggtttaccttaccgttcgttaacccc

SEQ ID NO: 123132 - DNA, 883 bp, Homo sapiens
  misc_feature: GYAE6OF01ETLTJ.4.1.A01.1.454.CMB.1.raw
  modified_base (244)..(244): a, c, t, g, unknown or other
  misc_feature (244)..(244): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (460)..(460): a, c, t, g, unknown or other
  misc_feature (460)..(460): n is a, c, g, or t
tcagagcactgtagcacgaccggtgctcgatttagacgtctcatcgaggggggaactgctcagttaggacccagacggaaccatggaacgccccagcgcagtcttctcttcctcctgcctactcgtcggctacccagactccgctaggagtaatcggtagtgacgcactccgccacgccctaccgttgttccgtggtacgtaccgtacggaaggggactacggaccgccctacccttcgtccgnggccggaccggacctaagtacgaggtagttcgttcgacacgcgttctaccggtccgtacggaccaagaccgaaacgtaccggtcggaccgtcggtacccgttcccggtacctaccgtctacgttcctgcgtccncggtccnccgtaggaccgtcggacctcgttaccgtcttccctagggtcccgttcggtcgcggacggttcgggtcgggttcgngggtaaccgtcgggttacttacccgaaccgtaccgtaccgtaaacctccggtacgtaccggaccgtacggtccgttaaccgtcgtaccgtacttacggtacgtttcgggtaactttcgggtttaacctttaacgggttttaacctttttcgttaaccgggttttagaaccgtttaacctttaaacgggttacgtttaaccggggttacccggggttacccccgggttaaccccggtacccggggtttaacccggggtaacccggtaaaccgggggtaaacccgggtaaacccggggttaaggtaaaaccgttaaaaccccggtaacggtaaacccgggtttacgggttaacggcgtaacccggttacccggtaccttaaccgttccggttacgttaccccggttttactccccgtttaacccg

SEQ ID NO: 123133 - DNA, 774 bp, Homo sapiens
  misc_feature: GYAE6OF01CJUEV.4.1.A01.1.454.CMB.1.raw
tcagagcactgtagcacgaccggtgctcgatttagacgtctcatcaggggggaactgctcagttaggacccagacgaaccatggaagcccagcgcagcttctcttcctcctgctactctggctcccagaactccgctggaagaaatcgtagtgacgcagtcctccacgcccaccctgtctgtgtcctccgaggggagagacgcccaccctccgtcctgcgagggaccaatcgaagagttagttggtacacgagtacgttacgccgtaggtaaccacgacaaacggaaaccgtcggaccgacgggtcccgttccccggtcctccctactacttcccgtcgtcgtcctcggtcctacccacgtacggaccggtacctaccgttcggttacctccccgtcggtccgtaccgggttccggtcggtacgtacgggggttcgggtaccggtaggggaactaacggtacgtttactaccctcccgtaaccacctaacgtccgaacggcctaacgtcccgtcggacttaacggttagtagtacgttagtaggttcgttacgggtactttaaaggtttttacttccgttacggtattaaccgttaagttaacggttaacggtcgggtacccgggtaccccgtaacccggtaccggggttacccggaaacccggaaaacggggtcgaaacggggtaaagtaaaccgtaaaccggtaaacgtacggtcggtacggacccgttacgacctaccgttaattcggttaccttcccgtcgttacccccg

SEQ ID NO: 123134 - DNA, 651 bp, Homo sapiens
  misc_feature: GYAE6OF01D8QXL.4.1.A01.1.454.CMB.1.raw
  modified_base (146)..(146): a, c, t, g, unknown or other
  misc_feature (146)..(146): n is a, c, g, or t
  modified_base (447)..(447): a, c, t, g, unknown or other
  misc_feature (447)..(447): n is a, c, g, or t
tcagagcactgtagcacgaccggtgctcgatttagacgtctcatcgaggggggaactgctcagttaggacccagacggaaccatggaagccccagcgcagtcttctcttcctcctgctactctggcctaccagactccgctggaanaatcgtagtgacgcagtctccacgccacctgtctgtcgtactcgaggggacacgacgccctaccctctcctgcgacggcatcagtagtattcgacatagtacttacgccgtaggtaaccaggacctaacggtaaccgtcggacccgtacggtcccgttacccggtcctaccgtactacttccgtctcgtcgttcgtccgtacctagtcggacgcctacgttcgtacctcccgtgaccgttacggtcggtcgacggtaggtcggtacgtagggaactacggtcttccgacttccgacacgtntaccgactcgactccgtagactagtctagctagtagttcgtatacgtttattctctgtacagttagtaacgtggtaccggaccgtacccggttcgtaccggtacggacggtaacggtaacgtaaggaaactaaccgtaaaccgtacgtacgtggtacggaacccttcgaaaacctcgttactacggttccttacgtctccccgg

SEQ ID NO: 123135 - DNA, 726 bp, Homo sapiens
  misc_feature: GYAE6OF01EBJ36.4.1.A01.1.454.CMB.1.raw
  modified_base (147)..(147): a, c, t, g, unknown or other
  misc_feature (147)..(147): n is a, c, g, or t
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (366)..(366): a, c, t, g, unknown or other
  misc_feature (366)..(366): n is a, c, g, or t
tcagagcactgtagcacgaccggtgctcgatttagacgtctcatcgagggggggaactgctcagttaggacccagacggaaccatggaagccccagcgcagcttctcttcctcctgactactctggctcccagaactccgctggaanaaatcgtagtgacgcagtcctccagccaccctgtctgtcgtctccgagggganagacgcccacctctccgtgacgacggccaatcgaggtagttnttcggtacacgtcgtactttacggcgtacggtaaccaggtacaaacggtaaaccgtcggcccgtaacggtcccgttcccggtaccctccgtactaccttccttcgcggtctacggtccgtaccngtaccggacggcctagtcgtacctccgtcgccgttacggttcggcggtacgtgggtcggtcggtaggacgtaggtacctacgtccttaccgtacctaacgtcgtaacgcgccgtacccgtcgtacgtacgtacgttcgtaactgtagtaagtttcgggttacgttactttaaggttttacctagtcgttaaacctattaaccgtaattacgggtcggtaccccgtaccggttcccgtaaccgggttccggaaccggtacggaaacgggttaaacggtaggtaaaacccgtacggaaacggttacggtaggtcgtaccgtaccgtaacctccttagtacctttcgtcgttccttaccccgg

SEQ ID NO: 123136 - DNA, 333 bp, Homo sapiens
  misc_feature: GYAE6OF01DEGMJ.4.1.A01.1.454.CMB.1.raw
  modified_base (313)..(333): a, c, t, g, unknown or other
  misc_feature (313)..(333): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgctagtttattactgtcatcaatatggtgacccggcccacgttcggccaaagggtaccaaagggtcggaaataccgaaaacgaactggtgctgaccacctatctgtcttcatccttcccgcatctagactacagtcgtctcgtggacggcgggtctggacgaacggtcgactagtagnnnnnnnnnnnnnnnnnnnnn

SEQ ID NO: 123137 - DNA, 697 bp, Homo sapiens
  misc_feature: GYAE6OF01A7M7V.4.1.A01.1.454.CMB.1.raw
  modified_base (143)..(143): a, c, t, g, unknown or other
  misc_feature (143)..(143): n is a, c, g, or t
  modified_base (398)..(398): a, c, t, g, unknown or other
  misc_feature (398)..(398): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctgganaaatcgtagtgacgcagtcctccagcccaccctgtcctgtcgtctccgaggggagagacgcccaccctctcctgcagggccaatcgagagtattggtcacgtagcttacgccttggtaacccagacaacgaaacccgtggccctagggtcccttccccggtctcccgtacacgttcctcgtcgcctcgtccgtccgactccgacgggtccctacgttcggtaacctccccgtcggacccgtacggggtttcccgnggacctagggttcgggtacgtcggggacaggtacgttccaccgttcctaccgacctactcgacgcctaacgtccctgacctacgtcgtcgtagtcgtaagttcggttcgtacttacgtttttataccttgtactaacgttactaagttacggtcggtaccgtaccccggtacccgttaccgggttaccggaaccgtaaacgggtaccggtaagggtaccgtaaacctaacggaaaccggtacgtcgggtacggacgtacgaccctaaccgttacttcgttcgttccgttccgttacccg

SEQ ID NO: 123138 - DNA, 815 bp, Homo sapiens
  misc_feature: GYAE6OF01CU7HF.4.1.A01.1.454.CMB.1.raw
  modified_base (137)..(137): a, c, t, g, unknown or other
  misc_feature (137)..(137): n is a, c, g, or t
  modified_base (187)..(187): a, c, t, g, unknown or other
  misc_feature (187)..(187): n is a, c, g, or t
tcagagcactgtagcacgaccggtgctcgatttagacgtctcatcgagggggaactgctcagttaggaccagacggaaccatggaagcccagcgcagcttctcttcctctgctactctggctccagatccgctgganaatcgtagtcgacgcagtctaccagccacctgtctgtcgtctcgaggganagacgccacctctccgtgcgacggacctatacagtagttattcggtacacgtacgtcgttacgtccggtcggtaaccgacggtaccaacggtaaccgttcggaccgtaaccggtcccgttacccgtcttaccctcgtacttccgtcgtcgtctccggtccgtaccacgtcgacggaccttacggttacgtcccgtcctcggtaccgttacgggttccgtcggacgtacgggttacgggtcggtacgggtacgtacgggtaccttacccgtaccttaccgaccgtaaacgacgttacgccggtaacgtaccgtaccgtacgaccgttacggtacgttacgttaacggtcggttcttttcggggaacgtttccgttttaaacggttacttttaccggtacgtttacctaagtttacgtaaagtttccggggttaccgggtacccggtaccccgggttccggttaaaccgggttaccccggggtaccgtaaaacccgggtaggtttaaaaaccgggaccggtttaaaaaccgaaccgggttaaaacgtcccggttaacgggaccggtttacgtaaccgacccgtttaacgtttaccctcggttttaaccgccgttttaacgttacccccgg

SEQ ID NO: 123139 - DNA, 687 bp, Homo sapiens
  misc_feature: GYAE6OF01AZ45U.4.1.A01.1.454.CMB.1.raw
  modified_base (241)..(241): a, c, t, g, unknown or other
  misc_feature (241)..(241): n is a, c, g, or t
  modified_base (382)..(382): a, c, t, g, unknown or other
  misc_feature (382)..(382): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctcagccaccctgtctgtgtctccgaggggagagacgcccaccctctcctgcgagggaccatcagtagttattggtcacnggcttacgcctaggtaccaggcaacggtaaaccgtggaccgacggtcctcccggtctcctcatcctcgtgcctacgccgtcctacgtccggacgggtacctacgttcggttacctccccgtgtacccgtcgggttcccggnggcgtagggtcgggtacgtgggactagggtacgttcctacctcctacccaacccgtatccgaacgtcaccgtccgtcgcgtagttaccgtgtaagttgtaagtttcggttacgtagtttaacgtttttataccttacgttactacttaactaacgttacggttccgggtacccggccccgtttaccggtaccgggttaccggaacccggaacggggtaaccctaaggggtaaccgtaaacgtaaccgtaacggtacgtacgggtcgactaccggactaccgtacgttcgtcgttcttacctcccg

SEQ ID NO: 123140 - DNA, 772 bp, Homo sapiens
  misc_feature: GYAE6OF01DLKZA.4.1.A01.1.454.CMB.1.raw
  modified_base (117)..(117): a, c, t, g, unknown or other
  misc_feature (117)..(117): n is a, c, g, or t
  modified_base (227)..(227): a, c, t, g, unknown or other
  misc_feature (227)..(227): n is a, c, g, or t
  modified_base (464)..(464): a, c, t, g, unknown or other
  misc_feature (464)..(464): n is a, c, g, or t
  modified_base (517)..(517): a, c, t, g, unknown or other
  misc_feature (517)..(517): n is a, c, g, or t
  modified_base (756)..(756): a, c, t, g, unknown or other
  misc_feature (756)..(756): n is a, c, g, or t
tcagagcactgtagcacgaccggtgctcgatttagacgtctcatcgagggggggaactgctcagttacggacccagacggaaccatggaagccccagcgcagcttctcttcctcctnctactctggctaccagaactccgctggaataatcgtagtgacgctagtctccagccctaccgtgtctgtcgtacctccggaggggagacgacgaccctacccttctccgnggaccgacgggtacctaatacgaaggtagttacgtggtaccaagtacgtaccttacggtcgtaccggtacacggtacaaaccggtaaaccgtcggacccgtacgggtcccttaccggtcctacctacactttcctcgtacgtacgtccgtaccgtaccgaacggttcccggaacgggtaaccccttggttaccgggtacctccccggtacggaccgtttacggggttcgcggtaccngggggttaccgtcggtagggtaactacggtcttaccactttaccactcctaanccgtaaggtcccgtacgcccgtttacggacgtaacgttcgtgttaaacgttcgtaacgtttcgggtactttaacggtttaattacgtttgtacgtactaacgttataacgggttctacccggacggttaccccgtaccgtcgggtaacgaccgggttaaacgaaccggtaggtaaacgaccgttaaacgtaaccggtaggttcggacgttaccgcgttaccctagttccgttaccgttntaacccgtttcgaccc

SEQ ID NO: 123141 - DNA, 729 bp, Homo sapiens
  misc_feature: GYAE6OF01AXCTG.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagatccgctggagaaatcgtagtgacgcagtctccagccaccctgtctgtgtcctccgaggggagacggacgccccacccgttctcccgtggccgaggggcccaaagttccgaaggtacgttagtttcggtacaaccaggtcctttaacgcccgttagggtaacccaggaccaaacggtaaacccgtgggacccgtacgggtcccgttccccgggttcctacccgtctaacttccgtccgttacggccttcggccgtaccctacgtccgacggggtaccctacgtcggtaccttccccgtacgtccggtacggttccggtcggaccgtaggttcgggtcgtgggactagtacgttcccgacttccgtaccacgtactccgagtcccgaccgtccgtcgacgtacgttcgtagtacgtggtacgttggttaccgtacgtttacgttttacttcgtacgttactacttacgtaagttcggtaccgggtacgtaccccgtcccggttacggtaccggaccggtaacggaccgtaaggtacgaaacgtacgaacggtagttcggacgtcgaccaccgtactagttaccttcgtcctacttacccg

SEQ ID NO: 123142 - DNA, 715 bp, Homo sapiens
  misc_feature: GYAE6OF01CO2LX.4.1.A01.1.454.CMB.1.raw
  modified_base (409)..(409): a, c, t, g, unknown or other
  misc_feature (409)..(409): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccacgccaccctgtctgtgtcctccgaggggagagacgcccaccctctccgtgcacgggaccaatcgaagtagttattcggtaccacagtcttacgccgtaggtacccagacaacggtaaaccgtcggcccgacgggtcccgttccccggtcctccccttcgacttcctccgtgaccgttcgaccgttcccagtacccggacgggccctaggttccgtacctccccgtcgcccgtagggttcccgnggacgtagggtcgggtcagggactacggtacgttccaccgttctaccacctatccgacgtccacgcctacgctacgttcgtgtataggtacgtttgtcgttacgtttaattttacgttacttcgtacctaattacgtaagtttacggttcgggtacccgtaccccggttaccgtacccgggttaccgggacccgaaacggggtaaccgtaagggtaacgtaaacggtaacgtaaaccgggtagttacggacggttcgaacccgtctaacccgttacttaccggttacttacccgttcgttaacccg

SEQ ID NO: 123143 - DNA, 905 bp, Homo sapiens
  misc_feature: GYAE6OF01E3F0C.4.1.A01.1.454.CMB.1.raw
  modified_base (706)..(706): a, c, t, g, unknown or other
  misc_feature (706)..(706): n is a, c, g, or t
tcagagcactgtagcacgaccggtgctcgatttagacgtctcatcgaggggggaactgctcagttacggacccagacgaaccatggaacgccccagcgcagtcttctcttcctcctgcctactcgtggcctcccagaactccgcgtggagtaaatcgtagtgacgcgagtcctccacgccctaccctgttccgttgttcgtccgtacggaagggggagacggtacccaccctaccccttccgttcccgtacgaccggtacgggacctaaattccgaaggtacgtttacgttcgggtaaccaccgacggtccgttttaaccggtcccgttaaccgggaacctacggtaaccgtaaaacccggtaaacccggccgggaccccgtacgggtccccgtttccccggttcccttacccttccgtaacctttccgttccgtaccggtcccgttaccggtaccccggttaacccgtaccggtaacccgggtaccggtaccccggttaaacgttttcccgggtaaccccgtttccccggttaccggtaccccggggtttccgggtttccgggacggttccgggttagggttcccgggggttacgtaaccggggtaacttaccggttaccgttaccgtcccttaccgtacccgtacgttactaccgtacgggtaccgtccgtaccgtcgggtacctaacggttcgtagttacggngtttaaggttttccgttagttacgttttaagttttacgtaccgtttgacctttaagtaacttagggtacggtttcccggacccggtaccggttacccgtcgggtaaccgacgggaacgtaaacggtaaggtaccaaaacggtacgtacgttaccggtcggtcgcctacgtacgactttcgtactctcccttagtccccg

SEQ ID NO: 123144 - DNA, 724 bp, Homo sapiens
  misc_feature: GYAE6OF01E5KBV.4.1.A01.1.454.CMB.1.raw
  modified_base (201)..(201): a, c, t, g, unknown or other
  misc_feature (201)..(201): n is a, c, g, or t
  modified_base (412)..(412): a, c, t, g, unknown or other
  misc_feature (412)..(412): n is a, c, g, or t
tcagagcactgtagcacgaccggtgctcgatttagacgtctcatcgaggggggaactgctcagttacggacccagacggaaccatggaacgccccagcgcagcttctcttcctcctgctctctcggctccagactcgcgtggaagaatcgtagtgacgcacgtcctccacgccctacctgtctgttcgtcgtcggaggganacgcgccctaccctctccgtgccgacggtaccaagttcgaggtagttacgttcggacacgtacgtcttacggccgtacggaccagaccgaacgtaaccgtcggaccgaccggtccgttcccggtctcctctacgttcctcgtcgcgtcgtcctaccgtagtaccggacggaccttcgttcgtacctcccgcggtccgtacgggtttccggnggtcgtcgggtcgggttggtacggactacgtcttaccgtcctacgacctactacgcgcgtccgacgtaccgtcgacgttgtcgttagtagttcggttagttcggtttacgtacgttttaacgttttacgttacgttcgttaacttaagttacgttacggttacggtccggtacccggttacccggaccgtttacgggtaccgggtaaccggaacggttaccggttaaagggtaacccgtaaacgttaaaccgaccggttaggtcggtccggtactccgtacgtacttccgttactcgtttactccgttcccg

SEQ ID NO: 123145 - DNA, 759 bp, Homo sapiens
  misc_feature: GYAE6OF01EPBK6.4.1.A01.1.454.CMB.1.raw
  modified_base (146)..(146): a, c, t, g, unknown or other
  misc_feature (146)..(146): n is a, c, g, or t
  modified_base (400)..(400): a, c, t, g, unknown or other
  misc_feature (400)..(400): n is a, c, g, or t
tcagagcactgtagcacgaccggtgctcgatttagacgtctcatcaggggggaactgctcagttaggacccagacggaaccatggaagccccagcgcagtcttctcttcctcctgccttactctggctcccagaactccgctgganaaatcgtagtgacgcagtctccagccacccttgtctgtgtcctacggaggggagacgacgccctacccgtcgtccgtaggaccgacggtccaaagtcgtaggttacgttagtcgaccacttacggtccgtttaccgccgtaaggaccaaggtaccgaacggaacccgtcgggaccgtaccggtccgttcccggtctccgtctactcgtcgtcgtacgtcgtaccgtcacgtccggacggtcctagtccgttacnccgtcgtccgtcggttccgaggtcgtcgggtggtcgtagggtacaggtaccgtctaaccgtcctaccgtacctacggtacgacgtcgtacgtccgtggtactacggttcgtagttgtagtttacggttcggtttacgttaggttttaactttacgttacgttaactgttaaaccttacggttattaccgggaccggttaccccggtaccgtacccggttacggaaacccgggtacgaacggggtacaaaacgggtttaccgaaaaccgggttactaaaccggggtttcgtacgggttacgacccgtaacgttacccgtacgttacgtttacccgttcgtttcccgtcttaaacccccgg

SEQ ID NO: 123146 - DNA, 890 bp, Homo sapiens
  misc_feature: GYAE6OF01CFNFW.4.1.A01.1.454.CMB.1.raw
  modified_base (122)..(122): a, c, t, g, unknown or other
  misc_feature (122)..(122): n is a, c, g, or t
  modified_base (695)..(695): a, c, t, g, unknown or other
  misc_feature (695)..(695): n is a, c, g, or t
tcagagcactgtagcacgaccggtgctcgatttagacgtctcatcgagggggaactgctcagttaggacccagacggaaccatggaacgccccagcgcagcttctcttcctctgctactcgngcctccagactccgcgtggaagtaatcgtagtacgacgacgagtcctaccgacgccctacccgtgtccgtggtacgtacgtaccgggaagggggaagacggaccgacccctacccttccgtcccgtacggaccggtaacgggaccctaaagttccgaaggtacgtttaacgttcggactacgtacgtccgtacggtaccgttacggaaccgtacgacgtaaaccggtaaccggtcccggaccgtccggttacccggtttcccccgtacccttacccgttactacggttccctccgttccggccgtttaccggtacccgtacccgtaacggtacccgggaaccgggttcccgtaaccggtttccggttaacccttcccggtccggtaacccggttacgggttcccgggtaaggtaccgggttcgggtacgggtcccggtaacgggtagtacgggttaccttaccgtaccggtttacccaacgtaccctaacgtcgaacccgtacgtacccgcgttagtaccgtacgtagtacgtagttccgttagttcgtaaccgttattacgttttaacccgngtttagtactacttaacgttcggttaacggtaccggtacccgtaacccggtacccgtaacggggttaacccgacgggtaaaccggttacgggaaaaggttaccgaaacgtaaacccggtaacgggtaccttcgggacgtaccggtaccaacggtttaaccgacggttcccgttttagccctttaaacgtccccgg

SEQ ID NO: 123147 - DNA, 669 bp, Homo sapiens
  misc_feature: GYAE6OF01BNXZM.4.1.A01.1.454.CMB.1.raw
  modified_base (308)..(308): a, c, t, g, unknown or other
  misc_feature (308)..(308): n is a, c, g, or t
  modified_base (429)..(429): a, c, t, g, unknown or other
  misc_feature (429)..(429): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagcccaccctgtctgtgtctccgaggggagagacgcccaccctctcctgcgagggcccaatcgagagttattcgggtacactagctttaagccttagggtaccagacaagaaaccgtggccaggcctcccggtctctcatcctntacgctgccgtccatccgagggccacgttcggtacctcccgtgccgtacggttccgtaggcgtaggtcgggtctaggggacacggtacgttccacgtctaccacgtactcgagccagtccngacgtagtctagtagtagtacttggtctacgtttacgttttaacgtttcctggttactaacttacgaagtttggtcggttaccgggaccccgttcccggtaaccggttccgggaacccggtaaacgggtaaccggtaaagggtaaccggtaaactaacccggaaaaccggttagttacgggtaccgacgttaccgaacccgtacgttacgttaccgttcgtttccgttaacgttaccccg

SEQ ID NO: 123148 - DNA, 483 bp, Homo sapiens
  misc_feature: GYAE6OF02JCHSL.4.1.A01.1.454.CMB.1.raw
  modified_base (480)..(480): a, c, t, g, unknown or other
  misc_feature (480)..(480): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgctagtttatactgtcatcaatatggtgaccggccacgttcggccaagggaccaaggtgaatcgaaacgactgtgctgcaccatctgtctntac

SEQ ID NO: 123149 - DNA, 482 bp, Homo sapiens
  misc_feature: GYAE6OF02GELDO.4.1.A01.1.454.CMB.1.raw
  modified_base (480)..(480): a, c, t, g, unknown or other
  misc_feature (480)..(480): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctggggacagagttcactctcaccatcagcagcctgcagtctgatgatgttgctagtttatactgtcatcaatatggtgaccggcccacgttcgccaagggccaaggtgaatcgaaacgactgtgctgcaccatctgtctnac

SEQ ID NO: 123150 - DNA, 545 bp, Homo sapiens
  misc_feature: GYAE6OF02GCATQ.4.1.A01.1.454.CMB.1.raw
  modified_base (275)..(275): a, c, t, g, unknown or other
  misc_feature (275)..(275): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaacctggccaggctcccggtntcctcatctctgctgcgtccatcagggccagtggtactccctgcctagggttcccgtggccaggttggggtctggggacaggtacgttcactctcaccatcagcagcctgcagtctgatgatgttgctagtttacttactgtctatcaattagtggtcgacccggtcctacgttcggaccgaaagggaccaagggtacggaaactaccgaaaacggtaacgttggtacggcttaggacctaccgtagttcctacggttaccttcgtaccg

SEQ ID NO: 123151 - DNA, 479 bp, Homo sapiens
  misc_feature: GYAE6OF02GULC0.4.1.A01.1.454.CMB.1.raw
  modified_base (412)..(412): a, c, t, g, unknown or other
  misc_feature (412)..(412): n is a, c, g, or t
  modified_base (476)..(476): a, c, t, g, unknown or other
  misc_feature (476)..(476): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgctagtttatctgtcatcaatntggtgaccggccacgttcgcaagggccaaggtgaatcgaaacgactgtgctgcacatctgtctntac

SEQ ID NO: 123152 - DNA, 287 bp, Homo sapiens
  misc_feature: GYAE6OF02I0G1I.4.1.A01.1.454.CMB.1.raw
  modified_base (283)..(287): a, c, t, g, unknown or other
  misc_feature (283)..(287): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagttattactgtcatcaatatggtgaccggcccacgttcggccaagggaccaaggtggaaatcaaacgaactgtggctgcaccatctgtcttcatcttcccgccatctgactacagtgctctgagcgggctggcaaggcgcatagnnnnn

SEQ ID NO: 123153 - DNA, 286 bp, Homo sapiens
  misc_feature: GYAE6OF02ILVJ8.4.1.A01.1.454.CMB.1.raw
  modified_base (282)..(286): a, c, t, g, unknown or other
  misc_feature (282)..(286): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgactgtggctgcaccatctgtcttcatcttcccgcatctgactacagtgctctgagcgggctggcaaggcgcatagnnnnn

SEQ ID NO: 123154 - DNA, 558 bp, Homo sapiens
  misc_feature: GYAE6OF02JCJG8.4.1.A01.1.454.CMB.1.raw
tcagagcactgtagcacgaccggtgctcgatttagacgtctcatcagggggaacgtgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtactcctgccaggttccgtggcagttgggtctgggacagagttcactctcacatcagcagcctgcagtctgactgatcgttgctagttttattacgttgtcattactaacgtattgggtcgacccggtccccgtacgttcgggacccaaaggggacctaagggtcggtaaaagtcccgtaaaaacggaaccgtggttacggaccgttcgaccacccgtaatccgtttacggttccgttactaacccg

SEQ ID NO: 123155 - DNA, 308 bp, Homo sapiens
  misc_feature: GYAE6OF02IGMIS.4.1.A01.1.454.CMB.1.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (288)..(308): a, c, t, g, unknown or other
  misc_feature (288)..(308): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtcgaccggcccagttcggccaagggaccaaggtgaaatcaaaacgactgtggctgcaccatctgtcttcatccttcccgcatctgactacagtnctctgagcgggctggacaacgggcncaagtagnnnnnnnnnnnnnnnnnnnnn

SEQ ID NO: 123156 - DNA, 486 bp, Homo sapiens
  misc_feature: GYAE6OF02FSWPK.4.1.A01.1.454.CMB.1.raw
  modified_base (483)..(483): a, c, t, g, unknown or other
  misc_feature (483)..(483): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcaggtgggtctgggacagagttcactctcaccatcagcagcctgcagtctgatgatgttgctagtttattactgtcatctaatatggtcgaccgcctacgttcgcaagggaccaaggtgaatcgaaacgactgtgctgcacatctgtcttntac

SEQ ID NO: 123157 - DNA, 518 bp, Homo sapiens
  misc_feature: GYAE6OF02G3P7K.4.1.A01.1.454.CMB.1.raw
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgctagtttatactgtcatcaatagtggtcgaccggtccctacggtttccggaccaaacggggaccaagggtacgaaataccgaaacggtaactggtaggactagaccaccgtattcgtgttcttctacg

SEQ ID NO: 123158 - DNA, 546 bp, Homo sapiens
  misc_feature: GYAE6OF02GFNVK.4.1.A01.1.454.CMB.1.raw
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtactccctgccaggttcccgtggcaggtgggtctgggacaggagttcactctcaccatcagcagcctgcagtctgatgatgttgctagtttatactgtctattacaattatgggtacgacccgggtccctacggttccggaccgaaacggggtacccaaagggtggaaaactccgaaaacggtaacgttggtacggacttacggacctaccgtagttccgttagttaccttctacg

SEQ ID NO: 123159 - DNA, 534 bp, Homo sapiens
  misc_feature: GYAE6OF02I4ZLQ.4.1.A01.1.454.CMB.1.raw
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaacctggccaggctcccggtctcctcatctctgctgcgtccatcacgggccactggtactcccctgccctaggttccgtggcaggtgggtctgggacagagttcacgtctcaccntcagcagcctgcagtctgatgatgtgctagtttattactgtcatcaatntggtacgacccggtccctacggttccggaccgtaaagggacccgtaagggtacgaaacgttaccgaaacgtaacgttggtacggcctaggacctaccgtatcctggttccttctac

SEQ ID NO: 123160 - DNA, 564 bp, Homo sapiens
  misc_feature: GYAE6OF02GIPZP.4.1.A01.1.454.CMB.1.raw
  modified_base (389)..(389): a, c, t, g, unknown or other
  misc_feature (389)..(389): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacagcttagcctggtaccagcagaaacctggccaggcctcccggtctcctcatctctgctgcgtccatcgagggccacgtggtactccctgccgtaggttccgtggctaggtgggtctgggacaggtagttcactctcaccatcagcacgcctgcngtctgatgtagtgttgtcgtagtttaccccccccttattcgtactatactaatagtaggtacgtaccggtacccgtaccggttccggtaccggaacgggaaccgaaggtacggaacgtaacgaaacggtaacgtacggtacggtcgtacgacgaccgtactcgtcgttcttctac

SEQ ID NO: 123161 - DNA, 287 bp, Homo sapiens
  misc_feature: GYAE6OF02HDG21.4.1.A01.1.454.CMB.1.raw
  modified_base (282)..(287): a, c, t, g, unknown or other
  misc_feature (282)..(287): n is a, c, g, or t
tcagagcactgtagcacgaccggtgctcgatttagacgtctcatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcatcttccgcatctgactacagtgctctgagcgggctggcaaggcgcatagnnnnnn

SEQ ID NO: 123162 - DNA, 531 bp, Homo sapiens
  misc_feature: GYAE6OF02FRG67.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtatggtcacagcttagcctggtaccagcagaacctggccaggcctcccggtctcctcatctatggtgcatccagcgacgggccacgtggcactccccagacgaggttcaggtggcaggtgggtctgggacagtacttcactctcaccatcagcagctggacgcctgaagtatttgacgtaggtgttacttacgtgtcaggtctaggtgttaggtactcgtaccgtaccggtacggttccggacgaacgggacgtagggtagaaacgtcgaaacgacgtgtacggctagctaccatcgtagtcttacg

SEQ ID NO: 123163 - DNA, 571 bp, Homo sapiens
  misc_feature: GYAE6OF02IGQ5G.4.1.A01.1.454.CMB.1.raw
  modified_base (340)..(340): a, c, t, g, unknown or other
  misc_feature (340)..(340): n is a, c, g, or t
tcagagcactgtagcacgaccggtgctcgatttagacgtctcatcaggggggaactgctcagttaggacccagacggaaccatggaagccccagcgcagcttctcttcctctgctactctggctcccagaatccgctggagaaatcgtagtgacgcagtctccagccaccctgtctgtgtctccgaggggagagagccaccctctcctgcagggccaatcagagtattggtcacagcttagcctggtaccagcagaaacctggccaggcctcccggtctcctcatctctgctgcgtccatcgagggccacgtggtactcccctggtcctacgggttccgnggcctaggtcgggtctggggacaggtcgttcactctacaccatcagtcagcctgcagtctgatgattgttgcttagtttattactgtcagttactaattagtggtacgacccggtccctacggttccggaccgaaacggggtaccaaggggttacgaaactacggaaaaccggtacgttaggtacggaccttacggacctaacccgtattccgttagttcccttactaccg

SEQ ID NO: 123164 - DNA, 768 bp, Homo sapiens
  misc_feature: GYAE6OF02GVCO0.4.1.A01.1.454.CMB.1.raw
  modified_base (359)..(359): a, c, t, g, unknown or other
  misc_feature (359)..(359): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcgagggccaatcagagtattggcacgagtcttacgcctaggtaccagcaacgaaacctggccaggcctcccggtctcctcattcctctgctgccgtccatcgacgggccctacgtcggtactccccgtgcccgtacgggtttcccgnggccgtagggttcggggtccgttggggactaggtacgttcaaccttcctacaacctacgtccaacggccacggtccttcggactacggtctaggattaggtacttcggttacgtaccgtttaagttttttaacttaccgttggtttacctaaattaccgttaaaaggtttacggttaccggggttacccggtaacccccggggttaccccgtttaaccggggtttaccccgggaaacccgggttaaaaaccggggtaaccccgggtaaaagggggtttaaccggtaaaaaccgttaaccccgggaaaaaacgggtttaaccgttcggggttaaccgggttacccttacggaaccccgttaaccttacgtttacccggtttaccggtttaccctttccgttaacccccgg

SEQ ID NO: 123165 - DNA, 517 bp, Homo sapiens
  misc_feature: GYAE6OF02F6M6D.4.1.A01.1.454.CMB.1.raw
  modified_base (331)..(331): a, c, t, g, unknown or other
  misc_feature (331)..(331): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtactccctgccaggttccgnggcagtgggtctgggacagagttcactctcaccatcagcagcctgcagtctgatgatgttgctagtttatactgtcattcaatgtggtcgaccggccctacgttccggacctaaaggggacccaagggtcgaaactaccgaaaacggacttggtcggtctcgacacctattcctgttaccttctac

SEQ ID NO: 123166 - DNA, 572 bp, Homo sapiens
  misc_feature: GYAE6OF02GMQAN.4.1.A01.1.454.CMB.1.raw
  modified_base (332)..(332): a, c, t, g, unknown or other
  misc_feature (332)..(332): n is a, c, g, or t
tcagagcactgtagcacgaccggtgctcgatttagacgtctcatcgagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaacctggccaggctcccggtctcctcatctctgctgcctccatcgaggccacgtggtactccctgccagggttccgnggctaggtgggtctggggacaggtacgttcacttctccacctatcagcacgtcctgccagtcctgatgatgttgctagttttatactgtactatcaattgtcggtaccgacccggtacctacggttccggaaccgtaaacgggggtacctaaaggggttacgaaaattaccgaaaaacggtaccttagggtacgacgttacggaccctaaccgtattcccggtacgttaccttaccgtac

SEQ ID NO: 123167 - DNA, 759 bp, Homo sapiens
  misc_feature: GYAE6OF02GCJKK.4.1.A01.1.454.CMB.1.raw
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacagcttagcctggtaccagcagaacctggccaggcctcccggtctcctcatcctctgctgccgtccatcgaggcctacgtggtactcccgtgccgtacggttccgtggctaggttgggtcgtcggggactaggtacgttcgaacttccgtaccaaccctagtaccgaacggtcctaacggcccgttggaccctaacggttccgttagggtaacgttcggtaacgtttcggttttaccggtaacgtttaacggttttttaactttaaccgttcgttaaccctaagttaaccgttaaagttacggttacgggtacccggtaaccccggtaccccgttaccgggtttacccgggaaccccggtaaaacgggggtaacccgtaaaacggggttacgggtaaaaaccgttaacccggtaaaaaaccgggttaaccgtttacggggttaacccgggtacccgttaaccggaccccttaaacccggttacgttacccggttttaccggtttaccccgtttaccgttaaccccg

SEQ ID NO: 123168 - DNA, 609 bp, Homo sapiens
  misc_feature: GYAE6OF02IABGX.4.1.A01.1.454.CMB.1.raw
  modified_base (196)..(196): a, c, t, g, unknown or other
  misc_feature (196)..(196): n is a, c, g, or t
  modified_base (366)..(366): a, c, t, g, unknown or other
  misc_feature (366)..(366): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagcccaccctgtctgtgtctccgagggggganacgccaccctcctcctcgcgagggccaactcagagtagttggtcacagtcttagcctcggtaccacgcaggaaacctggccacggcctcccggtctcctcatcttctgctgccgtccatcgagggccactgtactccctgccgtaggttccgtggcagtgggtctggacngtagtccactctccacatcagcacgctgcagtctgactgacgtgttcgatacgtttttaagttacttcggtactaataccgtaaattacgtggggtccgaaccccggtcccgttacggttaccgggaacccgaaggggaacctaagggtacggtaaaacgtaccgtaaaacgtaacccggtggtcggggacttacggacccaaccgttacttccgttaggtccctttaccgtacgttcccccg

SEQ ID NO: 123169 - DNA, 601 bp, Homo sapiens
  misc_feature: GYAE6OF02IZ48X.4.1.A01.1.454.CMB.1.raw
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (467)..(467): a, c, t, g, unknown or other
  misc_feature (467)..(467): n is a, c, g, or t
tcagagcactgtagcacgaccggtgctcgatttagacgtctcatcagggggaacgtgctcagttaggacccagacggaaccatggaagccccagcgcagcttctcttcctcctgctactctggctcccagaatccgctggagaatcgtagtgacgcagtctccagccaccctgtctgtgtctccgaaggggcagacgccaccctctcctgcagggccaatcagacgtattggtcacagcttaggcctggtaccngcaagaacctggccaggcctcccgtntcctcgactctcngctgaccgtccatcgacgggccacgtggtactccctggccctagggttccnggctagggttcggggtcctaggggacacgggtgttaccaccgtcctacacccgtatccgagcacgtccctggacctacggtctaggattgagttgttagcgtttaagttttacttcgcgttanaactataagttcgtggtaccgtacccggtccgttacgggtaccggacgaaacgggaccgtaaggtacgaaatacccgaaacggtacgtggtacgacgttacgcctaaccgtgtttccgacgtttcctactaccg

SEQ ID NO: 123170 - DNA, 799 bp, Homo sapiens
  misc_feature: GYAE6OF02HKYTW.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggcacagcttagcctggtaccagcagaaacctggccaggctccggtctcctcatctctgctgccgtccatcgacgggcctacgttcggtacctccccgtgtacccgtacgggtttcccggtggccgtaacggggttcggggtaccgtacggggaacagggtacgtttccaacccgtttcgtacccaacccgtagttaccgacggccgtaacggtccccttggacccgtaacggttccttacgggtaacgttcgggtaaacgtttgggtttaccggttaaccgttttaaacgggttttttaactttaaccgtttcggttacctaacgtttacccgtaaaagtttacggttaccggggttacccggaacccccgggttacccccgtttaaccggggtttaccccggggaaacccggtaaaacgggggttaacccggtaaagggggttaaacggtaaaaccgttaacccgggtaaaaaccggtaaccggtttcggggttaaccggcccgtttaacggaaccctacccggttaacgtttcccggtttacgtttacccgttttaccgtaaccccg

SEQ ID NO: 123171 - DNA, 545 bp, Homo sapiens
  misc_feature: GYAE6OF02HLG1T.4.1.A01.1.454.CMB.1.raw
  modified_base (396)..(396): a, c, t, g, unknown or other
  misc_feature (396)..(396): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagcccaccctctccctgcagggccaatcagagtattggtcacagcttagcctggtaccagcagaaacctggccaggctcccggtctcctcatctctgctgcgtccatcacgggccactggtactccctgccaggttccgtggcaggtgggtctgggacaggacgttcactctcacatcagcagcctgcagtctgatgatgtnctagtttattactgtcatcaattagtggtcgtacccggccctacggttccggaccgaaacggggaccaagggtacgaaacttaccgaaaacggtacgttaggtacggcgttacgaccgaacctacgttccgttacgttccttactaccg

SEQ ID NO: 123172 - DNA, 607 bp, Homo sapiens
  misc_feature: GYAE6OF02HCLH4.4.1.A01.1.454.CMB.1.raw
  modified_base (291)..(291): a, c, t, g, unknown or other
  misc_feature (291)..(291): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggtcacagcttagcctggtaccagcagaaacctggccaggcctcccggtctcctcatctcngctcgccgtccatccgacgggccctacgtcggtacttccccgtgtacccgtacgggttccgtggccgtagggttcggggtctaggggactaggtacgtttccacttctaccaccatccagcacgcctgcctagtctaggtatgtacttggttagtcttaagttttacttacgttgttacaattacaaattacgttgggtaccgtacccgggtacccgttacgggttacccgggaccgtaaacgggtaccgaagggtacgaaactacgaaacgtacgtggtcggctacggaccactacttcgtacgtcttactaccg

SEQ ID NO: 123173 - DNA, 497 bp, Homo sapiens
  misc_feature: GYAE6OF02HDNYJ.4.1.A01.1.454.CMB.1.raw
  modified_base (387)..(387): a, c, t, g, unknown or other
  misc_feature (387)..(387): n is a, c, g, or t
  modified_base (494)..(494): a, c, t, g, unknown or other
  misc_feature (494)..(494): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtactccctgcctaggttccgtggcaggtgggtctgggacaggtagttcactctcaccatcagcacgcctgcagtcngatgatgttgctagtttatctgtcatcaatagtcggtcgaccggcctacgttcggaccgaagggaccaaggtgaactcgaaacgatggtgctgacacatcctgtctntac

SEQ ID NO: 123174 - DNA, 629 bp, Homo sapiens
  misc_feature: GYAE6OF02JW5WI.4.1.A01.1.454.CMB.1.raw
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (464)..(464): a, c, t, g, unknown or other
  misc_feature (464)..(464): n is a, c, g, or t
  modified_base (591)..(591): a, c, t, g, unknown or other
  misc_feature (591)..(591): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcgaggccaatcagagtattggtcacagcttagcctggtaccagcaacgaaacctggaccaggtcctccccggtctcctacagttcctctcgctcgccgtccatcgacgggccctacgttggtacctcccgtcgacccgnggtttcccggnggaccgtaggggttcgggtcgtaggggaacctagggtacgttcctaccgtctacccaccgtatccgagtccacgtcctagcctagtcgtgattggattcggttnacgtttatttacttactgtctacgttactaagttagttcgggtccgacccggtcccgttaacgttccgggaacctaacggggaaccttaagggcgtaaagtaccgaaacggtacgtgggtccgtacncgtactaaccgtgttaccgtcgttacctacgttacccg

SEQ ID NO: 123175 - DNA, 613 bp, Homo sapiens
  misc_feature: GYAE6OF02IUTTE.4.1.A01.1.454.CMB.1.raw
  modified_base (237)..(237): a, c, t, g, unknown or other
  misc_feature (237)..(237): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacngcttagcctggtaccagcagaacctggccaggcctcccggtctcctcatctctgctgcgttccatccgacgggcctacgtcggtactcccgtggcctagggttccgtggcgaggttcgggtctggggacaggtagttccacgtcctcgaaccctatcgagtcacgtcctgctaggtctgatggtattggttgtacttagttttacttacgtgtactaagttactaaagttggtcgggttaccgaccccggtacccgttaccgggtttaccgggaacccgtaacggggaaccgtaagggtacggaaacttaccggaaaacggtacgtagggtcgtaccgtacggacctaacgtgttcgttacgttccttacgtaccc

SEQ ID NO: 123176 - DNA, 568 bp, Homo sapiens
  misc_feature: GYAE6OF02G5FZ5.4.1.A01.1.454.CMB.1.raw
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctccccggtctcctcatctctgctgctccatcgagggccagtggtactcccgtgcctaggttccgtggcaggtcgggtctgggacaggagttcactcncacctntcagcagcctgcagtctgatgatgttgcttagtttatactgtactatactaattacgtggtacgacccggtacccgttacggttaccggaccctaaaggggaccctaagggggtacgtaaactacggtaaaaccggtaacgttagggtacggtctacggacctaccgtattaccgttcgttaccttacgtacccg

SEQ ID NO: 123177 - DNA, 712 bp, Homo sapiens
  misc_feature: GYAE6OF02JWQXX.4.1.A01.1.454.CMB.1.raw
  modified_base (253)..(253): a, c, t, g, unknown or other
  misc_feature (253)..(253): n is a, c, g, or t
  modified_base (388)..(388): a, c, t, g, unknown or other
  misc_feature (388)..(388): n is a, c, g, or t
  modified_base (445)..(445): a, c, t, g, unknown or other
  misc_feature (445)..(445): n is a, c, g, or t
tcagagcactgtagcacgaccggtgctcgatttagacgtctcatcagggggaacgtgctcagttaggacccagacggaaccaatggaagccccagcgcagcttctcttcctcctgctactctggctcccagaatccgctggagaaatcgtagtgacgcagtctccagccaccctgtctgtcgtctaccgaggggagagacgcccacctctccgtgcgagggcccaatcagtagtattggtcaacgagtcttanccgtggtaccaggacagaaacctggcctaggcctccccggtctcctacgacttccgtctggtccttacggccgttacccagtccgaacgggccctaacgttcggtaactccccgtggcccgtacggtttcccggnggtacgtagggttcgggtacgtagggaactacggtgttccacttccaccgtaacctntaccgagccgtacgtccgacgtacgtacgttcgtagtagttacgtagttcggttacgttacgtttaagtttaaccttacgttaccgtacttagttaactaagtttacggtccggtacccggacccggtaacccgttacccggtttacgggaaaccggtaaaccgggtaaacggtaacgggttacggtaaaccttaaccggaaacgtaccgttcggtaccggtacgtacgtacccgtaccttacgttccgtacgttactttccctacg

SEQ ID NO: 123178 - DNA, 585 bp, Homo sapiens
  misc_feature: GYAE6OF02FUGM1.4.1.A01.1.454.CMB.1.raw
  modified_base (191)..(191): a, c, t, g, unknown or other
  misc_feature (191)..(191): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggngagagccaccctctcctgcagggccaatcagagtattggtcacagcttagcctggtaccagcagaacctggccaggcctcccggtctcctcactctctgctggccgtccatccgagggcccacgtggtactccccgtgcccgtaggttcccggtggcgtaggttgggtctggggacagtagttcactctccacctatcgacgcacgtcctgaccaggtctgatcgtagtgttgagttagttttacttacgttgtactattactaaattggttcggtacggtacccgtacccgtacggttccggaaccggtaaacgggaaccgtaagggtaggaaactacgaaaccggtaagttcggacggtctacgacctaccgtattcgtgttccttcgtacc

SEQ ID NO: 123179 - DNA, 526 bp, Homo sapiens
  misc_feature: GYAE6OF02GWY7W.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcgagggccatggtactcccgtgcccgtaggttccgtggctaggtgggtctggggacaggtacgttcactctacaccatcagcacgcctgctagtctgatgtatgttgctagtttatctgtctatactaatagtggtcgaccgtccctacggttaccggacgaacgggaccaagggtacgaaactcgaaacgtacgtggacgtacgtgaccactagtctgttctatcg

SEQ ID NO: 123180 - DNA, 561 bp, Homo sapiens
  misc_feature: GYAE6OF02G8Z6G.4.1.A01.1.454.CMB.1.raw
  modified_base (429)..(429): a, c, t, g, unknown or other
  misc_feature (429)..(429): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggtcacagcttagcctggtaccagcagaaacctggccaggcctcccggtctcctcatctctgctgctccatcacgggccacgtggtactcccgtgcccgtaggttccgtaggccaggttcgggtcgtggggactaggtacgtttccaccttctaccacctattccgagccacgccttggctaggtctgatgtatggttncgttagtttatctgtcatactaatcgtggtccgaccggtccctacggttccgaccgaaacgggactaaggtagaaactaccgtaaacgcgttaggtccgacgtcgacctacgtatcgttcgtacttcgtacc

SEQ ID NO: 123181 - DNA, 687 bp, Homo sapiens
  misc_feature: GYAE6OF02IDXM4.4.1.A01.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (378)..(378): a, c, t, g, unknown or other
  misc_feature (378)..(378): n is a, c, g, or t
tcagagcactgtagcacgaccggtgctcgatttagacgtctcatcagggggaacgtgctcagttaggacccagacggaaccatggaagccccagcgcagcttctcttcctcctgctactctggctcccagaatccgctggagaatcgtagtgacgcagtctccagcccaccctgtctgtgtcctcgaggggagagacgccaccctctccngaccagggccaatcagagttagttcggcacagacttacgccttggaccagctaagaacctggaccaggcctccccgggtctcccnctatcctcgttgccttcgccgtaccacgtccncgggtacccacgttggtaccttccccngtcccggtaagggttttccccggnggtaccgtaggggttcgggtacgtgggaacgtacggtacgttaccgtaccttcccgtaccgaccgtactaccgacgaccgtacgtccgtcgcgtacgtcgtgtagtgtagttcgtacgttacgtttacgtttagttccttacgtactaagttaataacgttacgtccgggtacccgtacccggtacccgttacgggttacccggaaaccggtaacgggtaacgtaaaggtacgtaaaccgtaaccggaaacggtaccgtacggtacgaccgtaccgacctacgtaccgttcgtcgttacctactacccg

SEQ ID NO: 123182 - DNA, 605 bp, Homo sapiens
  misc_feature: GYAE6OF02IP2PP.4.1.A01.1.454.CMB.1.raw
  modified_base (237)..(237): a, c, t, g, unknown or other
  misc_feature (237)..(237): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggtcacngcttagcctggtaccagcaagaaacctggccaggcctcccggtctcctcatctctgctgccgtccatcgagggccacgtggtactcccgtgccgtacgggttccgtggcgtaggtgggtccgtagggacaggtacgttcacttctacacctatcgagcacgccgtgacgacgttcgtgtagtagtagttgttacgtacgttagttttacttacgttgtacatactaattagtcggtaccgacccggtacccgtaccgggttccgggaaccgaacggggtaacccgaagggttacggaaacgtaccgaaaacggtacgtacggtacggtacgtacgaccaccgtacgttctacgttaccttactacccg

SEQ ID NO: 123183 - DNA, 598 bp, Homo sapiens
  misc_feature: GYAE6OF02IGSQP.4.1.A01.1.454.CMB.1.raw
  modified_base (236)..(236): a, c, t, g, unknown or other
  misc_feature (236)..(236): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacngcttagcctggtaccagcagaacctggccaggcctcccggtctcctcatctctgctgcgtccatccgaggccagtgtactccctgccgtaggttccgtggctaggttgggctgggactaggtagttcactctacaccatcagtcagtcctgacngtctagntacgnttaggtcgtattacgtttattacgtgtactatactaattacggtcggtaaccgtacccggtcccgtacgggttcccggaaccggtaaagggtacccgaagggtacggaaaactttaaccggaaaaccggtaacgttcggggtaccgtacgttacggacctaacccgtagttccgttacggttccctaacttccccg

SEQ ID NO: 123184 - DNA, 566 bp, Homo sapiens
  misc_feature: GYAE6OF02FYJRK.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaacctggccaggctcccggtctcctcatctctgctgcgtccatcgagggccactggtactccctgcctaggttccgtggcctaggtgggtctggggacaggtagttccactctacacctatcagcagcctgctagtctgatgatgttgtctagtttattactgtctatactaagtagtgggtaccgaccggtccctacggttccggacccggaaacgggaccgaagggtacgtaaactaccgtaaaccggtaacgtacggtacggtacgtacgaccctaacctagttccgttcggttaccgttactacccg

SEQ ID NO: 123185 - DNA, 607 bp, Homo sapiens
  misc_feature: GYAE6OF02HQNNB.4.1.A01.1.454.CMB.1.raw
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcagggaccaatcagagtattggcanagtcttagccgtggtaccagcaagaaacctggaccaggcctcccggtctcctcactctccntcctgcgtaccatcgacgggcctacgtggtactcccgtgcccgtaaggttccggtgaccgtgggttgggtcgtgggaacaggtacttcaaccgtctaccacctatcgagccagtcctagacctagttctagattggattggtgtacgtttagtttaacttactagtctaatactaaatacggttcggtacgacccggtccctacggttaccggaaccgtaaacgggacgtaacggtacgaaaacttaccggaaaacgtaacgtggtacggaccgtcgactaaccgtattccgtagtttctacccgtacc

SEQ ID NO: 123186 - DNA, 662 bp, Homo sapiens
  misc_feature: GYAE6OF02FPW0T.4.1.A01.1.454.CMB.1.raw
  modified_base (341)..(341): a, c, t, g, unknown or other
  misc_feature (341)..(341): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcacgggccaatcagagtattggtcacagcttagcctggtaccagcagaaacctggccaggcctcccggtctcctcatctctgctgccgtccatcgagggcccacgtggtactcccgtgccctaggttcccgnggcaggtgggtcgtggggacaggtagttccacgttcctaccgaccctagtcacggcctaacggcccttaggcctacggttccgtaggtaacgttgggtaactttcggtttacggaaccctttaagggtttttttaaacttaaccgttggtaccttaacttacgttaaagttaggttcggggttaacccggacccccgggttacccttaaccgggtttcccggaacccgtaaggggaacccgtaagggtacgaaacgtaccgaaacgtaccgtgggtacgtcgtacgtaccacccgtagttccgtcgtttaccgtatacccg

SEQ ID NO: 123187 - DNA, 538 bp, Homo sapiens
  misc_feature: GYAE6OF02FRE09.4.1.A01.1.454.CMB.1.raw
  modified_base (192)..(192): a, c, t, g, unknown or other
  misc_feature (192)..(192): n is a, c, g, or t
  modified_base (390)..(390): a, c, t, g, unknown or other
  misc_feature (390)..(390): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggangagccaccctctcctgcagggccaatcagagtatggtcacagcttagcctggtaccagcagaacctggccaggcctcccggtctcctcatctctgtccttcgtccatccgagggccacgtggtactccctgccaggttccgtggcaggtcggggtctgggactaggacgtttcactctccaccatccagcagcctgcngtctgatgatgttgcttagtttattactgtcatctaatgtggtacgaccgtcctacggttcggaccaaagggacgtaacgggtgtaactcgaaaacggtacttagtcgggctacgacaccgtctcgttcgttccttcctagttccccg

SEQ ID NO: 123188 - DNA, 789 bp, Homo sapiens
  misc_feature: GYAE6OF02HEE0H.4.1.A01.1.454.CMB.1.raw
  modified_base (347)..(347): a, c, t, g, unknown or other
  misc_feature (347)..(347): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcgcagtcttagcctggtaccagcagaaacctggccaggcctcccggtctcctcatcctcgtgctgccgtccatcgagggcccagtcggtactccccgtgcccgtagggtttcccgnggccgtagggttcggggtctaggggacctagggtacggtttccaaccttcctaccgaaaccctagttaccgacggtaccaccggtcccgtttggacccgtaagggtttcctagggttaacttcgggttaagtttggtttacggttacgtttaaacggtttttttacgtttaacccgttggtttaaccctaacgttaccttaaaaggtttacggtttacgggggttaacccgggtaaccccccgggttcccccggtttaaacgggttttccccgggggaaaccccggtaaaacggggggtaaaccccgtaaagggggttaccgggttaaaaactaacccggtaaaaaccggtaaaccggtttcggggttaacggtacccgtttacgggacccttaaaccgttaccgttccggtttacggtttaccctttaccggttaaccccg

SEQ ID NO: 123189 - DNA, 504 bp, Homo sapiens
  misc_feature: GYAE6OF02G5W8C.4.1.A01.1.454.CMB.1.raw
  modified_base (315)..(315): a, c, t, g, unknown or other
  misc_feature (315)..(315): n is a, c, g, or t
  modified_base (397)..(397): a, c, t, g, unknown or other
  misc_feature (397)..(397): n is a, c, g, or t
  modified_base (499)..(499): a, c, t, g, unknown or other
  misc_feature (499)..(499): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctcccggtctcctcatctctgctgcgtccatcagggccagtggtancctgcctaggttccgtggcaggtcgggtctgggacaggtgttcacgttctcaccatcagcacgcctgcagtctgatgatgtnctagtttatctgtcatcatgtgtcgaccgtccgacgttcggaccaacggtacgaaggtagaactacgaaacgtactggtgctgacctacgtatctgtccttntaccg

SEQ ID NO: 123190 - DNA, 907 bp, Homo sapiens
  misc_feature: GYAE6OF02IU608.4.1.A01.1.454.CMB.1.raw
  modified_base (196)..(196): a, c, t, g, unknown or other
  misc_feature (196)..(196): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtcctccagccaccctgtctgtcgtcctccgagggganagacgcccaccctctcctgcacgggaccaatccgagacgttagttcggtacacgagtcgttacgcccgttaggtaccagaccaacgtaaacccgtggacccgaggtcccgtaccccggtctcccgtactacttccgttacgtcgtaccgttcggtaccggttacccagttaccggaaccgggccccttaacggttacggtttaaccgttcccccgtaggtaccccggtttaacggggttccccggtagggtacccgtaacgggggttttccgggggttacccggttaacggggtaaaccgttaacgggtttaacccgttttacccgaacccgtttacccgtttaaccccgaaaaccccgtttaacggtttcccgaacgggtacccggtaacccggttcccgtaacgggtaaccttaccggttacgttacggtaagttcggttaaacgttttgggtaacgttaaccttttaaagggttttaaccttttaacggtaccgttacctaaacgtttaacgaaacggttttcgtaccggggttacccgaccccggggttacccgttaaccgggtttaccgggaaacccggttaaaacggggtaccgttaaaccggggtagtaaaaccgttaacccggaaacggttaaccggttacgggtacgtaccgtacgaacccgttaccgttaacgttccgtttacgttacccgtacttacccg

SEQ ID NO: 123191 - DNA, 561 bp, Homo sapiens
  misc_feature: GYAE6OF02IUK1N.4.1.A01.1.454.CMB.1.raw
  modified_base (282)..(282): a, c, t, g, unknown or other
  misc_feature (282)..(282): n is a, c, g, or t
  modified_base (456)..(456): a, c, t, g, unknown or other
  misc_feature (456)..(456): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgccacccctctcctgcagggccaatcagagtattggcacagcttagcctggtaccagcagaaacctggaccaggctcccggtcncctcatctctgctgcgtccatcacgggccactggtactccgtgcctaggttccgtggcagtcggggtcgtaggggactaggtacgttaccacttctaccaaccagttcgaacgcacggcctggctacgtcttgatagacgttgttagctaagttttattactgtcatacaattntggtacgaccgtccacgttccggacgaaacgggacaagggtacgaaagtacaaaaggtacgtgtacggtctagacctaccgtatccgtcgttaccgttactaccg

SEQ ID NO: 123192 - DNA, 635 bp, Homo sapiens
  misc_feature: GYAE6OF02G64V3.4.1.A01.1.454.CMB.1.raw
  modified_base (488)..(488): a, c, t, g, unknown or other
  misc_feature (488)..(488): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaatcgtagtgacgcagtctccagccaccctgtctgtgtctccgaggggagagagcccaccctctcctgcgagggccaatcagagtagttggtcacagtcttagcctggtaccagcaacgaaacctcggaccgaggcctccccggtctcctcactctcgtgctcgccgtccatccgacgggcctacgtggtacctccctgaccgtacggttccggtggcgtaggtggggtcgtacgggacaggtacgttccacgttcctaccgaacctactccgagcccacggtccctggactggttcctggtatcggtagttcgtagtactttagtttactacgtgtacacttaanagttacggtcggaccgtccgtacccgtacgggttaccggaacggtaaaccgggacgttaagggtacgtaaacaaccggtaaacggtacgttagggtccggtactacgaaccttacccgtagtttccgtctttaccctgttacccccg

SEQ ID NO: 123193 - DNA, 576 bp, Homo sapiens
  misc_feature: GYAE6OF02G40N9.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctcccggtctcctcatctctgctgccgtccatcgagggccacgtggtactccctgcctaggttccgtggcaggtcgggtctgggacaggtacgttcactctacaccatcgagcacgcctgcagtctgagtgagtgttgacttagttttatactgtacattacaaattgtcggtacgtacccggccttaaccggttccgggaaccgtaaacggggaccgtaaagggtacgtaaaacgttaccgaaaacggtacttgggtacggaccgttacggacctaaccgtattccgttacgttcctttactaccg

SEQ ID NO: 123194 - DNA, 605 bp, Homo sapiens
  misc_feature: GYAE6OF02FPM8D.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagccaccctctcctgcagggccaatcagagtattggtcacagcttagcctggtaccagcagaacctggccaggcctcccggtctcctcactctcgtgctgcctccagtccgacgggccacgttcggttactcccgtggccctagggttcccgtggccgtagggtcgggtcgtacggggactaggtcgttccacgttcctacaccctatccgagctacgtcctgactacgtctgattggtattggttacgtacttagtttttacttaccgttgttactattacgtaaagttgttcgggtaccgacccggtccgtacggttaccggacgtaaacgggtaccgaagggtacgaaacttaccgaaacgtacgtcgggtacgacttgacaccgtattcgtacttaccttctaccg

SEQ ID NO: 123195 - DNA, 731 bp, Homo sapiens
  misc_feature: GYAE6OF02FW5KQ.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagtccaccctctcctgcaggccatcgagagtatggtcacagcttagcctggtaccagccagaaacctggccacggcctcccggtctcctcactctctgctgccgtacatcgacgggccagtcgtactccgtgccgtaggttccgtggcgtagggttcgggtcgtggggaacctagggtacgttccgtaccttccaccgtaacccataccgacgccgaaccggtcccgttagcccgtaaggttcccgttaggaagttacggtgttacggttttacggaacgtttttaagtttttaaccgtttacttacggttacctacgtttaacgttaaagttacgggtttacggtaacccgggtaccccggttaaccccggtttaccggggttacccggaaacccgggtaaacggggaacccgttaaaggggttaacgtaaaaccgtaaccggtaaaaacccggttaacggttccgggttaaggtaccgttaccgaacccgttaaccgttaccgttccgttacgttttcccgttattaacccccg

SEQ ID NO: 123196 - DNA, 532 bp, Homo sapiens
  misc_feature: GYAE6OF02FHU8D.4.1.A01.1.454.CMB.1.raw
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtatggtcacagcttagcctggtaccagcagaaacctggccaggctcccggtctcctcatctctgctgcgtccatcagggccactggtactccccgtgccagggtttccgtggctaggtcggggtctggggacagagttcacttctcacccatcacgcagccctgcagtctgatgatgttgctagtttattactgtcatcaattagtggtcgacccggccctacggttccgaccgtaagggaccaagggtcggaaactaccgaaaacggacgtaggtggcctgacccacacttctcgttcttctaccg

SEQ ID NO: 123197 - DNA, 677 bp, Homo sapiens
  misc_feature: GYAE6OF02H1FS3.4.1.A01.1.454.CMB.1.raw
  modified_base (402)..(402): a, c, t, g, unknown or other
  misc_feature (402)..(402): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcagggccaatcagagtattggtcacagcttagcctggtaccagcaacgaaccgtggccacggcctccccggtctcctcacttctctgctcgccgtccatcgacgggccctacgtcggtactcccgtgcccgtcgggttccgtggcgtaggttcgggtcgtgggactaggtacgttcactctccaacctancagcacgcctggactacggttctagtactgtacgtttggttacgtacgttttaacgtttttaattacgttcgtactaacttacctaaaggtttacggttccggggtacccggtacccccgggtacccgttaaccgggttacccgggaaccggaaacggggaacccgttaaggggtaaccgtaaaactaccggtaaaacggtaccggttgggtaccggtacgtaccggaaccctaccggttaacttccggtttaccgtttaccttacgttaacccg

SEQ ID NO: 123198 - DNA, 689 bp, Homo sapiens
  misc_feature: GYAE6OF02JC1WW.4.1.A01.1.454.CMB.1.raw
  modified_base (481)..(481): a, c, t, g, unknown or other
  misc_feature (481)..(481): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccacctgtctgtgtctccgaggggagagacgccctaccctctccgtgcgacgggccaatcgaggtacgtattcggtacacagtcttacgccttaggtaccagaccaacgtaaaccgtgggacccaagggtcccttccccggtcttcccgtactaacgttccgtacgtcggccttcggacccgttccagtccgacgggtaccctaacgttcggtaccttcccgtggacccgttagggttcccgaggccgtaagggtcgggtacgtgggactagtcgttacaccgttctacaccgtagtcgacgtccgacgtccgngaccgtagttcgtagtacgttagtattggtagtacctttaagtttactacgtagtactactacgtaagttcggtacgggttacccgacccgttacccgttaacggttcccggaacgaaacgggtacgtaacgggtacgaaacgtaccgaaacggtgtcggtacggcttacggactaccgtacgttacgtcggttaccttacgtacccg

SEQ ID NO: 123199 - DNA, 714 bp, Homo sapiens
  misc_feature: GYAE6OF02F97IG.4.1.A01.1.454.CMB.1.raw
  modified_base (358)..(358): a, c, t, g, unknown or other
  misc_feature (358)..(358): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaatcgtagtgacgcagtctccagccaccctgtctgtgtctccgaggggagagagcccaccctctcctgcagggccaatcagagtattgtcacagcttagccgtggtaccagcaacgaaacctggaccaggcctcccggtctcctcatcctctgctcgtccgtccatccgagggtcccacgttcggtacctcccgtcgcccgtacgggtttcccggnggccgtagggttcggggtacctacgggggactaggttacgttccgtaacttcgtacctaccgtaacttcggacgccgaccggtcccgtaggtcctacggtttcgtggtaagttcggttagttcggtttacgtacgttttagtttttaaccttacgtttgtaccttaacgttaacgtaatttagggttacgggtaccgtaccccgggtaccgttacgggttacccggacccgtaaacgggggaaccgttaacggggtacggtaaactaaccgggtaaaaaccggttacgttacgggtaacgggtccgtacgtacccgtacgtaccgtttaccgttacgtttacccttacgtaccccg

SEQ ID NO: 123200 - DNA, 612 bp, Homo sapiens
  misc_feature: GYAE6OF02H13ZR.4.1.A01.1.454.CMB.1.raw
  modified_base (238)..(238): a, c, t, g, unknown or other
  misc_feature (238)..(238): n is a, c, g, or t
  modified_base (441)..(441): a, c, t, g, unknown or other
  misc_feature (441)..(441): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgcccaccctctcctgcgagggccaatcagagttattggtcangcttacgctggtaccagcaagaaccgtggccgaggcctccccggtctccctctactctcgtgcgtcgcgtccacgtcgacgggcctacgtcggtacgttccctcgtcccgtacgggttccgtcggccgtgggttcgggtcgtgggactaggtcgttacaccgttcaccgtaccactccgacgtccgacgcccttgctaggtcngtaagtctgttggttcacgttttaggtttaacttcgtagtactattacaagttgacggtccgaacccgtccgttaaccggcggaaccgaacgggaaccgtaagggtaacgtaacgtacgaaacgtgttcggcgtccacgtacacgtacgtacgtcgttacccttgtacccg

SEQ ID NO: 123201 - DNA, 663 bp, Homo sapiens
  misc_feature: GYAE6OF02GECGR.4.1.A01.1.454.CMB.1.raw
  modified_base (240)..(240): a, c, t, g, unknown or other
  misc_feature (240)..(240): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagcccaccctgtctgtgtctccgaggggagagacgcccaccctctccgtgcgacgggccaatcagagtattgcagngcttagccgtgaccagacgagaaccgtgaccgaggcctcccggtctcctcatctcgtgcgtcgccgtaccagtccgacgggtcctacgtggttacctcccgtaggtccgtacggttcccggtggcgtacgggttgggtaccggtagggacgtaggtacgttaccacttccgtaccaactctacgacgacgaaccgccgtaggtaccgtagtccttagtacgtggttacgttcggttgtacgtttacgtttttaacgtcgttactactaacgtttacaacgttagtacggtacccggtacccgggtacccttacgggttaacccggacggaaaccgggaaccgttaagggtaccgaacgtaacgaaaccgtaggtacggtacgacgtacacccgtagtcctccttacggttcctaccgtaaccg

SEQ ID NO: 123202 - DNA, 533 bp, Homo sapiens
  misc_feature: GYAE6OF02FSZPE.4.1.A01.1.454.CMB.1.raw
  modified_base (336)..(336): a, c, t, g, unknown or other
  misc_feature (336)..(336): n is a, c, g, or t
  modified_base (406)..(406): a, c, t, g, unknown or other
  misc_feature (406)..(406): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggcctcccggtctcctcatctctgctgccgtccatcgagggccacgtggtactccctgcccaggttccgnggcaggtcgggtctaggggacaggtagttcactctccacctatccagcagcctgcagtctgatgatgttnctagtttatactgtcatctaatgtgtagacccggtcctacggttccggccgaaagggaccctaagggtacgaaactacgaaacgaactggtcggactggaccaccgtaatcgtagtcctttacaccg

SEQ ID NO: 123203 - DNA, 740 bp, Homo sapiens
  misc_feature: GYAE6OF02HN53M.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagacgccaccctctcctgcgacgggccaatcagagtattggtcacagtcttacgccgtaggtacccagacaacgaaacctggccaggccgtccccggtctccgtcactctctgctgccgtccagtcgacgggcctagtcggtactccctggccgtacgggttccggtggccgtagggttcggggtcgtggggacacggtacgttccaccgtttccactacccgtaagtccacggtacgaacggtcccgtaggtaccgtaggttccgttaggtacgttaggtaacgtttcgggtttacgtaccgttttaagtttttaacgttttaaccgttcggttacctaagttacgttaaagttacggttacggggttaccggtacccccgggtacccgttaaccggggttttaccccgggaaccggtaaaaccggggtaaccgggtaaacgggtaaccgggtaaacgttaaaccggtaaaaccggtaccgttaggggtcggtaacccgtgtaacccgtacctaagtttcccgttacggttaccttacgttacccg

SEQ ID NO: 123204 - DNA, 731 bp, Homo sapiens
  misc_feature: GYAE6OF02GBS9N.4.1.A01.1.454.CMB.1.raw
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcacgggccaatcagagtattggtcacagtcttagcctggtaccaggcagaaacctggccaggctccccggtntccncatctctgctgccgtcancgagggccagtcggtactccccgtgccgtacggttccggnggctaggttcgggtcgtggggactaagtacgttccaccgtctcaccatccgagaccacggcccttgaccgtagtccgtagacttaggtagttggttcggtactttaaggtttttaacgttttaaccgttaggtttaccctaaattacgttaaaacgttacgggtttcgggggttaacccgaacccccggggttacccccgtttaaaccggggttcccggtaaacccgggtaaaaccggggtaaccccgtaaaagggggttaacggtaaaaacccgttaccgtaaaaaacccgggttaacgtttggggtaaccggtacgttaacccgggtacccaaacccgttaagtttcccggtttaacggtttacccgttaccgtttaacccccg

SEQ ID NO: 123205 - DNA, 569 bp, Homo sapiens
  misc_feature: GYAE6OF02FHDGN.4.1.A01.1.454.CMB.1.raw
  modified_base (336)..(336): a, c, t, g, unknown or other
  misc_feature (336)..(336): n is a, c, g, or t
  modified_base (391)..(391): a, c, t, g, unknown or other
  misc_feature (391)..(391): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgccgtccatcagggccacgtggtactccctggcctacggttccgnggcaggtgggtctgggacaggtagttcactctcaccatcagcagcctgcagttcngtatgattgttcgcttagttttacttacgtgtactacttactaagtagttcgggtacgtacccggtcccgtaacggttccggaaccgaagggtacccgaagggttacgaaactaccggtaaaacgaacgttcggtacggcctacgtaccgacctagttcttcggttccttacgtaccc

SEQ ID NO: 123206 - DNA, 621 bp, Homo sapiens
  misc_feature: GYAE6OF02HGXR6.4.1.A01.1.454.CMB.1.raw
  modified_base (193)..(193): a, c, t, g, unknown or other
  misc_feature (193)..(193): n is a, c, g, or t
  modified_base (346)..(346): a, c, t, g, unknown or other
  misc_feature (346)..(346): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagcccaccctgtctgtgtctccgagggganagacgcccaccctctcctgccagggccaatcagagtattggcacagcttagcctggtaccagcaagaacctggccaggcctcccggtctcctcactctctgctgccgtccatccgagggccctacgtcggtactcccgtgccgtaggttccgnggccaggtgggtccgtgggacaggtagttcacctcgtacacccgatccgagcgacgtccctgctaggtcctagacttgtaacgttggtttggtacgttagttttaacttacgttgttacctaattactaaagttacggttcggtacggacccggtcccgttacggttccggaccgtaacggggtaccgtaacgggtacgaaacgtaccgaaaacgtaacgtcggtacggtccgtacgaccgtaccgtacgtccgttacgttaccttcgtaacccg

SEQ ID NO: 123207 - DNA, 646 bp, Homo sapiens
  misc_feature: GYAE6OF02IKTLT.4.1.A01.1.454.CMB.1.raw
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccatcagagtattggtcacagtcttagcctgtaccagcaagaaaccgtggaccacggtccctccccggttctcccgtacacttccgtcctcggtcgtcggtccgtccaacgttcgacgggtccctagttcggtactcccgtcgccgtacgggttccgtaggcgtaggttgggtcgtaggggactaaggtcgttactacccgttctaccgacctatcccgagtacctaccgcccttcggtctacgtctagtaacgtgtaagttcgttagtacgtttagtttaacttcgttagtactatactaagttcgtcggtacggtacccggtaccgtaccggttaccgggaccgtaaacgggacgtaaggtacgtaaactacggtaaacgtcgtaggtcgtcgtacgacctacgtattcgtacgttccttactaccg

SEQ ID NO: 123208 - DNA, 748 bp, Homo sapiens
  misc_feature: GYAE6OF02G6OAJ.4.1.A01.1.454.CMB.1.raw
  modified_base (599)..(599): a, c, t, g, unknown or other
  misc_feature (599)..(599): n is a, c, g, or t
tcagagcactgtagcacgaccggtgctcgatttagacgtctcatcagggggaactgctcagttaggacccagacggaaccatggaagccccagcgcagcttctcttcctcctgctactctggctcccagaatccgctggagaatcgtagtgacgcagtctccagccaccctgtctgtgtctccgaggggagagacgcccgaccctctccgtgcgacgggccaagtcaagtagttacttcggtaccacgtacgtcttaacgtcccgttacggtacccaaggtaccaacgtaaaccgtcggaccacggtcccgttccccggtccttacccgttcctacgttccgttccgtacgccgttcggcccgttaccgtacgtacccggtaacggggcccctaaccggttcggtaacccttccccgtaccggttcccgtaacgggttttcccggtaggccgtaagggttccggggtcgtacggggtaacgaggtaccgttcgtacccgtccctacgtaccctaataccgaacgtccgaccgtccgtacgtaccgtacgttaccgtgtacgtgtacgttggttcgtaacgtttagttttacgtacgttnttaccgtatacgtaagttacgtacggtaccggtacccggtaccgtcgggttaaccgaccggtaacggtacgaacggttacgaaacgtaccgtaaagtaccggtaggtccgtactacgtccgtaacgttcgtacgttcgttacgtctccg

SEQ ID NO: 123209 - DNA, 644 bp, Homo sapiens
  misc_feature: GYAE6OF02IZW55.4.1.A01.1.454.CMB.1.raw
  modified_base (192)..(192): a, c, t, g, unknown or other
  misc_feature (192)..(192): n is a, c, g, or t
  modified_base (422)..(422): a, c, t, g, unknown or other
  misc_feature (422)..(422): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctcgagggganagacgccaccctctcctgcagggccaatcagagtattggcacagcttagcctggtaccagcaagaaacctggaccaggcctaccccggtctccgtacacttctctgccttcggccgtaccatcgacgggcctacgtggtactccgtagccgtaggttccgtggcgtaggttcggtcgtgggactaggtacgttcactctacaacctagtcacgctacgcctgcctagtcngtactgtattggtacgtacgttagttttaacttacttgtacctatacgtaaattcggttacgggtaccggacccgggtacccgttaaccgggtttccggaaacccggtaaaccggggaacccgtaagggtacggaaaacttaaccggtaaaacggttaaccggtggttaccggtaccgtggaaccgtaaccgtagttaccttacggttaccttcttaacccg

SEQ ID NO: 123210 - DNA, 698 bp, Homo sapiens
  misc_feature: GYAE6OF02FIR20.4.1.A01.1.454.CMB.1.raw
tcagagcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagacgccaccctctcctgcacgggccaatcagagtattggtcacagcttagcctggtaccagcagaaacctggccaggcctcccggtctcctcactctctgctgccgtccatcgaggccacgtcggtactccctgccctacgggtttccgtcggcgtacggtcggggtccttcgggggaactaggtacgttccgaacttccgtccaaccctactcacggtccacggccccttggacctacggttccgtagtaattcggtaacgttcggtttacgttaccgttaacgtttttttaacgttaaccgtttgttacctaatttacctaaagttacggtttcgggtaccggtaaccccgggtaccccgttaacgggtttacccggaacccggtaaacggggtaacccgtaaaggggtaccgaaaacgttacccggtaaaaacggtaaccgttagggtaccggtacgttacggacctacccgtacgttccgttacggttaccttaccgtaccc

SEQ ID NO: 123211 - DNA, 732 bp, Homo sapiens
  misc_feature: GYAE6OF02HKTE2.4.1.A01.1.454.CMB.1.raw
  modified_base (192)..(192): a, c, t, g, unknown or other
  misc_feature (192)..(192): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaatcgtagtgacgcagtctccagccaccctgtctgtgtctccgagggganagacgcccaccctctcctgcagggccaatcagagtattcggtcacagtcttagccgtgtaccagcagaacctggaccaggcctcccggtctcctcatctctcgctcgtcgtccagtcacgggcctacgtcgtctcccgtgccgtacggttccgtggcgtaggtcgggtcgtacggggacaggtacgttctacgttcctacgtaacccactaccgagtaccgacgtccgtcgaccgtagttaccgtagtagttacggtattacggtttcgtacgttttaagtttttaactttacgtttacgttaccgtaattaccgttaaacgttaggttcgggtacccggttacccggacccccggtttaacgggttaacccggggtacccgtaaaacgggggtaacccgtaaacggggtaacgggtaaaccgtttaaacccggtaaaacggttaaacccgggttagggttaaccggtaccggttaaccgggacccgttaaacccgtaagtttacccgtttacggttacccgtttacccgttaaccccgg

SEQ ID NO: 123212 - DNA, 574 bp, Homo sapiens
  misc_feature: GYAE6OF02FSUO1.4.1.A01.1.454.CMB.1.raw
  modified_base (413)..(413): a, c, t, g, unknown or other
  misc_feature (413)..(413): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagcccacctgtctgtgtctccgaggggagagacgccaccctctcctgcagggccaatcagagtattcggtcacagcttagcctggtaccagcaagaaccgtggccaggcctcccggtctcctcatctctgctcgccgtccatcgacggccacgtggtactcccgtgcccgtacggttccgtggctaggtgggtccgtagggacaggtacgtctacgtctaccacctatcagcacgcctgctagtcgtntagtgtatcgttgacttagttttactctgtacagtactaagttcgtggtaccgcccggtacctacggttaccggaacgtaacgggaccgtaaggtacgaactacgaaacgtacgttcggacgtacctgacccgtactagttccgttcgttccttactcccg

SEQ ID NO: 123213 - DNA, 558 bp, Homo sapiens
  misc_feature: GYAE6OF02H0ECF.4.1.A01.1.454.CMB.1.raw
  modified_base (194)..(194): a, c, t, g, unknown or other
  misc_feature (194)..(194): n is a, c, g, or t
  modified_base (345)..(345): a, c, t, g, unknown or other
  misc_feature (345)..(345): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggganagagcccaccctctcctgccagggccaatcagagtattggtcacagcttagcctggtaccagcagaacctggccaggcctcccggtctcctcactcctctcgctgcgtccatcgacgggccacgtggtactccgtgccgtagggttcccgnggctaggttgggtctgggacaggtacgttcactctcaccatcagcacgcctgctagtctagactgattgttgcttagttttacttcgtgtactatactaattgtcggtaccgacccggtccgtaccggttccgggaaccgtaacgggacgtaaggtagaacgtacgaaacgtacgtaggtcgacgtgacactagttcctgttccttcgtaccg

SEQ ID NO: 123214 - DNA, 660 bp, Homo sapiens
  misc_feature: GYAE6OF02HDG9J.4.1.A01.1.454.CMB.1.raw
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagatccgctggagaaatcgtagtgacgcagtctccagccaccctgtctgtgtcctccgaggggagagacgcccaccctctcctgcgacgggccaatcagtagtattgggtcacgagtccttagcctaggtacccagccaagaaaacctggaccagccgtccccggtctaccctcatctcngtcctgccgtccactcgacgggcctacgtggtacctccccgngtaccgtacgggttccgtggcgtaggtcgggttcgagggtacaaggtcgttcaccttccgtaccacctactcaggccacgcctgctacgttntcgaagttgtacttggttgtaacctttagttttaacttattcgtcaagttacaagttacgtacgggtacgaccccgggtcccgtaacggttcccgggaaccgtaaaccggggtaactaacgggggtaacgtaaaacgtacgaaaaaccggtcggttaacggtcggttaactcggtaccgaacccgttatccgggtttacttacccttgtttaaccccg

SEQ ID NO: 123215 - DNA, 633 bp, Homo sapiens
  misc_feature: GYAE6OF02HHSK1.4.1.A01.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgctgtgtctccgagggganagacgcccaccctctcctgcagggccaatcaggagtagttggtcacngcttagcctggtaccagacgagaaaccgtggaccaggtcctcccggtctcctcacttctctcgccgtgccgtcagtccgacgggtcctagttcggtactccccggtcgtacccggtgggttccgtggcgtagggttcggggttccgttcgggaacgtacggtcgtttaccacgttcccttacgaccaagttccagcagacgtgggtacncgtagtaacgttntttaggactagttcgttaattcgngttacngtctaggttgtggtacgtcctacgaccggttacggttccggaccgtaaagggccaagggtagtaactacggtaaaccggtagttcggacgtccgtacgacccgtaccgtgtttccgtaccgttacttttccacgtttacccg

SEQ ID NO: 123216 - DNA, 641 bp, Homo sapiens
  misc_feature: GYAE6OF02H46DL.4.1.A01.1.454.CMB.1.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctcgaggggngagagccacctctcctgcagggccaatcagagtattggtcacngcttagcctggtaccagcagaaacctggaccaggccttcccggtctcctctactctctcgtctcggccgtcctacgtccgacgggccctacgtcgggtactccccgtacgcccgtaggttccgtggcgtaggtcgggtcgtacggggactaggtacttccgactcctcacctatccgagaccacgcctggactcgtcgtagagtgtattggtcgttcttaagttttacttcgttacgtctattactaacgttaggttcggtaccggtaacccggtcccgttaaccgggttcccggaaaccggtaaaccgggtaacgtaaggggtacgtaaactaaccggaaaacgtaccgttagggtacgtacgtacgtacccgtaacctgttccgtttacgttccttacgtacccg

SEQ ID NO: 123217 - DNA, 620 bp, Homo sapiens
  misc_feature: GYAE6OF02GW6O7.4.1.A01.1.454.CMB.1.raw
  modified_base (347)..(347): a, c, t, g, unknown or other
  misc_feature (347)..(347): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccgaggggagagagcccaccctctcctgcagggccaatcagagtattggtcacagcttagcctggtaccagcagaaacctggccaggcctcccggtctcctcatcctctgctcgccgtccagtcgacgggccctagtcggtactcccgtgccgtaggttcccgnggcctagggtcgggtcgtaggggacaggtacgttccacttctcaacctatcgagcacgcctagctagtcgagatgattgttcgtacttagttttactactgttactaattacgtaattacgtgggtacccgtacccggtacccgttacgggttcccgggaaccgaaacggggtaccgtaaacggggttacgtaaaaccgtaccgtaaaacggaaccgtttcgggaacggtccgtacgaacccgtctacgttccgtacgttcccttacgtaccc

SEQ ID NO: 123218 - DNA, 710 bp, Homo sapiens
  misc_feature: GYAE6OF02JVSHV.4.1.A01.1.454.CMB.1.raw
  modified_base (181)..(181): a, c, t, g, unknown or other
  misc_feature (181)..(181): n is a, c, g, or t
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (467)..(467): a, c, t, g, unknown or other
  misc_feature (467)..(467): n is a, c, g, or t
  modified_base (658)..(658): a, c, t, g, unknown or other
  misc_feature (658)..(658): n is a, c, g, or t
  modified_base (671)..(671): a, c, t, g, unknown or other
  misc_feature (671)..(671): n is a, c, g, or t
tcagagcactgtagcacgaccggtgctcgatttagacgtctcatcgagggggggaactgctcagttaggacccagacggaaccatggaagccccagcgcagtcttcctcttcctcctgctactctggcctccagaactccgctgggaataatcgtagtcgacgcagtctccacgcctcctntcgtgtctccgacgggaggngacgtccaccctccttccgctgaccggacgtaccatcgagtagtacgttcgaccacngtcgtacgtcgtacgcacgtacaacgtaaccgcggacgtcggtcccttcccggtcctcctctcgttcctcggtacgtcgtccgcctacgtacgtaacgggcccgtaccgtcgtaccgttcctccgcggtacccggtcgggtccgtacggcggtggttccgggcggtaagtcgtacgtcttacctcgttaacctccgactacgtacccgnggtcccgtacggtctcggttaccaaggttctatcgttaacgttccgtgttacgtacttttaacgttcgttagtcccttaagtaccttaaggtccggttaccgttcgggaacccggtttccccgtgtaacccggggtaacggtacggaacggggtaaccgttaaggacccgtttaagaacccggtttaaggnttccggggtaacnccgtacgtacttctacgttacgtccttcctacccgttcc

SEQ ID NO: 123219 - DNA, 617 bp, Homo sapiens
  misc_feature: GYAE6OF02F7IGN.4.1.A01.1.454.CMB.1.raw
  modified_base (193)..(193): a, c, t, g, unknown or other
  misc_feature (193)..(193): n is a, c, g, or t
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
tcagagcactgtagcacgaccggtgctcgatttagacgtctcatcagggggggaactgctcagttaggacccagacggaaccatggaagccccagcgcagcttctcttcctcctgctactctggctcccagaatccgctggagaaatcgtagtgacgcagtctccagccaccctgtctgtgtctccagggganagagccaccctctcctgcagggccaatcgagagttattggtcacagcttagcctggtaccagcagaacctggccaggctcccggtctcctcatctctgctgccgtccatcgagggccctacgttggtactcccgtgcccgtagggttccgtggctagggttgggtccgtgggacnggtacgttcacttcctaccacctatccgagccgagcctgctagtctagntggattgttgactttagttttactacttgtactacttacgtaatggttacgggtaccgacccggtcccttacgggttacccgaccggtaagggtacccgtaaagggtacgtaaactaccggaaaacgttaccggttggtaccgggtataccggtacccaaccgtttacgttccgtttacgtttaccgttaccttaacccg

SEQ ID NO: 123220 - DNA, 759 bp, Homo sapiens
  misc_feature: GYAE6OF02JCZLQ.4.1.A01.1.454.CMB.1.raw
  modified_base (470)..(470): a, c, t, g, unknown or other
  misc_feature (470)..(470): n is a, c, g, or t
tcagagcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccacctgtctgtgtctccgaggggacagacgccacccgtctcctgcagggccaatcagagttatggtcacagtcttagcctggtaccagcagaacctggaccaggtcctccccggtctccgtacacttcctcgtcggcctcggtacccgtcctaagtccggaaacgggtccctaacggtttcgggttaaccttcccccgtaggtaccccgttaaggggttttccccggaggtccgtaacgggggtttggggtaccgttacgggggaactaggtaacgtttcccacgtttccacccgaaacctntaccgacgtccacgtcccgtagtacgtacgtcgtagacgtcgtagttcgttagtacgtttagttttactccgttagttactaacgttaacgtaacgttacggttccgggtaccggaccccggttaccggttaaccgggttaccggaaaccggtaaaccggggtaacgtaaacggggttacgtaaaaccggtaaccggtaaaacggttaccggttaccgggtacggtccgttaccggtaaccgttacccgttaaccgttaccgtttacggtttacccgttaccgtacccg

SEQ ID NO: 123221 - DNA, 710 bp, Homo sapiens
  misc_feature: GYAE6OF02I0D5Z.4.1.A01.1.454.CMB.1.raw
  modified_base (142)..(142): a, c, t, g, unknown or other
  misc_feature (142)..(142): n is a, c, g, or t
  modified_base (295)..(295): a, c, t, g, unknown or other
  misc_feature (295)..(295): n is a, c, g, or t
tcagagcactgtagcacgaccggtgctcgatttagacgtctcatcagggggaactgctcagtttaggacccagacggaaccatggaagccccagcgcagcttctcttcctcctgctactctggctcccagaatccgctgganaaatcgtagtgacgcagtctccagccaccgtgtctgtgtcctcgaggggagagacgcccacctctcctgcacgggccaatcgagtagtattcggtcacaggtcttacgcctcggtaccagcgagaacctggccgaggcctcccggtcctcctnacgtctctgctggcctccagtcgacgggtccctacggttcgtacctccccgtcggacccgttacgggttcccggtcggaccgtaggggttcggggttacgtacgggaactacggttacgtccgtacctcctacacccgtactaccgacgccgtacgtcccgtacgacgttacggtctacggtacttaggtacttggtttaacgtacgtttacggtttaacgtttaccgtagttacctaacgttaaccgtaagttacggttacccgggtaccgtacccgggttaccccgtaacgggttacccgggaacccggtaaacggggaacccgtaacgggtaacgaaaccgtacgtaaacggtaccgtcgggtaacggtccgccgttaacacgttccttaccgttcggttactacgttaccg

SEQ ID NO: 123222 - DNA, 749 bp, Homo sapiens
  misc_feature: GYAE6OF02JD36E.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctcctgctactctggctcccagaatccgctggaagaaatcgtagtgacgcagtcctccacgccaccctgtctgtgtctcgagggagagacgccaccctctcctgcgacgggaccaatacgagtagtagttcggacacgtagtcgttacgtccgtaggtaccacggaccaacgaaccgtcggaccgacggcctcccggtctcctctactctctcgctcgtccgtactacgtcggacgggtaccctaggtacgttacctcccgtacggtcccgtacgggttccggtacggacgtcggggttacgggttccggtacgggaacgttacggtacgttaccctacgttccgtacccaaccggtacttaccgaacgtcgtaacccggccttacgggaaccgtaacgttcgtaacgggttacttggtaacgttgttaacgttacgttttaacgtttacgttctacgttcctaacgttacgtaacgttcggttacgggtacccgtacccgggtacccgttaccggtaaccggggaaacccgttaagggggaaccgttaacgggtacaaaacggttaccgaaaacggttacggttggaaccgtacgtaccgacccgttaactggttcctttaccggtctttaccctcccgg

SEQ ID NO: 123223 - DNA, 636 bp, Homo sapiens
  misc_feature: GYAE6OF02GDCLG.4.1.A01.1.454.CMB.1.raw
  modified_base (345)..(345): a, c, t, g, unknown or other
  misc_feature (345)..(345): n is a, c, g, or t
  modified_base (417)..(417): a, c, t, g, unknown or other
  misc_feature (417)..(417): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagcccaccctgtctgtgtctccgaggggagagacgccaccctctcctgcgagggccaatcagagtattggcacagcttagcctgtaccagcagaacctgccgaggctccccggtctcctcatctctgctcgccgtccatccgaaggcctacgtcggtactcccgtgccgtacggttccggngcgtagggttcgggtcgtagggactagtacgttcactcctaccactatcagcgcgtctcgctacgtcgtagnttgtattgttgtacgtttagttttacgttatcgtactactataacgttagttcgggtaccgacccggtcccgttaacgggtccggtaacccggtaaacggggtaccgtaaggggtaacgtaaaccgtaacccggtaaaaccggttacgttacgggtcggttacccgtagtaaccccgtactttacggttcccgttacgtttaccttacccgtttacccg

SEQ ID NO: 123224 - DNA, 740 bp, Homo sapiens
  misc_feature: GYAE6OF02GLMZI.4.1.A01.1.454.CMB.1.raw
  modified_base (512)..(512): a, c, t, g, unknown or other
  misc_feature (512)..(512): n is a, c, g, or t
  modified_base (540)..(540): a, c, t, g, unknown or other
  misc_feature (540)..(540): n is a, c, g, or t
tcagagcactgtagcacgaccggtgctcgatttagacgtctcatcaggggggaactgctcagttaggacccagacggaaccatggaagccccagcgcagcttctcttcctcctgctactctggcctcccagaatccgctggaagaatcgtagtgacgcacgtctccgagtcccacctgtctgtcgtcctccggaggggagacgaccgccccaccctccgtccgtggccgacgggaccaacgtcgaaggtagttacgttggtacacgtagtcgttacgtccgttcggtacctacggacgaacgtaaaccgtcggaccgtacggtcccgttaccccggtccttcccgtctacttccgttcgtcgtcgtccgccgtaccgtacgtacggaccggtcctaccgttacggttacccgtcccgtcggttaacccggttaccgggttccggtacggtacgggttcgggttcgggttcggtacgggtaacgtacggttcctaccgtcgtacccgtaaccncgtaccgtacgaccgtccgtacgtccgngtaccgtagttctggtacgtagtcggttacttacggttactttagtttacctacgttctaacctattacgttaagtccggtacggtcccggtaccgttaccggtacggaccgtaaacggtacggtaagtaacgtagtaaccgtaggtaacgtaggtacgtgaccgtagaccttacgtacttcctacgttccgcttacccg

SEQ ID NO: 123225 - DNA, 418 bp, Homo sapiens
  misc_feature: GYAE6OF02HR7HP.4.1.A01.1.454.CMB.1.raw
  modified_base (230)..(230): a, c, t, g, unknown or other
  misc_feature (230)..(230): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (364)..(418): a, c, t, g, unknown or other
  misc_feature (364)..(418): n is a, c, g, or t
tcagagcactgtagcacgaccggtgctcgatttagacgtctcatcagggccactgggtatccctgccaggttccgtggcagtgggtctgggacagagttcactctcaccatcagcagcctgcagtctgatgatgtgctagtttattactgtcatcaatatggtacgacccgcctacggttaccggaccgaaacgggaccgaagggaggaaaactacaaaacggtactggnggcgtacgcctaaccattcgttacgttcttctacttcccttcccgcctatctacgtactacgagttcactcgtagacgggtcggctcgggacggaaggccgactagtagcctgntcagcctgatcagangttcnnnnnnnnnnnnnnnnnnnnnnnnnnnnnnnnnnnnnnnnnnnnnnnnnnnnnnn

SEQ ID NO: 123226 - DNA, 796 bp, Homo sapiens
  misc_feature: GYAE6OF02HF4EY.4.1.A01.1.454.CMB.1.raw
tcagagcactgtagcacgaccggtgctcgatttagacgtctcatcaggggggaactgctcagttaggacccagacggaaccatggaacgccccagcgcagcttctcttcctcctgctactctggcctccagaatccgctggaagaaatcgtagtgacgcacgtctccacgcccacctgtctgtctctccgaggggagacgacgcccaccctcgtcctcgcgaacgggccaaatccgaagacgttaagttcggccaactagtaccgtttaacgccgttacggggtaaccaaggacctaaacggtaaaaccgttccggggaccacggggtacccgttcccccgggttacctccctcctaacttccgttacgtcggtaccgttcgacccggttacccaacgttccggaaccgggtaccctaacgggttcggttaaccttcccggtacgtcccggtacgggttcccggtaggccgtacggggttcgggtacgtacgggacgaaggttacgttacctaccttcccgtaacaaccgtactacgaccggaccgtcgtaccctcgaccgttaagttcctaggtaagttacggtagttcggtttaacgaaccgtttaaacgtttttactacgtatttaccgatttaaaccaagtttacggtcggtaacccggacccggttacccgtacggttaccggggaaacccgaaacgggaaccgtaaaacgggtacgtaaaacacccggtaaaacgtaccgtaggtaacccgcgtcaaccctcgttactaccggtttcttactcccgtacc

SEQ ID NO: 123227 - DNA, 752 bp, Homo sapiens
  misc_feature: GYAE6OF02G9HCW.4.1.A01.1.454.CMB.1.raw
  modified_base (246)..(246): a, c, t, g, unknown or other
  misc_feature (246)..(246): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaactccgctggagaaatcgtagtgacgcagtctccacgccacctgtctgtctcgtccgagggagagacgcccacctctccgtgcgacggaccaagtcgaagtagtagttcgacacngtcgtacgccgtacgtacagacaacgtaaccgtcggaccacggcctccccggtctcctcgtacttcctcgtcgtcgtacgtccgtacacgtcggtaccggcgtaacgttccggtacgtccccgtcggaccggttaccgggttccggtcggtaccggttagggtccgggtaccggtggaacgtacggttaccttaccgtaccgtactaccgaaccacgttaccgacgtaaccgccgtttccggaccgttacgtacgttacggtcgtaaacgttgttaacggttttacggttacgtttaaaccgttacgggtttttaacttaccgtaacctttacgtaaacgtttaccgaaaggttttcccggtacgggtttaccccgtaacccggttaccgttaacccgggtcggggttaaacccggaaacgggttaaaccgtaggtaaccgtaaacgtaaccggtaacgtcgttacggctcggacttacgacttccgtagtactttccgacgtccc

SEQ ID NO: 123228 - DNA, 895 bp, Homo sapiens
  misc_feature: GYAE6OF02IMRCZ.4.1.A01.1.454.CMB.1.raw
  modified_base (148)..(148): a, c, t, g, unknown or other
  misc_feature (148)..(148): n is a, c, g, or t
  modified_base (613)..(613): a, c, t, g, unknown or other
  misc_feature (613)..(613): n is a, c, g, or t
tcagagcactgtagcacgaccggtgctcgattttagacgtctcatcgagggggaactgctcagtttacggaccagacggaaccatggaacgccccagcgcagcttctcttcctcctgctactctggctcccagaactccgctcggaanaaacttcgtagtcgacgcacgtctccacgcctaccctgtcttcgtcgttccgtaccgaggggtacacggtaccgccctacccgttcgtccgttggaccgtaacgggtccctaaagttaccgacggtaacggtttacgtttacgggttaccaacgttacggtcctttaacggcccgtttacgggtaaccgacggtaaccgttaacggtaaaacccggttcggggacccctaacggggtccccgttaccccggttctcccttaacgacctttcccgttcgtcggtacccgtacggttcccgaccgtacgttaccggaccggtacttaacggttccgtaccgtttccgccgtaccggtttaaccggtcggtacgtacggttcggtttacgggtacgtacgggaacgttacggtacgttccgaacgtccgttaccaccggttaacgccgtaccggtagacccggttacncggtaacgtcgtacggtttatacgttacgggttgtttaccggttcgtttaacgttttacgtttttacgttacgttacccgtttacgtaacttttaacgggacttaccggggtttaccggttacccgaccccggtttaacgtccggggttaaaaccgtaaccggggaaaccgttaacggttaaacggttacgaaaccggtttaacgtaaacgggtcgttccggttaaccgacgtaaccgaccttacgtttaaccgttcggttaccgttaccctacggttcccg

SEQ ID NO: 123229 - DNA, 760 bp, Homo sapiens
  misc_feature: GYAE6OF02G5R5Z.4.1.A01.1.454.CMB.1.raw
  modified_base (178)..(178): a, c, t, g, unknown or other
  misc_feature (178)..(178): n is a, c, g, or t
  modified_base (212)..(212): a, c, t, g, unknown or other
  misc_feature (212)..(212): n is a, c, g, or t
  modified_base (383)..(383): a, c, t, g, unknown or other
  misc_feature (383)..(383): n is a, c, g, or t
  modified_base (488)..(488): a, c, t, g, unknown or other
  misc_feature (488)..(488): n is a, c, g, or t
  modified_base (532)..(532): a, c, t, g, unknown or other
  misc_feature (532)..(532): n is a, c, g, or t
  modified_base (564)..(564): a, c, t, g, unknown or other
  misc_feature (564)..(564): n is a, c, g, or t
tcagagcactgtagcacgaccggtgctcgatttagacgtctcatcgaggggggaactgctcagttaggacccagacggaaccatggaacgcccagcgcagcttctcttcctcctgcttactctggcctcccagaatccgctggaagaaatcggtagtgacgcagtctacacgtacccncccgttgtccgagttcgtccaccggaaggggganagaccgaccctacctcctacctggaccgacggtaccatcgaaggagttacgttcggaccaactacggtccttaacggcccgttaggggtaacccacggacgtaaaaccgtaaaccgtccggaacccgtacggtccccgttaccccgggtcctccgtataccgttccttcgngcttccggaccttacacggttccggacgtacctacttacggttacctcccgttacggaccggtcggttccggtacggcgttcgggtacgggtcgaacggggtaanaggtttaccgtacctacgtcctaccgaccgtagtaacgcgtacncgtaccgtgtacgtcgtacgtagtcgtaagtnttacggtgttacgtttacgttaacttctattactaactacgttaagtaggtccgggtaaccgtccggtaaccggttcggttaaccgggaaccgtaaacgggaacggtaaggtaacggttaacgtaaacgtaacggtactagggtaccgtaacgaccgaccgttaacaccgtttcaaccggtttcaccgtttacccg

SEQ ID NO: 123230 - DNA, 778 bp, Homo sapiens
  misc_feature: GYAE6OF02H5IQP.4.1.A01.1.454.CMB.1.raw
tcagagcactgtagcacgaccggtgctcgatttagacgtctcatcaggggggaactgctcagttaggacccagacggaaccatggaagccccagcgcagcttctcttcctctgctactctggctcccagaatccgctggagaaatcggtagtgacgcagtcctccagcccaccctgtctggtcgtctccgagggggagagacgcccaccctcgtcctgccagggccaatcgagagttattggcacagtcttacgccgtagtaccagacaagaaaccgtcggaccacggtccgttcccggtcctccgtcacttcctacctggccttcggtccgtacctacgttaccgacgggtccctacgtcggttaccgttccccgtcgaccgtacgggttccgtggaccgttagggttcggggtctacggggacgtaggtacgttccacttccgtactaccacttcgacgtctacgtccgtacgtacgtacgttccgtagtaacgttaggacgtttaggttacgtacgttttaagttttaacgttacgttacgttctaacttacgttaaacgttacggtacgggttaccggtacccggtcccgtttaaccgggttcccgggtaaacccggtaaaccgggggtaaaccccggttaaggggtaaccgggtaaaaccgtttaacccgggaaaaccggttaaaccgttcgggttaaccggttaccgtaccggtacccgaacccgttaacgtttccgtttaccggttttacccgttaccgtttaacccccgg

SEQ ID NO: 123231 - DNA, 772 bp, Homo sapiens
  misc_feature: GYAE6OF02JFCJZ.4.1.A01.1.454.CMB.1.raw
  modified_base (195)..(195): a, c, t, g, unknown or other
  misc_feature (195)..(195): n is a, c, g, or t
  modified_base (435)..(435): a, c, t, g, unknown or other
  misc_feature (435)..(435): n is a, c, g, or t
tcagagcactgtagcacgaccggtgctcgatttagacgtctcatcgaggggggaactgctcagttaggacccagacggaaccatggaagccccagcgcagcttctcttcctctgctactctggcctccagaactccgctggaacgtaaatcgtagtgacgcacgtctccagtccgacctgtctggtcgtcctcgnggggagagtacgccctaccgtcctaccgtcgccgacgggtacctaagtcgtagtacggttaagttcggacctacgagtccgttaacgtccgtacggtaacgacgactacgaaaccgtcggaccgtcggtcccgtcccggttcctaccgtctacttcgtcgtcggccgtcgtcccgtcctaagtccgtacgggacccttaggtaccgttacgtccgtccggtacggttacccgggttccgnggtaccggtaggttggttccggtacgggtacgtacggttacgtcctaacctaccgtacctaccgtacgtcgtaaccggtactaccggtccgtcgtaacggtcgtaccgttgaacgttgtaacgtttgtaaccgttcgttttaaacttccgttatccgttacaacttaacaacggtttacggaccgggtacccgtaacccggttcccgttaccgggtaaccgggtacgaaacgggtaaccggtaaagtactaaacggtaacccgtaaggccttaccgggtatacccgtaacggtccttaacggtcccttacggtttccttacggttaaccctccccgg

SEQ ID NO: 123232 - DNA, 696 bp, Homo sapiens
  misc_feature: GYAE6OF02IJN0Y.4.1.A01.1.454.CMB.1.raw
  modified_base (199)..(199): a, c, t, g, unknown or other
  misc_feature (199)..(199): n is a, c, g, or t
  modified_base (667)..(667): a, c, t, g, unknown or other
  misc_feature (667)..(667): n is a, c, g, or t
tcagagcactgtagcacgaccggtgctcgatttagacgtctcatcaggggggaactgctcagttaggacccagacggaaccatggaagccccagcgcagcttctcttcctcctgctactctggctcccagaactccgctggaagaaatcgtagtgacgcagtctccacgcccaccttgtcttgtcgtcctcgagggganacgacgcccaccctctccgtagccgacgggtaccaactccaaggtacgtagtttcggacatacgtacgttacgcccgtaggtaccagtacaacgtaaaccgtggaccgacggcccgttaccggtcctcctcacgttcctctcgtctcgccgtacacgtacgacggtacctacgtcgttacctccctacgtccgttacggttccggtaggtccgtagggtccggtacgggtcggtaacgaggttaccgtcctaccgtttcccaactaccctataccgtactaccgtcgtccgtacgtcgtacgttacgtgtaacgtgtacgttgttgttaactttagtttacttcgtatacctataccgtatttaggaccgtaccggacccgtccggttacggtaccggaacggtaaccgggtaacgtaggtaacgaaccgtaagaaccggttaagtcgacgtaccgtacgacccttanccgtttagttcccttactaccgtttcccg

SEQ ID NO: 123233 - DNA, 912 bp, Homo sapiens
  misc_feature: GYAE6OF02FYDC8.4.1.A01.1.454.CMB.1.raw
tcagagcactgtagcacgaccggtgctcgatttagacgtctcatcagggggaactgctcagttaggacccagacggaaccatgggaagccccagcgcagcttctcttcctcctgctactctggcctcccagaactccgctggaagaaatcgtagtgacgcacgtctccgacgccaccctgtctgtcgtctcgaggggagagacgcccacccttctccgtcgacgacggggaccctaatcaaggtagttaagttcgggttaccaacgtacggtccgtttaacggcccgttacggttaacccacgtaccgaaggtaaacccgttgggacccgaacggtccccgttaccccggttcctccgtactacttcgttctcggtccgttcggtaccctacctagtaccggaccgggtacctaccgggttcggtttacccgtcccggtaccgtccggttaccgggtttaccggtcgggtaccgttacgggggtacgggttacccggtaagggggtaaccgtaacgggtttaccgttaccgaacccggtttaccttacccgaaacccgttagttacccggacgtaccggttaaaccgggccccttgggaaccgtacgggttactaccggtagtacggttaacttcgggggttaacttccgttttaaagggttttacctttagtaccggttacaaacggttaaccgtaagttaccggttcggggtaacccgacccgggttcccgtttaaacgggtcccggggtaaaccgggtaacccgggttaaaccgggtaaaggggtaacccttaaaccgggtaacccgtaaaacccggttaggtttaccgggggaaccgttacgaaccggttaacccctacggtttaacccgtttcccggtagtttttaccccgtacgtttaacccccgg

SEQ ID NO: 123234 - DNA, 753 bp, Homo sapiens
  misc_feature: GYAE6OF02F4B9J.4.1.A01.1.454.CMB.1.raw
  modified_base (564)..(564): a, c, t, g, unknown or other
  misc_feature (564)..(564): n is a, c, g, or t
tcagagcactgtagcacgaccggtgctcgatttagacgtctcatcagggggggaactgctcagttacggaccagacggaaccatggaacgcccagcgcagcttctcttcctcctgctactctggctcccagaactccgcgtggaagaaactcgtaggtgaccgctacgtcctccagcccaccctgtctcgtcgtcctccggaggggacgacgacgacccctacccttcctccgtgaccgacgggacctaatcgaagtaggttaagttcggtcacgtacgtccgtttacgccggttacggtacacgactaacggaaacctcgggaccacggtcccggttacccggtctaccctctacttcctcgtcgtccgtacgtccgtaccagtccgacgggtcctacgttccgttaccgtccgtcgtaccggtccggttacggcggtacgtacgggttcgggtacgacgggtcgacggtactcctacgtccctacgactacctacgcgaccgtaccgcgtcgaccgtgtgtaactcggtgttcgttagggttctacggtttacgttttaacncgtacgttctaaacgtcttaagtaccgggtacggttacccggaccggttaccgaccggggttaacccctaacgggggtaaaccgtaaccgggtaacgggttaacgtaaccgaacggtaacccgggttaggttaccgtacggtaccgacgtaccctacggttaccgttgtttcccgtactttcgtcccgg

SEQ ID NO: 123235 - DNA, 684 bp, Homo sapiens
  misc_feature: GYAE6OF01B08MF.4.8.A08.1.454.CMB.1.raw
  modified_base (323)..(323): a, c, t, g, unknown or other
  misc_feature (323)..(323): n is a, c, g, or t
tcagagcactgtagcacgaccggtgctcgatttagcatactctacgaacgacacgaaagggggaggaactgctcagttaggacccagacggaaccatggaacgcccagcgcagcttctcttcctcctgctactctggctcccagtataccacgtggaagtaaagttagtgatgaacgtacgagtcctccgagcccaccctgtctgtcgtctccgaaggggaaagacgcccaccctctccgtggcaggccagtcagagtgtaggatctaacgttcgcctaggtaccagacaataacctggaccaggcctcccgaggcctccgtnacttcgagtggtcgacgtactcccgaccgacgggcctaagttcggtactcccgacgtacccgtacgttcgaaggttcgacgtagggttcgggtacgacggggaccacgtacgttacaccttccgacacctatccgaacgccaacgtccctgaacctaagttcctaagtaacggtttagttttagggaactttttaacttacgtacgttacaaggtacctaaaggttacgttaaacgtaccgtcggtaccctttacgttaccgttaaccggtttcggggacggtaaccgggtacctaaggggtcgaacgtaacgtaccggaaacgtacgttcggtacggactacggcctaccgtagttccgg

SEQ ID NO: 123236 - DNA, 612 bp, Homo sapiens
  misc_feature: GYAE6OF01CZXOS.4.8.A08.1.454.CMB.1.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggctcccagactaccatggagaaatagtgatgacgcagtcctccagccaccctgtctgtntcaccgaaggggaanacgcccaccctctcctgcgagggccagtcagagtgtagganactaacttagctaggtaccagacaataaaccgtggaccaggcctaccacggcctcctacatcgtatggtcaccactaccgaccgacgggcctacgtggtaacctccaacggcctaacggttcaaggtcggacgtaaggtgggtacgtacgggactacgtacggttacacgttcctacaccgtactacgagctacgccctggactagttcgtagtaaagtttcttttagggattttaagtctaggtacaggtacctaagttaactaactaacggtcgtaccttctacgtacgttacgggacggagggtaaccgaaggtcggaataacgtacgaaacgtacgtgtacggactagcaacgtatccg

SEQ ID NO: 123237 - DNA, 613 bp, Homo sapiens
  misc_feature: GYAE6OF01D9SDW.4.8.A08.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
tcagagcactgtagcacgaccggtgctcgatttagcatactctacgaacacacaaagggggaggaactgctcagttaggacccagacggaaccatggaagccccagcgcagcttctcttcctcctgctactctggctcccagataccactggagaaatgtgatgacgcagtctccagccacctgtctgtgtcctccaggggaaancgcccaccctntcctgcagggccagtcagagtgttaggancaacttagcctaggtaccagcaataaacctggccaggcctccaggtcctcctcattcgtatcggtgcctactcccaaccgagggccctaacgttggtaactcccgagccctagttcagtcggcaggtcgggtctagggacactgttccacttcacactatcgacgcacgtcctgacctagtcctagtaagtttgtttagggtactttattaccgttagtacgaagtacgtaagttaacgttaaacgttacgttacggtcccttacgtacgttaaccgtttcggggaacgggtacgggaaacccgtaggggtcgaagacgttaccgaaaacggtcgtagggtcgtaccgtgaccctaacgtacgttccg

SEQ ID NO: 123238 - DNA, 664 bp, Homo sapiens
  misc_feature: GYAE6OF01BCU79.4.8.A08.1.454.CMB.1.raw
  modified_base (209)..(209): a, c, t, g, unknown or other
  misc_feature (209)..(209): n is a, c, g, or t
  modified_base (539)..(539): a, c, t, g, unknown or other
  misc_feature (539)..(539): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgcccaccctctcctgcgacgggccagtccagagtggttaggagctaacgttgccgtggtaccagctaacgtaaccgtggaccaggcctccccgaggtcctcctcatcgtagtcggtgcacgtcccacgacgggtcctacgtcggtactcccgagtccctacgttcgaggtcggacgtagggttcggggtcgtacggggaacctacgttacgttccaaccgttcctaccgaacctaactcgaacgtacctacggtcccctaggacctaggttcgtagtaaagttgttttagggtaatttttactacgttcggtacagtacgtaagttaanaaacgttaccgtcgtcccgttactaccgttacggttcgggaccggtacggaaccggttaagggtacgggtaatagtaaccggaaaacgtcgttgggtacgtactaaggcctaaccgtgttacccg

SEQ ID NO: 123239 - DNA, 696 bp, Homo sapiens
  misc_feature: GYAE6OF01BG1VJ.4.8.A08.1.454.CMB.1.raw
  modified_base (253)..(253): a, c, t, g, unknown or other
  misc_feature (253)..(253): n is a, c, g, or t
  modified_base (656)..(656): a, c, t, g, unknown or other
  misc_feature (656)..(656): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggcctcccagataccactggaagaaatgtgatgacgcagtctccagcccaccctgtctgtcgtctccgaggggaaagcgcccacctctccgtgcgacgggccagtcgagagtgttagganactaacgttgcctaggtaccagacaacgtaaccgtggaccgacgcctccgaggtcctcctcacttctagtcggtcacctactacccgaccgacggccctacgttacggtacctcccgacgtacccgtacggttcgacggtcggacgtacgggttcgggtaccgtacggggtaacctaccggttacgttaccaccttacctaccaaccgtatccgacgtccgacgtcccgtagaccgtagtcgtaagggtaatttagttttacggtaagttttacttacgtgtactagtacgttaagttaacgttaaacgttccgtacgttcccttacggttaccgtaccgggtttacgggacgggtaacggtaaccggtagggtacggtaagtaacgttaaccgaaacggttntcgggtacgtacctaggtaccctaaacggttcgttacccg

SEQ ID NO: 123240 - DNA, 698 bp, Homo sapiens
  misc_feature: GYAE6OF01CLYTZ.4.8.A08.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggctcccagataccactggaagaaatagtgatgacgcagtctccagcccacctgtctgtacgtcctaccgaaggggaaacncgtcccaccctctcctgcgaggccagtcagagtgtaggnctaacttgccgtggtaccagactaacgtaaaccgtcggaccaggcctaccccgaggtcccttaccgtctacgttcgtaagtcggtcgacctacgtacccgaaccgacgggccctacggtcggtaacctcccgtacgcccgtacgttcgaggttcgacgtaggtcgggtctacggggaaccacgtaggttccaacctcgtaacacctactacgacggtccacgtcccgtagtaccgtacggttcgtaacggtaaaggtttacgtttttagggtaactttttaacgtttaccgtagttacgaagttacaaggtttaactaaacgtacgttacgtcctacgtacgtaccgtttacgggacgggaacggtaacgtaagggtcgggtaataaacggtaccgtaaaacggtacgtacgggtacgtaccgtgtaacccgaccgttgttaccg

SEQ ID NO: 123241 - DNA, 833 bp, Homo sapiens
  misc_feature: GYAE6OF01D2A9X.4.8.A08.1.454.CMB.1.raw
  modified_base (222)..(222): a, c, t, g, unknown or other
  misc_feature (222)..(222): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggcctcccagactaccacgtggaagaaatagtgatgacgcagtcctccacgcccaccgtgtcctgtcgtccgtaccggaaggggaaacnccgaccctacccttcctccgtcgacgacgggccaggtacgaggtagttaggttaggacaccgtaacgttacgccgttacggtaccacgtacctaaacgttaaacccgtcggacccacggccctccccgaggtccctaccgtcgacttccgtagtcggtcgacctaccgtaccccgaaccggacgggtacccttacgtaccgggttaaccctccccgaaccgtccccgtaacggtttaccgacgggttcggaccgttagggttcggggttaccgaacggggtaccctaacgttcggttaccgaaccttccgttaaccaaccgttacgtaccgacgtaccgtacccggtaccgttcgaaccgttaacgggttacgtttaagggtaaacgtttttacggttttacggggtttaagtttttaacctttacggtcgtaaccgttaacgtaacgtttaaacgttaaccgtttaacgttaaccggttccgtacccttacggttaccgttaacgggttccggggaacggggtacccgtaaacggttaggggtaccgtacgttaaaccgacggtaaaccggtagttcggtacgtaccgtcacccgtaacgttcgttccgg

SEQ ID NO: 123242 - DNA, 776 bp, Homo sapiens
  misc_feature: GYAE6OF01BUNZO.4.8.A08.1.454.CMB.1.raw
  modified_base (156)..(156): a, c, t, g, unknown or other
  misc_feature (156)..(156): n is a, c, g, or t
  modified_base (217)..(217): a, c, t, g, unknown or other
  misc_feature (217)..(217): n is a, c, g, or t
  modified_base (351)..(351): a, c, t, g, unknown or other
  misc_feature (351)..(351): n is a, c, g, or t
tcagagcactgtagcacgaccggtgctcgatttagcatactctacaacacacgaaagggggaggaactgctcagttacggacccagacggaaccatggaacgccccagcgcagcttctcttcctctgctactcgtggctccagactaccatggaanaaatgtgatgacgcagtcctccagccctaccgtgtctcggtgtccgtaccgaaggggaaancgcccaaccgttctccgtaggcgacgggtccaagtcgaggtacgtggttaaggacactaaacgtttgccgtacggtaccaagtacctaacttaaaccgtcggaaccacggtcctaccccgaggtccctaccgtnaacgttctacggtcggtacaccacgtaccccgaacggtccgggtacctacggtcgtaccctacccgtacgtacccgtaacggttcgaacgggttcggacgtacgggttcggggttacgacggggaactaacccggttgttacccctaactccccggtaacctacccgtacgttaccgaacggccgtaccggtcctacgtacggttaacgtaccggtaaggttaaaggttttcggttttagttaaaccgttttactaaccggtttgaaaccgtaacggttacttaaacggttaacttaaacgtcggttcccttacgttaacttacggtaccccgggttagggacgggtaaaccggtaccgtaggggtaacgagttaaccaaaggtaacgttccggtagggtctaccgtacgctacctggttacccg

SEQ ID NO: 123243 - DNA, 920 bp, Homo sapiens
  misc_feature: GYAE6OF01CNLCR.4.8.A08.1.454.CMB.1.raw
  modified_base (228)..(228): a, c, t, g, unknown or other
  misc_feature (228)..(228): n is a, c, g, or t
tcagagcactgtagcacgaccggtgctcgatttagcatactctacaacacacgaaagggggagaactgctcagttaggacccagacggaaccatggaagccccagcgcagcttctcttcctcctgctactctggcctcccagactaccactggaagtaaatgtgatggacgcagtcctccgacgcccacccgtgttccgtggtcgtaccgtaccggaagggggaaacnccgcccctaaccccttcctcccgtgggaccgaacgggggaccctaaggtaccgtaagggtaggttacgggttaaacgggacttaaccgtaaacggtttacggacccgttagggtaacccaaggtacctaaaccgttaaaacccgtcggggacccgtaacgggccccttacccggagggtccccttaccctaccgtaacgttccgttaacggttcgggtaccgtaccctaacccgttaccccggaacccggaacccggggacccttaacggttacgggtaaccctaccccggtacggtaccccggttaacggtttccgagggtcgggtaacggtcggggttcggggtacgtacggggaccttaaacgttcggtttacccaccgtacgtaccgaacctacgtaccgacgtacgtaaccgtcccgttacggacccgttaggtaccgtttaacgggtaaaggttttacgggttttttaacggaagttttttaaccgttaccggtttaggttaacgtacggttaacgttaaacggtttaaacttaaccgttaccggttccggttaccttaccgttaccggttaacggggtttcccgggaacggggttaaaccgaccgggttaaagggtcgggaaccgtaaacggtacggaaaaccggttcggttacgtacgggactagtaaccctcgtcgtttaacg

SEQ ID NO: 123244 - DNA, 718 bp, Homo sapiens
  misc_feature: GYAE6OF01CXFDB.4.8.A08.1.454.CMB.1.raw
  modified_base (215)..(215): a, c, t, g, unknown or other
  misc_feature (215)..(215): n is a, c, g, or t
  modified_base (713)..(713): a, c, t, g, unknown or other
  misc_feature (713)..(713): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggcctcccagactacccacgtggaagaaatagtgatgacgcagtctccagcccacctgtctgtcgtctccgaaggggaaacncgcccaccctctcctgcgacgggccagtacgaggtaggttggttagggacacctaaacgtttacggccttagggtaaccagtacaaactaaacccgtcggaccaacggtcctaccccgaggtcccttaccctactacttcctaggttcggtacacctacctaccccgaaccggacggggtacccctacggttaccggtaaccctccccggaacgtcccgttacggttcgaagggttcggacgtagggttcgggtcgtacgggactacgtacgttccacttcctaccaaccgtatccgacgtaccacgtccgtcgacgttagtacgttaaggtaaggtttcgttttagggtactttttaacgtcgttacgtactacgttaactaagttaactttaacgtaccgttcgtaccttcttaccgttacggttaccggggacggtaacggtacgagggtcgaacgtaacgtaaccggaacgtagtcggacgtcacgactccgtnttccg

SEQ ID NO: 123245 - DNA, 706 bp, Homo sapiens
  misc_feature: GYAE6OF01C2L5V.4.8.A08.1.454.CMB.1.raw
  modified_base (175)..(175): a, c, t, g, unknown or other
  misc_feature (175)..(175): n is a, c, g, or t
  modified_base (182)..(182): a, c, t, g, unknown or other
  misc_feature (182)..(182): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (336)..(336): a, c, t, g, unknown or other
  misc_feature (336)..(336): n is a, c, g, or t
  modified_base (471)..(471): a, c, t, g, unknown or other
  misc_feature (471)..(471): n is a, c, g, or t
tcagagcactgtagcacgaccggtgctcgatttagcatactctacaacacacgaaagggggaggactgctcagttaggacccagacggaaccatggaacgccccagcgcagcttcctcttcctcctgctactctggcctcccagatacccacgtggaagtaaatagtgatgacgnacgtccnccagcccaccgtgtctgtcgtcaccgaaggggaancgccaccctctccngcaggccagtcaggtagtgtaggancaacttagccgtaggtaacccagtacaacgttaaaccgtcggtcgacggcctacccgacggtcctaccgtacatcgtagnggtacgacctacgtacccgaccgacgggaccctaacggttcggtaaccctcccgtacgcccgttaacgttccgaggtacggccgtagggtcgggtcgtagggacctacgtacggtccacctacctagaacccgtntaccgaggtccaccgtccttacgactaacgtcgtaggtacgtttagttttagggtattttaacgttcgagttacgacgtagtaaagttaattaaccgtacgtacgtccttacgttccgtaacggtttccgggacgggtaaccgggacgtaaaggggttaccgaaaggttaaccgtaaaccgggttaaacgacggtttacgggacggttaccctgaaccccgtgttacgttacccg

SEQ ID NO: 123246 - DNA, 941 bp, Homo sapiens
  misc_feature: GYAE6OF01C8C8F.4.8.A08.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
tcagagcactgtagcacgaccggtgctcgatttagcatactctacaacacacgaaagggggaggaactgctcagttaggacccagacggaaccatggaacgccccagcgcagcttctcttcctctgctactctcggctcccagactacccagtaggaagaaatagtgagtcgacgcacgtccnccagccctaccttggtctgtntccgtaccggaaggggtaacaccgtcccctacccttctcccgtggaccgacggggtacctaacggtccgtaaggtacgggtttaggttaaacggggacctaacccgtaaaacgtttaccggtacccggttacggtaacccgaacggtaacctaaaaccgttaaccccgtcgggaccccgaacggtccccgtaccgacggtcccttaccctacgtaacttccgttaagttcggtactacccgtaaccgtaccccgaaccgtaccggggtacctaaccggttacgtacccgtaccccgtaccggtaccgttaaccggtttcgtaacgggttcggacgttacggggttcgggtaccgtacgggtaaccgtaccgtaacgtttccctacccgttacctaccgtaaccgtcgtaccgaaccgtctaacccggtcgtaccgtaacggttacgttacggtaacgttaacggttttagtttaacggttaacgttttaccgtttaacgttacggttacctaacggtaactttaacggtaaacctttaaaacgttccgggttacccgttacccttaaccggtttaccggttaacccgggttaccggggtaccggggtaaaaccggttaacccggggtaaacgggttacgggtaaaccgtaaacggttaaacccggtaaacgggttaaccgtttcgggtaaaccgggtacccgtaccggttaaccgtcccggttaaacgtttcccggg

SEQ ID NO: 123247 - DNA, 723 bp, Homo sapiens
  misc_feature: GYAE6OF01DOSHF.4.8.A08.1.454.CMB.1.raw
  modified_base (154)..(154): a, c, t, g, unknown or other
  misc_feature (154)..(154): n is a, c, g, or t
  modified_base (213)..(213): a, c, t, g, unknown or other
  misc_feature (213)..(213): n is a, c, g, or t
  modified_base (361)..(361): a, c, t, g, unknown or other
  misc_feature (361)..(361): n is a, c, g, or t
tcagagcactgtagcacgaccggtgctcgatttagcatactctacgaacacacaaagggggaggaactgctcagttaggacccagacggaaccatggaaaccccagcgcagcttctcttcctcctgctactctggctcccagataccactgganaaatgtgatgacgcagtcctccagccctacctgtctagtcgtcgtaccgaaggggaaanaccgccctaccctctccgtaggccagggccagtcgaggtagttggttaggacgtactaaaccgttcgaccgttacggtaaccacgactaaccgtaaaccgtcggaccaggtcccaccgaggtcctccgtatactcgtacgtcggtacnccggtactacccgaaccgtacgggtacccacgttacggtacctacccgagtacccgttacgttcgaggtcgacggtacgggtcggtcctagggacctcgttaacgtccaacgttccaacgactacgtcacgcgacgtcgtacgtacgtacgtagtacggttagttagttttacggtatttacgttcgtagtacgtaacgtacgttaacgttaacttaaacgtcggtaccgtcgtttaccttaccggtaccgggttacgggtaccggtaagggaaacccggtagggtaaccggagttaaccggtaaacggaacgttaacggttcggtacgtaccgtacgacgttaccctaagtttccgtaacg

SEQ ID NO: 123248 - DNA, 744 bp, Homo sapiens
  misc_feature: GYAE6OF01D1IPK.4.8.A08.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
  modified_base (629)..(629): a, c, t, g, unknown or other
  misc_feature (629)..(629): n is a, c, g, or t
  modified_base (697)..(697): a, c, t, g, unknown or other
  misc_feature (697)..(697): n is a, c, g, or t
  modified_base (734)..(734): a, c, t, g, unknown or other
  misc_feature (734)..(734): n is a, c, g, or t
  modified_base (739)..(739): a, c, t, g, unknown or other
  misc_feature (739)..(739): n is a, c, g, or t
tcagagcactgtagcacgaccggtgctcgatttagcatactctacaacacacgaaaggggggaggaactgctcagttaggacccaggacggaaccatggaacgccccagcgcagtctttcttccttcctcctgctactctcggcctacccagactaaccacgtagggaagaaataggtagataggacgcgtacgtccnccacgcccaccgttgtcttcggtcgtccgtaccggaaagggggaaacnccgcccctaacccttctccgtcgacggacggccaagtcgaggtacgttggtaaggacgtactaacttacggccgtacggtaccagaacctaacgtaacccgcggaccgacggtccctacccgacggtaccttcccgtactaccttcgtaagtcggtacaccgtaccgtacccgaacggtaccggacctaccggttcgtaccctaccgaccggtaccctacggttacggacggtcggacgggttacgggttcgggtaccggtacggaacccgttacgtaccgtttccaacccttcccgaacgtaacctcgtacgaaggtccaccgtcgtacgtactcgttaacgtaggtttaactttacgggttttattaacgttttacgtacncggttaacacgtataaacgttatacgtaccgtctccttcacggttaggtacccggaaggacgggtaangggtacacgaactaacggacgtgtgacgcgaactccncgttnttaac

SEQ ID NO: 123249 - DNA, 927 bp, Homo sapiens
  misc_feature: GYAE6OF01CDTNO.4.8.A08.1.454.CMB.1.raw
  modified_base (289)..(289): a, c, t, g, unknown or other
  misc_feature (289)..(289): n is a, c, g, or t
tcagagcactgtagcacgaccggtgctcgatttagcatactctacaacacaacgaaagggggaggaactgctcagttaggacccagacggaaccagtggaacgccccagcgcagtcttctccttccgtctgctactcgtcggcctcccagactacccgacgtagggaagtaaaagttcggtaggactcggaccgtctaacggttccacccgtacggccctaccgttcggttcgtcgttccgtaccgtaccggaaaggggtaaacgccgtacccctacccttcgttccgnggaccgacggggcctaagttccgaagggttacggtggttaacggcgtaactaacgttacgacgttacggtaacacggtaacctaaccgttaaaccgcggaccgtaaccggtccccgtaacccgtcggtaccctttcctacgtacgttacgttacggttcggaaccaaccgtacgtacccccgagggtaaccggggtccccttaacggttacgggaccccttaccggaaacccgtccggttaacgttaccgggtaggggttaccggaccgggtttacgggttccgggggtaacctaacgggggtacttacccggtacccgtttaccttaccgtcccgtaactaccgacggtaactcggtacgaccccgttacgtacgacgtaacgttacgggttaagttacggtttaaccgttttaggttacgttttacttaacggttcgtaacgttaagtcgtttaaacgttaaacgtttacgtaccgggttacctaccgtttacgttcccggttacgggttaaccgggaacgggtacccgggttaaaggtaaccggggacttaaaccggaacggttaaaaccgaccggttaaacggttcgggtacttaaccgggtacccgtaactttaaccggcgttttaccccggg

SEQ ID NO: 123250 - DNA, 799 bp, Homo sapiens
  misc_feature: GYAE6OF01BKE3Z.4.8.A08.1.454.CMB.1.raw
  modified_base (221)..(221): a, c, t, g, unknown or other
  misc_feature (221)..(221): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (782)..(782): a, c, t, g, unknown or other
  misc_feature (782)..(782): n is a, c, g, or t
tcagagcactgtagcacgaccggtgctcgatttagcatactctacaacacacgaaagggggaggaactgctcagttaggacccagacggaaccatggaacgccccagcgcagtcttctcttcctcctgctactctcggcctcccagactaccacgtggaagaaatgtgatgaccgcagtctccagcccacctggtctgtcgtcctaccgaagggggaaacnccgccctacccttctccgtgaccgacgggccagtacgaggtggtgtaggacactaacgttcgccgtgggtaaccagtacctaacgttaaccgnggacccacggccctaccccggaggtcccttacccttntacttcgtagttgggtacnccaccgtaccccgaaccgggaccgggtacccctacgttaccgggtacctacccccgtaaggaccccgttaacggttaccgaagggggtccgaacggtacggggttcggggtcggtaacggggaaccctacgttacgttcccaccgttccctaccgaaccgtactaccgaaccgtacgtaccggtcccgtacgtaccgtagttaccgtagggtttaaacgtttaggttttaacgggtttacttttaacgttacgtacggttacgtacttacgtaaacgttaacgtaacttaccggttacggtccttccgttaccggttaacggggttccgggaacgggtaaacggggaacccgtaaggggtacgaacggttaacgtaaacgtaaaccgggtctacggggttcctaccggtaanacccttcgtacttccgg

SEQ ID NO: 123251 - DNA, 793 bp, Homo sapiens
  misc_feature: GYAE6OF01AH12M.4.8.A08.1.454.CMB.1.raw
  modified_base (157)..(157): a, c, t, g, unknown or other
  misc_feature (157)..(157): n is a, c, g, or t
  modified_base (221)..(221): a, c, t, g, unknown or other
  misc_feature (221)..(221): n is a, c, g, or t
  modified_base (537)..(537): a, c, t, g, unknown or other
  misc_feature (537)..(537): n is a, c, g, or t
tcagagcactgtagcacgaccggtgctcgatttagcatactctacaacacacgaaagggggagaactgctcagttaggacccagacggaaccatggaagccccagcgcagcttctcttcctcctgctactctggctcccagtactaccacgtggaanaaactgtagatcgacgctagtcctccacgcccacctgtctagtcgtccgtacggaacggggaancgaccctacctctccgtgcgacgggcctacgcgaggtaggttggttaaggacgtaccgttaaacgttcgtaccgtacggtaaccacgtactaacgtaaccggtgaccgacggtccctccgacgtcctaccgtactactcgttaagtcggtacaccgtaacctacccgaaccggtacgggtacctaccggtacgtacccgtacccaacgtacccgtaacgtttccggaacggttcggacgtaaacgggtttcgggtacgtaacgggaccctagtcgttacaccttacgaccctacgactcgtaggacctcgttacgngtaaccgtacggttaacgtagggtttaaaccgtttaggtttcggtttaaaccgtttacttaccggtcgtaacgttaacgtaagtaaaccgttaacgttaaaaccgtttccgtacgttaaccccggttataacccggttaccgggtacccgggagggttaaaacccggtaggaaccgggttaggaaaccgaacggttaaccggtaaaccggttggacggttaccgtacgtaaccgtccgttaaacttcggtaacccg

SEQ ID NO: 123252 - DNA, 897 bp, Homo sapiens
  misc_feature: GYAE6OF01CY23F.4.8.A08.1.454.CMB.1.raw
  modified_base (251)..(251): a, c, t, g, unknown or other
  misc_feature (251)..(251): n is a, c, g, or t
  modified_base (756)..(756): a, c, t, g, unknown or other
  misc_feature (756)..(756): n is a, c, g, or t
  modified_base (841)..(841): a, c, t, g, unknown or other
  misc_feature (841)..(841): n is a, c, g, or t
tcagagcactgtagcacgaccggtgctcgatttagcatactctacaacacaacgaaagggggaggaactgctcagttaggacccagacggaaccatggaacgccccagcgcagcttctcttcctcctgctactctcggcctcccagactaccacgtaggaagaaatggtagatcgacgcagtctccaggcccacccgtgtctgtcgttacctacgggaaggggaaacgccgtcccctaccctccgtcccgnggaccgacgggtacccacggtacgaggtaaggttggttaacgggacgtaccgtaaacgtttacggaccccgttagggtaacccgaacgtaaccgtaaacccgtaaaacccggttccgggaccccgtaaccgggtacccccgttaccccgggaacccgggtcccctttacccccgttaccgttaaccttacccgtttaaaggttcccgggtaccggtaacccttaacccgtaccccggtaaaccccggggaccgggtaaccccgttaaccgggttaccggggttaaccctccccggtaaaccggttacccccgtttaacgggtaccgttaacggggggttacggtccgggtttaagggggttccggggttacggtaaccgggggacctaacgttacggtttacccaacgttcccttaccgaaccgttacgttaccgacggtaccgacccgtaccgttacgacgtaacgtcgtaaggtacgtttaggtttagttacgttattacgtntacgtagtacgtaattaataaccgttagcgttaccttcgtaccgttacggttacgggcgggtaccgacggtacggaacggggtanaacgtaaaccgaacgggtagtccggtaggtaccgacgtactaccgtcgtttaccgg

SEQ ID NO: 123253 - DNA, 678 bp, Homo sapiens
  misc_feature: GYAE6OF01DDKUR.4.8.A08.1.454.CMB.1.raw
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (352)..(352): a, c, t, g, unknown or other
  misc_feature (352)..(352): n is a, c, g, or t
tcagagcactgtagcacgaccggtgctcgatttagcatactctacaacacacgaaagggggaggaactgctcagttaggacccagacggaaccatggaacgccccagcgcagcttctcttcctcctgctactctggctcccagactaccactggaagaaataggtgatgacgcagtcctaccagccacctgtctgtcgtctcgaggggaaancncccaccctctccngacgacggccagtcaggtagttgtaggacnctaacgttacgccgtaggtaccagtacaacgttaaccgtggacccgtaggcctaccccgaggtccctaccgtcattccgtagtcggtcacgtacncccgaaccgacgggtacctacgttacggtactcccgacgacctacgttccgtagggtcggacgtagggttcgggtctaccgggacacgtacgttccacgttcctaccacctacgtcacggtactaccggctcgtacgtacgtacgttaggtaagttttagttttagggttacttttacgttacgttacgtacgtacgtaacgtaattaacgttaacgttacgtcgttacccttaccttaccgttaccggttaccggacgggaccgggtacgaaggtaggagtacaaacgaaacgtcggttcgtggacttcgacctacgtgttaccg

SEQ ID NO: 123254 - DNA, 781 bp, Homo sapiens
  misc_feature: GYAE6OF02IQMQW.4.8.A08.1.454.CMB.1.raw
  modified_base (291)..(291): a, c, t, g, unknown or other
  misc_feature (291)..(291): n is a, c, g, or t
  modified_base (533)..(533): a, c, t, g, unknown or other
  misc_feature (533)..(533): n is a, c, g, or t
tcagagcactgtagcacgaccggtgctcgatttagcatactctacaacgacacaaagggggaggaacgtgcctcacgtttagggacccttagacgggaaccttatggtaaggccccagcgcgagcttactcttcctcctagcctacctctgggcttcccgagtataccactgggacgttaaattagttggattagttaaacggctagtacttccgagcctaccctgtcttggttgtacttccgagggggaaagcgtccaccctctcccgtgggtccagggccagtccacgngttgtaggagcctaacttggccttggtaccctaggaccaacttaaacctggcccaggtcctacccgaggtccttcccgccagttcctagtggggtggcctagtccaccggacggcctagttggttactccgagtccgtagttcacggtcgactaggtggtcagggactacgtaggttcccacgtcctacaccgtactacgaacgcctacgtccctaggacctaggttccgttagtaacgttnttttacgggtaagtttttaattaccgtactacgaacggtcgaaacggtttaacgtaaacgttaacggtaccggtaccccttttacgtttacccgttaaaccggttttcggggaccgggtaaccggggtaaacccgtaaaccgggttcggttaaaccggtaacggtttaaaccgggaaaaccggtttaacggtttacggggttacgggttaccgttaaccgggacccttacccgggtagtttacccggg

SEQ ID NO: 123255 - DNA, 699 bp, Homo sapiens
  misc_feature: GYAE6OF02IZAGL.4.8.A08.1.454.CMB.1.raw
  modified_base (206)..(206): a, c, t, g, unknown or other
  misc_feature (206)..(206): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccacctctcctgcaggccagtcagagtgtaggagcaacgttgcctaggtaaccagcaataaaccgtggacccaagggcctaccccgagggtccctacccgtaccaattccttaagtcgggttcgacctaacttccccgaaccgacggggacccctaacgttcgggtaactccccgaaggtcccctaacgtttcaacggttggcctagggttcgggtacctggggaacctaccgtacggtttccaaccgtttcctaccgaacccacttcgaacgtccgaacgtccctgaccgtaggttccgtaggtaaacggttagttttttacgggaagttttttaactttaccgtggttaccgtaagtactaaggttaataaacgttaacgtcggtacccttcgtaccgtaacgttttcgggacggtacggtacgtaagggttcggagtaacgtaaccgaaacgtacgtcggtacggccttacggacctaccgtagtaccg

SEQ ID NO: 123256 - DNA, 532 bp, Homo sapiens
  misc_feature: GYAE6OF02GIXUP.4.8.A08.1.454.CMB.1.raw
  modified_base (207)..(207): a, c, t, g, unknown or other
  misc_feature (207)..(207): n is a, c, g, or t
  modified_base (461)..(461): a, c, t, g, unknown or other
  misc_feature (461)..(461): n is a, c, g, or t
tcagagcactgtagcacgaccggtgctcgatttagcatactctacaacgacacaaagggggaggaactgctcagttaggacccagacggaaccatggaagccccagcgcagcttctcttcctcctgctactctggctcccagataccacgtggagaaatagtgatgacgcagtctccagccaccctgtctgtgtctccaggggaaangccacccctctcctgcagggccagtcagagtgttaggagcaacttagcctggtaccagcataaacctggcccaggctcccgaggcctccgtcatcctaatggtgactatcccaaccgaggggcccacgttcggtactccccgagccctagttcaggtggcaggtggtcgtgggacactagtcactctcacatcagcagcctgcagtcagaagtgttttggatttatactgtcagctagtataagtactgtcctntcgtacgttcggcggaggaccgtaagggtcggagactacgaacgtactggtacggcctgacctacattccg

SEQ ID NO: 123257 - DNA, 730 bp, Homo sapiens
  misc_feature: GYAE6OF02F2NI6.4.8.A08.1.454.CMB.1.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
tcagagcactgtagcacgaccggtgctcgatttagcatactctacaacacacgaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcaggccagtcagagtgttaggagcaacttagcctggtaccagcaataaacctggccaggcctcccaggtcctccctcactctagtggtncatcccaccgagggccacgtgggtactcccgagccctacgttacaggtcggactaggttcgggtctaggggaccacgtacggttaccaccttcctacccgaaccctacgttaccgagacccgtacgccccgttaggaccctaggttaccgtacggttaaaaggtttacggtttttacgggttaaagtttttaaccgttaccgttggtttaccgtaacgggtactaaaggtttaacttaaacgttaaaccggttcgggttacccctttacgttaccgttaacccggttttaccgggggaccgggttaacggggtaacccgtaagggggttacgggtaaggtaaccgttaaaccggaaaaccggttaaccggttggttaaccggggtcccgtacgggtacccttaaccgtacgtttacccgg

SEQ ID NO: 123258 - DNA, 722 bp, Homo sapiens
  misc_feature: GYAE6OF02IWNRP.4.8.A08.1.454.CMB.1.raw
  modified_base (209)..(209): a, c, t, g, unknown or other
  misc_feature (209)..(209): n is a, c, g, or t
tcagagcactgtagcacgaccggtgctcgatttagcatactctacaacgacacaaagggggaggaactgctcagttaggacccagacggaaccatggaagcccagcgcagcttctcttcctcctgctactctggctcccagataccactggagaaatagtgatgacgcagtctccagcccaccctgtctgtcgtctccgaaggggaaanagccaccctctcctgcgagggccagtcagagtgtaggagcaacttgcctaggtaccaggaccaacgtaaacctcgggaccgaggcctaccccgacggtcctcccgtacacttcttagtgggttcgacctactaccccgaaccgtacggggcccacgttcggtaacctccccgaaggtacccctacggtttaccgaggttcgggcgttaacgggttcgggggttaccgtacgggggaactaccgtacggtttaccacctttccaccgaccctagtacccgacgaccgtacgccgtcgacgtacgttaccgtaggtaacggtttagttttacgggttaagttttatacgttgtacgtagacttaagttaactaacgttacctagttccctacgttacttaccggttcgggacgggtacggtaacccgggtagggttaccggaaggtaacctaaccggtaaaacgtaacggttagggtaccggtaccgttacggacccgttaccgtagtttacccg

SEQ ID NO: 123259 - DNA, 655 bp, Homo sapiens
  misc_feature: GYAE6OF02H5LON.4.8.A08.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
tcagagcactgtagcacgaccggtgctcgatttagcatactctacaacacgacaaagggggagaactgctcaggttaggacccagacggaaccatggaagccccagcgcagcttctcttcctcctgctactcgtggcctcccagactaccactgggtaagaaaattggtgaatggaaccgtcgaacgttctccaggccctacccctggttcctggtcgttcctaccggaaagggggaaacgcgccctaacccctctccgtcggacggacgggcctaagtcaggtacgtggtaggcactaacgttgccgtggtaaccngcaactaccgtggaccacggcctaccgaggtcctcccgtanacgtttctagtggtcactacgtacccgagaccgggcttacgtcggtacncccgagtcccgtagttcgaggtgacctagggtttcggactcgggaactaacgttcgttaccncgtttcactacgactcgtacncgcgtcganacgtacgtgtaggtacgttacgtttagtacgtttatacgtgactatacgtaattacgtaactcgtcgaccttcgtacgtacgttcgacggtacgacgtaggtcgagttaactaacgtaacgagtcgtacggtacgtacgactaccgtagttcccgg

SEQ ID NO: 123260 - DNA, 656 bp, Homo sapiens
  misc_feature: GYAE6OF02GNA50.4.8.A08.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagagcactgtagcacgaccggtgctcgatttagcatactctacgaacacacaaagggggaggaactgctcagttaggacccagacggaaccatggaagccccagcgcagcttctcttcctcctgctactctggctcccagactaccactggagaaatgtgatgacgcagtcctccagccctacctgtctgtgtcctccgaaggggaaancgcccaccctctcctgcaggccagtcgagtgtgtaggancaatagcctgtaccagcactaaacctgacccaggcctcccgaggtcctccgtcatctagtggtgcactcccacgacgggcctacgtggtactcccacgcctacgttcaggttcgacgtacggtgggttccgtaggggaaccacgtacgttacgaccttctccaccacgtaccagtaccaccggtcctacgactaggtaccgtaggtaacgttagttttacggtaagttttacttacgtacggtacctacggacgttaagttaactaaacgttaactcgggttacccttcgttaccgttacggttacccggggacgggtaaccgggacggtaacggggtagaaacggtacgtaaccgtaaaccggtacgttcggtacggtccgtacgtacccgtacctcggttaccc

SEQ ID NO: 123261 - DNA, 523 bp, Homo sapiens
  misc_feature: GYAE6OF01CGB1G.42.52.E08.1.454.CMB.1.raw
tcagtgacgtatgtcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccaggcaaagcccccaaaatcatgatttatgatgtcagtaatcggccctgtagggtttctaatcgcttctctggctaccaagtctgggcaacgaccggcctaccctgacccatctctcgggctccgaggctggacggacgaggctgatttattactgcagctcaatataacaagcagacacgccccgtgtggtacgttcggacggacggtacagctcgacccgtcgtacggtcacgcccaaggcctcccgg

SEQ ID NO: 123262 - DNA, 606 bp, Homo sapiens
  misc_feature: GYAE6OF01CEOEF.42.52.E08.1.454.CMB.1.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagtgacgtatgtcacgaccggtgctcgatttagtcgagctctcagagaggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctggtaccaacagcaccaggcaaacgcccccaaatcatgatttangatgtacagtaacgtccggtccctcgtagggtttctaacgtccgtctttcgtcgtcggtcctaccgaagttcgtacgggaccaaaccgaccggtcccttcccgtacgaccctacgttcctcgtcggggtccttccgacggtccgtaggaacggacggacggtcgtagtaatttacttactgctagtctacatactacaacgcagccgacgtccccgtggtacgtacgttcgggacgggacggaccgaaggtccgtacggtaccgttcgtacggtaccaccggacccgacggtccgtaccccgg

SEQ ID NO: 123263 - DNA, 547 bp, Homo sapiens
  misc_feature: GYAE6OF01BBRGY.42.52.E08.1.454.CMB.1.raw
  modified_base (370)..(370): a, c, t, g, unknown or other
  misc_feature (370)..(370): n is a, c, g, or t
tcagtgacgtatgtcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggccaaacgcccccaaactcatgatttatgatgtcagtaatcggccctcgtaggggtttctaatcgcttctctggctccaagtctggcaacncggccctcctgaccatctctcgggcctccgagctggacggacggaggctagtattattactgcagctcaatatacagcagcacgccccgtgtcggttcgtcgggacggacggaccgaaggccgtcggacccggttacccgtacgggtcacccggaccccaagggtcccgtccccggg

SEQ ID NO: 123264 - DNA, 547 bp, Homo sapiens
  misc_feature: GYAE6OF01ENTQG.42.52.E08.1.454.CMB.1.raw
  modified_base (345)..(345): a, c, t, g, unknown or other
  misc_feature (345)..(345): n is a, c, g, or t
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaccagcagtgacgttggtgttatactatgtctcctgtacaacagcaccagcaaacgccccaaaactcatgtatttatgatgtacagtaatcgtcctacgtagggtttctaatcgtcttctntcggctcaagtctgacaacgacgcctcctacaccactctcgtcggctcgacggtcgtgaggacgagcgttagtacttattactcgactagtctacaattatacgaagcacgactacgccccggtgtacggtacgttcgggacggtacgggaccgacgcgtcgtaccgtacgtacggtacacggacccgagtccgtaccccgg

SEQ ID NO: 123265 - DNA, 701 bp, Homo sapiens
  misc_feature: GYAE6OF01D7TPL.42.52.E08.1.454.CMB.1.raw
  modified_base (273)..(273): a, c, t, g, unknown or other
  misc_feature (273)..(273): n is a, c, g, or t
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacgagggtcctgggcccagtctgccctgactcagcctgcctccgtgtctgggtctctggacagtcgatcaccatctcctgcactaggaaccagcaggtgtacggttggtgttataactatgtctctgtaccaanacgccaccgagaccaaaccgaccccaaactcatacgtatttatgtatgtacagttaacgtccggtacccttaggttacgggtttacctaacgtcgtacctttccgttcgtcggtaccttccgaaacggttcgtacggtaaccaacccgtaccggtccccttacccgtacgtaccctaacgttccgttccggtcgggtccttacccggaacggtccgtacgggaacgggaaccggacggtacgttaggttaacttttaacttacgtacgtaccgtacgtcttaacgtaacgttaacaacgtaacgacacgtacccggaccgttccccgggttaggtacgggttaccggtccgggtaccggacgggaaccaggtccgtaccggtaccgtaccgttacggaccaccggacccgtacggtcccgtaccccgg

SEQ ID NO: 123266 - DNA, 562 bp, Homo sapiens
  misc_feature: GYAE6OF01CS76Z.42.52.E08.1.454.CMB.1.raw
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatccaccatcctcctgcactggaaccagcagtgacgttggtgttataactatgtctctggtaccaacagcaccaggcaaacgccccaaactcatgatttangatgtcagtaatcggccctcgtaggggtttctaatcgtcttctctcggtctactagtctgcaacnccggtcctccctgaccactcctcgtcgggcctccgacggtcgtaggagggaacggngggtcttagtatttaacttactcgcagtctacaattaactaacagcacgccgaccgtcccggtgtaggtacgttcgggacgggacggaccaggcctcggtaccgtccgtaaggtccacggcccaggccctccccgg

SEQ ID NO: 123267 - DNA, 607 bp, Homo sapiens
  misc_feature: GYAE6OF01AXLNE.42.52.E08.1.454.CMB.1.raw
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtgttataactatgtctcctggtaccaacagcaccaggccaaacgcccccaaactcatcgtatttatgatgtcagtaatccggccctgtagggtttactaatcgcttctctggctccaagtctggacaacgaccggccctcccgtagaccctatctcgtcggtcctccaggctaggaggacgaggactgtaatttacttacgtgcagtctactaagtactaacgaacgtacacgccgaccggtcccccgttgggttacggttacgttcccggggacgggtacgggtaaacccgacggtccgttacggtaacccgttacccggtaacggttaccgaaccggaccccgaacggtcccgtacccccggg

SEQ ID NO: 123268 - DNA, 689 bp, Homo sapiens
  misc_feature: GYAE6OF01C1NDW.42.52.E08.1.454.CMB.1.raw
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccaggacaaacgccccaaactcatgtatttatgatgtcaagtaactccggccctcgtacggggtttactaactcgtcttctcgtcggtcctacgtaacgtcgtacgggacctaaacgacccggtcccgttaccctacgtaccctaacttccgttcgtccgggtcctaccgaaggtccgttaggaacgggacggacgggtacgttacgtaatttaacgtttacgtagaccgtaagttctactaaagttaactaacaaacggtcctaacggacccgtacccgtccccggttagggttccgggttaacggttcccggggacggggaaaccggggtaaccaacgggtcccgtaccgggtaccccgttacggttaccgggtacccaccgggaaccccgaaccgggtcccgtacccccggg

SEQ ID NO: 123269 - DNA, 591 bp, Homo sapiens
  misc_feature: GYAE6OF01EGJJ5.42.52.E08.1.454.CMB.1.raw
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttgtgttatactatgtctctgtaaccaacngcaccgagcaaaacgccccaaatcatgtatttangtatgtacaagttaatccggtccctgtagggttttacaatccgtcttcgtctggcctacgaagttcncggtacaaccgacggtccctacccgttgaccctatccgtccgtcgggcctccgaggtctaggaggtacgaggtcttagtatttactacgtgcacgtctacgtaatactaacgaagctacgacccaccggtccccggttggtacggttacgttaccgggacggaacgggaccgtaagcgtacggtacccgtacgtacgcaaccgaccgaacgtccgtacccgg

SEQ ID NO: 123270 - DNA, 577 bp, Homo sapiens
  misc_feature: GYAE6OF01C0GWP.42.52.E08.1.454.CMB.1.raw
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
  modified_base (449)..(449): a, c, t, g, unknown or other
  misc_feature (449)..(449): n is a, c, g, or t
  modified_base (471)..(471): a, c, t, g, unknown or other
  misc_feature (471)..(471): n is a, c, g, or t
tcagtgacgtatgtcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccagcagtgacgttggtagtataactatgtctcctagtaccanacgcaccagcaaacgccccaatcactgatttagnatgtacagtaatccgcctagtagggttctaatcgtcttactctggtctaccaagtcgtacgccgaaacctaccggccttacccgtagaccaactccgtcgtgggtacctcccgaggtcgtaggaggacggagtcgtatattattacgngtacagctacgtaatacgtaanaacgcacgacctccgtccccgtggttcgtagtccgggagggtaccggacgacgtcgtcggtaccgttacgtacggtaccgaccgaacccgtacggccgtaccccgg

SEQ ID NO: 123271 - DNA, 559 bp, Homo sapiens
  misc_feature: GYAE6OF01BDODC.42.52.E08.1.454.CMB.1.raw
  modified_base (267)..(267): a, c, t, g, unknown or other
  misc_feature (267)..(267): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
tcagtgacgtatgtcacgaccggtgctcgatttagtcgagctctcagagagaaaggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaaccagcagtgacgttggtgttatactatgtctcctgtaccaanagcaccagcaaacgccccaatcatgtatttatgattcgtacagtaactcggtccctgtacgggttctaagtcgtcttctctcgtctccgaagtcngacacacgcctcctcgacnctctcgtcggccncgagctaggacggacggagtctagtatttactacgtgacacgtctacgtatactagaacgtacacgaccaccggtcccgtggtcggtacgttcgggacggacggaccgacgtcgtaccggtaccgttaccgtacggtacccgagacccgagtcccgtacccccgg

SEQ ID NO: 123272 - DNA, 758 bp, Homo sapiens
  misc_feature: GYAE6OF01BNZ27.42.52.E08.1.454.CMB.1.raw
  modified_base (250)..(250): a, c, t, g, unknown or other
  misc_feature (250)..(250): n is a, c, g, or t
  modified_base (744)..(744): a, c, t, g, unknown or other
  misc_feature (744)..(744): n is a, c, g, or t
tcagtgacgtatgtcacgaccggtgctcgatttagtcgagctctcagagaggaaagggggggggtctcagggaggcagcgctctcgggacgtctccaccatggcctgggctctgctattcctcaccctctcactcgagggcacgtagggtcctgggccagttctcgccctgactcagcctcgcctcgtgtcgttgggtctccgtgacagtcgactaccaccattcctaccgtcacctacgacggaaaccncggcgtaaggtaggtaccgggtttagggtagtttaaacttaacgttagttcgttacccttccgttaacggtaaccaaccgaccgacccgaaacccggtaacggaaacccctaaaaccccgacccccctaaaagtcgtaacgttagttactttagtagtacgttgtaaccgtagtactccggtccgttagtacgggtttacacgtcttcgttactacgtcgtactcgtaacgttcgacgaaccgaccgtccgtcctaccgtactacctcgtccgtcggtccgaccgttcggacgtcggaacggacggtacgagttcttaaacggtactttacgtacgtccggaactcgtaacttacggtaactaaccgaagtactaccgacggtaccccgttacgcccgggtttgggttaaggcccgggtacgggaccgggaacgtacccggtagtacccgtccgggttaccccaagggttccctaccggaccctaaccggggtntccccccggttcgg

SEQ ID NO: 123273 - DNA, 788 bp, Homo sapiens
  misc_feature: GYAE6OF01ERXLM.42.52.E08.1.454.CMB.1.raw
  modified_base (246)..(246): a, c, t, g, unknown or other
  misc_feature (246)..(246): n is a, c, g, or t
tcagtgacgtatgtcacgaccggtgctcgatttagtcgagctctcagagaggaaaggggggggtctcaggaggcagcgctctcgggacgtcctccaccatggcctgggctctgctattcctcaccctcctcactcgagggcacgaggtcctgggcccagtctgccctagactcagcctgcctccgtgtccgtggtcctcgtaggacaggtcgactccaccatcctccgtgaccacgtacggaaccngactaggttcgtacggttttaggtacgttaataacgttagttcgtccgttaccgtacggtaacccaaacacgaccccgaacccgaacggaaccaaaacccggtaccccccaaaacgtaccgtaagttacggttaactttagttagtaatacgttacgtaaacgtttaacccgtcccggtacccttaggtacgggttttacaacttcgtactttcgtcgtacggtcctacgtacgttccaggtaccaaacccgtccggtccctaccgtacgaacgtactccgtcgtacggtcctaccgagtacgtagacggtacggagtacgtgtaacttagtactcgtacgcctacgttactaacttacgaaacgtacggacctacgggacccgtaccccggtaccggtttaacgggttccgttaaccgggttaccgggaaccccgggtaacggggttaacccggaacggttcccgggtacccggttaacccgttaccggttaaaccgtaccggaacccgtaaccccgggtaccgtccccggttacccccgg

SEQ ID NO: 123274 - DNA, 714 bp, Homo sapiens
  misc_feature: GYAE6OF01EW1D0.42.52.E08.1.454.CMB.1.raw
  modified_base (513)..(513): a, c, t, g, unknown or other
  misc_feature (513)..(513): n is a, c, g, or t
  modified_base (528)..(528): a, c, t, g, unknown or other
  misc_feature (528)..(528): n is a, c, g, or t
tcagtgacgtatgtcacgaccggtgctcgatttagtcgagctctcagagaggaaaggggggggtctcaggaggcagcgctctcgggacgtctccaccatggcctgggctctgctattcctcaccctcctcactcagggcacgagggtcctgggcccagtctcgccctgactcgacgtcctgcctccgtgtcgtcgggtcctcgtggacacgtcgactccaccatcctcgtgcacgtacggaaccagcgagtcggtacggttggtagttaactactatcgtccgtccgtacgtaccaacgtacgaccctaccgaacgaccaaaccgtaccccaatcgtaacttgttattagtagtacgtgttacaacgttacgtccggtaccgttaggtacgggtttctacgttccgtacgttcgtcgtacgacctacgtacggtacgtcgacctaacgtccgtcctaccgtcgacctacgtccgtcgtcgtactcggacgtacgtggacgtacggacgtacgngttacttagtaccgngtacgtactcacgttaactaacgtacgacgacgtaccgtccgtacccgtacccgggttgttaccgggttaaccggacgggtaaccgggtccgggtaaacggtacggttccgggtaaccccgtaccggttaccgggtacggtacccgaaccccggtaccggttacccggtaccccggtacccccggg

SEQ ID NO: 123275 - DNA, 683 bp, Homo sapiens
  misc_feature: GYAE6OF01AQ611.42.52.E08.1.454.CMB.1.raw
  modified_base (551)..(551): a, c, t, g, unknown or other
  misc_feature (551)..(551): n is a, c, g, or t
tcagtgacgtatgtcacgaccggtgctcgatttagtcgagctctcagagaggaaaggggggggtctcaggaggcagcgctcgtcgggacgtctccaccatggcctgggctctgctattcctcaccctcctcactcgagggcacagggtcctgggcccagtctcgccctgactcagcctcgcctccgtgtcgtgggttcctccgtggactaggtcgactccaacctattccttcctgccacgtacggaaccagcaggttggtacggtttggttaggtttaactaacgttagttcgttccttccgttacggtaacccaactacgacccaacccgacggaccaaaccgacccccctaaaactcagtacgtaatttagtgtagtcgtaacgtaagtaccgtccggtccgttacggttacggtttactaacgttctcttcctcgtcgtcctacgtacgtcgtcggaccaccggtcccgtcctaccgtcgtaacctcgttcgtcggtccggtcctcgacggcgtacgaacgggcgacgtcgtactattactaccgtnacgtacgctaacgatacgaatacgcgacgaccgccgtaccggtgttacggtacgtaccgggacgggacgtaccggacggtacccgtcggacccgttacggccgtaccgaccgaccgtacgtcccgtaccccg

SEQ ID NO: 123276 - DNA, 519 bp, Homo sapiens
  misc_feature: GYAE6OF02HB5Q1.42.52.E08.1.454.CMB.1.raw
tcagtgacgtatgtcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcagtaatcggcctcaggggtttctaatcgcttctctggctcaagtctggcaacacggcctccctgaccatctctgggctccaggctgaggacgaggctgattattactgcagctcatatacaagcacgcacgcccccgtgtcggtacttcgggccggagggaccaaggcgtcggacccgttccgtaggtccacgaccccgaggctcccgg

SEQ ID NO: 123277 - DNA, 610 bp, Homo sapiens
  misc_feature: GYAE6OF02GW28B.42.52.E08.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
tcagtgacgtatgtcacgaccggtgctcgatttagtcgagctctcagaggagaaagggggggtctcaggaggcagcgctctcgggacgtctccaccatggcctgggctctcgctattcctcaccctctcactcagggcacagggtcctgggcccagtctgccctgactcagcctgcctcgtgtctgggtctcctggacagtcgatcaccatctcctgcactggaaccngcagtgacgttggngttataactatgtctctggtaccaanacgcacccaggcaaacgccccaaatcatgatttangatgtcagtaatcggcctcgagggtttctaatcgtcttcnctggcctccaagtctggactaacaccggtcctccgtgacctatctacgtcggacctcgaggctggacggacgaggcttagtattacttacgtcgtacacgtactacgaattacgtaacgaagaccaacgtaccacggtaccccggttggtaccggttacgttaccggggacgggaccgggtaaccgtaaccgggtccttaccggtaacccggttcggttaaccgggtcccgaaccggtacccggtaacgggtcccgttacccccggg

SEQ ID NO: 123278 - DNA, 512 bp, Homo sapiens
  misc_feature: GYAE6OF02IX67G.42.52.E08.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (412)..(412): a, c, t, g, unknown or other
  misc_feature (412)..(412): n is a, c, g, or t
tcagtgacgtatgtcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgcactggaaccngcagtgacgttggtggttataactatgtctcctggtaccaacagcaccaggcaaagccccaaatcatgatttatnatgtcagtaatcggcctctaggggtttctaatcgtcttctctgctcaagtctggcacacggcctccctgaccatctctggctcagctgagcgagctgattatactgacngctcatatacagcagcacgccccgtgtcgtacgttcggcggtacggaccgtaagcgtacgtaccgtccgtacggtcgaccggcccgacggtcgtacccgg

SEQ ID NO: 123279 - DNA, 518 bp, Homo sapiens
  misc_feature: GYAE6OF02FN2NB.42.52.E08.1.454.CMB.1.raw
  modified_base (305)..(305): a, c, t, g, unknown or other
  misc_feature (305)..(305): n is a, c, g, or t
tcagtgacgtatgtcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatccatgatttangatgtcagtaatcggcctcaggggtttcaatcgcttctctggctccagtctggcaacacggcctccctgacccatctctggctccaggctgaggacgaggctgattattactgcagctacatatacaagcagcacgccccgtgtcgtattccgggcggaacgggaccaaggcctgacccgttcctagggtccacggtcccaaggcctacccgg

SEQ ID NO: 123280 - DNA, 595 bp, Homo sapiens
  misc_feature: GYAE6OF02HUOO7.42.52.E08.1.454.CMB.1.raw
tcagtgacgtatgtcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttataactatgtctcctggtaccaacagccaacccgaggaccaaaacgcccccaaaactcaatcgatttatgatgtacagtaatcggcctcgagggtttcaatcgcttctctggctccaagtctggacaacgcggccctcctgaccactcctctgggtcctccgacggtccgtaggtacggacggaggtccgttagtacttaagtttactgctacgtctactatataacgaacgacgagtccgaccggtaccccgttgtacggttacgttacgggaccgggaacgggaaccgaacggtccgtccggtaccgttccgtacggtaccgacggacccgtaacgggcctaccccgg

SEQ ID NO: 123281 - DNA, 536 bp, Homo sapiens
  misc_feature: GYAE6OF02JAYRT.42.52.E08.1.454.CMB.1.raw
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
  modified_base (435)..(435): a, c, t, g, unknown or other
  misc_feature (435)..(435): n is a, c, g, or t
tcagtgacgtatgtcacgaccggtgctcgatttagtcgagctctcagagggagaaagggggggtctcgaggaggcagcgcgtctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccngcagtgacgttggtgttataatatgtctctgtaccaacagcaccaggccaaagccccaaatcatgatttancgatgtacagtaactcggcctcgtagggtttcaatcgtcttctctggctcaagtctggcaacaccggcctcctgaccatcctactcgggctccgacggcgtgaggacgaggctgtatttattactgcagtctnaacttataacaagcacgcacgcccgtgtcggtacgttcggacggaacgggtaccagtccgtacgaccgtacgtacggtccacggcccgaggtcctacccgg

SEQ ID NO: 123282 - DNA, 540 bp, Homo sapiens
  misc_feature: GYAE6OF02GKOPA.42.52.E08.1.454.CMB.1.raw
tcagtgacgtatgtcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgccccaaactcatgatttatgatgtcagtaatcggcctctagggtttctaatcgcttctctggtctcaagtctgcaacgcgcctcctgaccatctcgtcggcctccgaggcctggacggacggaggcgtgtatttacttactgctagctctactataacagcagccaccgtccccgtagtcggtacgttcgggcgggtacgggaccaggacctacggtaccgtacgtacggtcaacgcccgtacgccgtccccgg

SEQ ID NO: 123283 - DNA, 560 bp, Homo sapiens
  misc_feature: GYAE6OF02HCF6V.42.52.E08.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (298)..(298): a, c, t, g, unknown or other
  misc_feature (298)..(298): n is a, c, g, or t
  modified_base (415)..(415): a, c, t, g, unknown or other
  misc_feature (415)..(415): n is a, c, g, or t
tcagtgacgtatgtcacgaccggtgctcgatttagtcgagctctcagagagaaagggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgacactggaaccngctagtcgacgtttggtggttaataactatgtctcctggtacaacagcaccaggcaaacgcccaaacncatcgattatgatgtctagtaatcgcctcgtagggttctaatcgcttctctgctcaagtctggctacacggtcctcctgaccatctcgcgggtcctccgaggctggacggtaacggnggtccttaggtatttactaaccgttgcctaagcttacattacaacaagcacgccacgtaccccgttgtacggttacgtcgggtcggaacgggccaagtccgtggtacccgtcgtacggtacaccggaccgtacgtcgtaccccgg

SEQ ID NO: 123284 - DNA, 704 bp, Homo sapiens
  misc_feature: GYAE6OF02HNE7I.42.52.E08.1.454.CMB.1.raw
  modified_base (186)..(186): a, c, t, g, unknown or other
  misc_feature (186)..(186): n is a, c, g, or t
  modified_base (498)..(498): a, c, t, g, unknown or other
  misc_feature (498)..(498): n is a, c, g, or t
  modified_base (538)..(538): a, c, t, g, unknown or other
  misc_feature (538)..(538): n is a, c, g, or t
tcagtgacgtatgtcacgaccggtgctcgatttagtcgagctctcagagagaaagggggggtcgtcgaggaggcagcgctctcgggacgtctccaccatggcctggctctgctattcctcaccctctccactcagggcacgaggtcctgggcccagtctcgaccctgactcagcctcgcctccgtntcgtgggtcctcgtaggacagtcgatccaccatctcctgctactggaaccagccagtcgtacgttggtaggttactaactagttcggtacctcgtcggtaaccaacacgccaacccgaggacaaaccggaccccaaactacatacggtaatttaactgtaactgttactacgttaaactccggtccctacggttacgggttttactaacgtcgtacttctacgtcggactacctagtcgttgaaccaacgcggtccctaccgtacgaccttactcctcggtcggtacctccgaagtccggagacggtaacgnggacctggtttaactacgttaaccgtagctacgccgttanaacttagtaaaccagttaaccacgttacccgaccgtacccggttacgggttagtaccccgggtttagggacccggggttaacgggtaacccctggtaccggtaccccggttaggtacccggttaacggacccggtaccgtacccggtaccgggtccccgtacccgg

SEQ ID NO: 123285 - DNA, 684 bp, Homo sapiens
  misc_feature: GYAE6OF02JCGIK.42.52.E08.1.454.CMB.1.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
tcagtgacgtatgtcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctgtaccaacacncaccagcaaacgccccaaatcatgtatttatgatgtacagtaactccggcctacgtagggtttactaagtcgtaccttcgttctcggtcctaccgtaacgttcgtcggaccaaccgtaccgggtccccttcccgtacgaccctacttacccgtcggttaccgggtcccttacccggacggtccgtacgggaacgggtaccgacgggtacttaggtaactttacgttaccttgacctacggtcttactattaacgtaacgtaacgacgaacgaccgtaacccggtccccgttaggtaccggttacgttaccggggacgggtaacggggtaacccgaacggtccggttaccggtaacccggttacccgtacgggttaccaaccgggtaccccgtaacgggtcccgtacccccggg

SEQ ID NO: 123286 - DNA, 637 bp, Homo sapiens
  misc_feature: GYAE6OF02HO54U.42.52.E08.1.454.CMB.1.raw
  modified_base (400)..(400): a, c, t, g, unknown or other
  misc_feature (400)..(400): n is a, c, g, or t
tcagtgacgtatgtcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgccactggaaccagcagtgacgttggtgtatactatgtctcctgtaccaacacgccaccgaggacaaaccgaccccaaactcatgtattagtatatgtactaagtagtccggtcccttagtacgggtttactagtccgtacttctcgtcgctctaacgtctagaccaacgccgtccctcccncgtaccacttccgtcgtcggacctaccgaggtccgtaggtacgggaacgtacggtgtagttaacttacgttaccgtcgtctacgttctacgtataactaacgacgacacgaccgtacccggcccgttgggtacggtacggttaccgggacgggtaaccggtaaccggagtacccggtaccgtacccggttaccgtacggtaccgtaaccggcccgtaaccggtcccttacccccggg

SEQ ID NO: 123287 - DNA, 733 bp, Homo sapiens
  misc_feature: GYAE6OF02FWQ61.42.52.E08.1.454.CMB.1.raw
  modified_base (230)..(230): a, c, t, g, unknown or other
  misc_feature (230)..(230): n is a, c, g, or t
tcagtgacgtatgtcacgaccggtgctcgatttagtcgagctctcagagagaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgttataactatgtctcctggtaccaacagccaccaggccaaacgcccccaaaatcatgtatttatgatgtcaagtaatccggccttgtagggtttctaacgtcgtcttctcgtggtcctaccgaagttcgtcgggacctaacgtaccgggccccttcccgtacgaaccctacttacttcggtcgggtcccgttccgtacggtccgtacgggaacgggtaccggagggtaccgtaggttaacttttacgtttaccgttcgtaccgtagtaccgttacctaattaactaacgtaaacggtacctaacggtcccaacccggttcccccgggttagggttaccgggttttacgggttcccgggggtaaccggggtaaccggggtaacccgtaaacgggtaccccgttacgggtacccccggtttacccggttaaccgggttaccccggtaaccgggtacccccggtaaaccgggtccccggttaccccccggg

SEQ ID NO: 123288 - DNA, 686 bp, Homo sapiens
  misc_feature: GYAE6OF02F8LG6.42.52.E08.1.454.CMB.1.raw
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
tcagtgacgtatgtcacgaccggtgctcgatttagtcgagctctcagagaggaaagggggggggtctcaggaggcagcgctctcgggacgtctccacatggcctgggctctgcttattcctcaccctcctcactcagggcacgagggtcctgggcccagtctcgccctgactcagcctgcctccgtgtcgtgggtctccgtggacagtcgatcaccatcctcctgcactacggaaccagcagtgtacggttggtgttatactatgtctctggtaccacngaccacaggacaacgacccaatcatgtattanagtatagtcgtaagtactccggtccttacggttacgggttactacgtcgttccttacgttcgtcgtcctacgtagttcncggacctaccgccggtcctccgcacctacgtcgtacgtcggcctacggtcggcgtacggacgggacgtagtcgttaagtacgttataccgtcgactacgtacctagttaacgtaccttaaacgacgtaccggacgacccggtaccggtttcccgggttagggttaaccggttaccggtacgggggtaccggggtaaaccggtaccggtaaccggtacccggttaccggtacccggttcggtaacccgggttaaccggacccggttacccggtacgggtacccccttacccccgggg

SEQ ID NO: 123289 - DNA, 672 bp, Homo sapiens
  misc_feature: GYAE6OF02G6RWV.42.52.E08.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (315)..(315): a, c, t, g, unknown or other
  misc_feature (315)..(315): n is a, c, g, or t
  modified_base (533)..(533): a, c, t, g, unknown or other
  misc_feature (533)..(533): n is a, c, g, or t
tcagtgacgtatgtcacgaccggtgctcgatttagtcgagctctcagaggagaaaggggggggtctcaggaggcagcgctctcgggacgtctccaccatggcctgggctctgctattcctcaccctcctcactcagggcacagggtcctgggcccagtctgccctgactcacgcctgcctccgtgtcgtgggtctctggacagtcgatcacctatctcctgccactcggaaccngcagtcgacgttggtgttatactntgtctctgtaacacganccaccaggacaaacgcccctaaatccagtgtacttgagtntgtacaacgtactccggtcctggtacgggtttactaacgtctcgttcctgtacggtcctaccgtaaggttccgtacggaacctaaaccgccggtaccctcccgttagacctacttccgtacgtcgggacctacggtacggtcgtcgggaacggaccggtaggtaccgttagtaactttaacttcgtcgtaccgtaagtccctaggtaacttaacgtanaccggtaacgtcgaaccgtaccgtcccggttagttacggttacgtccgggtaacgggccggtaacccggtagtaccggccggttaacccggtccgttaacggacccgtaaccgaccccggtacggtaccgtacccccgg

SEQ ID NO: 123290 - DNA, 672 bp, Homo sapiens
  misc_feature: GYAE6OF02HJW5J.42.52.E08.1.454.CMB.1.raw
  modified_base (315)..(315): a, c, t, g, unknown or other
  misc_feature (315)..(315): n is a, c, g, or t
tcagtgacgtatgtcacgaccggtgctcgatttagtcgagctctcagagagaaagggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatcctctgcactggaaccagcagtgtacgttggtaggttaataactatgtctcctggtaccaacagcacccgaggacaaccgacccccaaatcatgtatttangtatgtactaagtacgtccggtccctacggtagggtttactacgtcgtcttctcgtcggtcctacgaacgtctacggacctaaccgaccggtcccctcccgtacgtaaccctacttccgtaccggtcgggtaccctaccgcgggtccgtacgggaacgggacggtacggtacgttaggtttaactttaacgtttacgttcgtaccacggtcctacgtaacgttaacgtaacgaacgacgacgaccgaccggtcccggttaggtcgggttacggttccgggacgggaacgggaccgacggtaccgtacggtacccgttacggtccggtaccgaccgtaccggacgtcccgtaccccgg

SEQ ID NO: 123291 - DNA, 763 bp, Homo sapiens
  misc_feature: GYAE6OF02IJ5DT.42.52.E08.1.454.CMB.1.raw
  modified_base (276)..(276): a, c, t, g, unknown or other
  misc_feature (276)..(276): n is a, c, g, or t
  modified_base (596)..(596): a, c, t, g, unknown or other
  misc_feature (596)..(596): n is a, c, g, or t
tcagtgacgtatgtcacgaccggtgctcgatttagtcgagctctcagagaggaaaggggggggtctcagggaggcagcgctctcgggacgtctcccaccatggcctgggctctgctattcctccaccctcctcactcgagggcacgacgggtcctcgggcccagtctcgccctgactcagcctcgcctccgtgtctcgggtcctccgtggacagtcgatcaccatctcctgaccacgtcgaaccacgtcgagtgtacgttggtagttaactaactntcgtctcgtacgtaaccaacgacgaccaccgtaagaccaaaccgaacccctaaaactactacgttacgttaattaacgtagtacttagttacgaacgttaaccgtccgggtaccttaccggtacggggtttacctaacggtccgttccttctacgtccgtctacgtacgtcgtacgaccaaacgccggtacctccgtacgtacctacttaccgtcgtaccgtccgtaccgtaggtcgtaacggaacgggtacgacggtaccgtagtttaacttaagttccgttacgacgtaaacgttgaacttaaacgtaccgtaaacgnggtaaccacggtccgtaacccgttcccgggtaaggtaacggttaccggtacgggggaacgggtaacccggtaacccggtaaacggtaccccgtaaccgggtaccccgtttaccgtaacggtacccggtaacccggaacccgggttacccgtaccggtaccccccggg

SEQ ID NO: 123292 - DNA, 805 bp, Homo sapiens
  misc_feature: GYAE6OF02GC51O.42.52.E08.1.454.CMB.1.raw
tcagtgacgtatgtcacgaccggtgctcgatttagtcgagctctcagagagaaagggggggggtctcaggaggcagcgctctcgggacgtctccaccatggcctgggctctgctattcctcaccctcctcactcagggcacgagggtcctgggcccagtctgccctgactcagcctgcctccgtgtcgtggtctcctggacagtcgatcaccatcctcctgctacgtcggaaccagcagtgtacgttggtagttataactattcgtctctacggtaccaacgtcaccaccaggaccaaaccgacccccaaactcactagtaactttatgattacgctacgtaacgtccggtacctcggttaacggggtttctaacgtccgttcttacgttcgtcggtacctacccgtaacgtccgtacggtaacccgtaacccgacccggtccccgtaccccgttaccgaacccgttaacctcccgttcggtacgggtcccctaaccggtcggtaccggtacgggaacgggtaaccgggacgggttaaccgttaagttaaccgttttaaacgttacctacggtaaccggttaccgtaccgtttaccaaagtttacctaaaaccggaacgttaccgaaccgggacccgttaaccccgggttccccgggtttagggtttaaccgggttacggttacccggggacgggggttaaccgggaaacccctaaggggtcccgttaacccgggtacccgtttaacccgggtacggtacccgtaacccggtaaccccgggaccggtcccccgttaccccccggg

SEQ ID NO: 123293 - DNA, 805 bp, Homo sapiens
  misc_feature: GYAE6OF02HPA1A.42.52.E08.1.454.CMB.1.raw
  modified_base (589)..(589): a, c, t, g, unknown or other
  misc_feature (589)..(589): n is a, c, g, or t
tcagtgacgtatgtcacgaccggtgctcgatttagtcgagctctcagagaggaaaggggggggtctcaggaggcagcgctctcgggacgtctccaccatggcctgggctctgctattcctcaccctcctcactcgagggcacgacgggtcctagggcccagtctcgccctgactcagcctcgcctccgtgtcgtggtctccgtggacagtcgactcactactcctcctgccagtacggaacagcagtcgtacgttggtagttaataactagttcgttccttccgtacggtaaccaacgtacgaccctaacccggacggaaccaaaacccggaccccccaaaactccgtaacgttagttaacttttaggtagtacgttacgtacggtaacgttaaccggtcccggtacccttacggggttacggggtttaacctacggttacgtcctttcgtaccggttcgtaccttaccgttaaacgtcgtacgaccgaaccgtaccgtccctacccgtacgtacctacgtccgttccgtacgggtccaccggtacggtacgtacggtacggaacgcgtacgttagtacttacgttacncgtacgaccggtactacgtaacgtacgtaacgacgtaccgtacgacccggtacccgtacccggttacggtttaccggtacggtaccggggaacccgggtaacggggtaacctaacccgggttccggttaaccccggttaaccccggtttacgggaaccgggttaaccccggaaaccggtaccccggttacccggtaccccggttacccccccgggg

SEQ ID NO: 123294 - DNA, 843 bp, Homo sapiens
  misc_feature: GYAE6OF02JR25A.42.52.E08.1.454.CMB.1.raw
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (648)..(648): a, c, t, g, unknown or other
  misc_feature (648)..(648): n is a, c, g, or t
tcagtgacgtatgtcacgaccggtgctcgatttagtcgagctctcagagaggaaagggggggtctcaggaggcagcgctctcgggacgtctccaccatggccgtgggctctgctacttcctccaccctcctcactcgagggcacgtacgggtcctcgggccagtccgtcgaccctgacctcacgcctcgccctccggtgtcgtcggtcctccgtggacagtcgactccaccnctctaccgngtacctcggaccggacacgtacgtcgtacgttaggttaggttacgttaatacgttagtcgttcctaccgtaacgaactaacgacgcccaaccggtaccgaacctaacccgaacccgtaatcgattacgtattacggtactactacggtaagtaaccgttaccggccggttaccggttacgggttaaccgtttacctacgttccccgttacgtccgtttacgggtccttaccggtaaccggttacggttaacctaccggtaacccgttaaccccgtcccgggttaccccttagacccggttaaacctcccggttaccggtccggttaccgtaacccgtacggtacggtacgggtaccggaaccgggtacgggtaacgtacgttacgtttaacgttaccgggtttaccncggttacctaccgacgttaacgtaaaccgtagtaaacgaaccggacgtacccgaccggttcggttaacccggtggtttaaccggggtccgtaaccgggtaccgtaaccggacggttacggtaccgggttaaccggtaccgttaacccggttcgaccccggtaaccctaccgggacccggttcccgtaaccccggg

SEQ ID NO: 123295 - DNA, 783 bp, Homo sapiens
  misc_feature: GYAE6OF02JZJ0I.42.52.E08.1.454.CMB.1.raw
  modified_base (198)..(198): a, c, t, g, unknown or other
  misc_feature (198)..(198): n is a, c, g, or t
  modified_base (751)..(751): a, c, t, g, unknown or other
  misc_feature (751)..(751): n is a, c, g, or t
tcagtgacgtatgtcacgaccggtgctcgatttagtcgagctctcagagagaaagggggggtctcaggaggcagcgctctcgggacgtctccaccatggcctgggctctgctattcctcaccctctcactcgaggcacgaggtcctcggcccagtctgaccctgactcagccgtgcctcggtgtcgtacggtctccgnggacctgtcgactccgacctatccgtcctgctacgtaggaaacctcgacgtacggttacgtacggtttaggtaccggtttaaacttaaacgttcgttacgtacccgttaccgttacggttaaacccaacgtacgacccgtaacccgaaggtaccccgtaaaacccgtaccccccgtaaaatccgtaacgttacggttaacttaggtaccgtaaggttaccgaacgttacggtaacgttccccggtccgttaacgggtttaccgggttaacttaaccgtcgttacccgttacgttaccgtacgttaccgtactaaccgtcgtcgaaccgtaaaccgtccggacccttaccacgtaacctcgttaccgacgttcggacgtaccgacgggtaccgaggtaccggtacgtacgtcgttagtactacggttctacgtcgacgttactacgtaacttacgaacgtaacgcgtaacaccggtcccgtaccggtgttacgggtaccgttaccggacgggtaacgtaaccgtaggtcccgtacggtacccgttggttaaccnccgggttaactccgtaccggacgttcccccgg

SEQ ID NO: 123296 - DNA, 651 bp, Homo sapiens
  misc_feature: GYAE6OF02JW4ZG.42.52.E08.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
tcagtgacgtatgtcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctcgccctgactcagcctgcctcggtgtctgggtctcctggacagtcgatcaccntcnctgcnctaggaccngcagtgacgttggtagttaatactatgtctccgtcggtaccaacacgcccaccgacggacaaaacccgcccccaaaactccaatgtaatttactggtaacttgtactagtaacgtccggaccccttggtacgggttttactaacgtcgtcttacgtcgtcgccttactagtactggaccaaccgtaccggtcctcctacgaacctcgtctcgtcggtctacgacgtcgtacggaggacgtcgacgttntacgttactacgngtcagtccgtatatactaacgataccgacgtaccgaccggtcccggttaggtacggtcggttaccgggacgggtaaccggtaccgaacggtaccgttaccgtaacccggttaccgtaccggtaccgtaaccggacccgggtaccggtcccggttacccccgg

SEQ ID NO: 123297 - DNA, 486 bp, Homo sapiens
  misc_feature: GYAE6OF01B7FYW.22.73.G07.1.454.CMB.1.raw
  modified_base (194)..(194): a, c, t, g, unknown or other
  misc_feature (194)..(194): n is a, c, g, or t
  modified_base (480)..(480): a, c, t, g, unknown or other
  misc_feature (480)..(480): n is a, c, g, or t
tcagacatacgcgtcacgaccggtgctcgatttagctctacgctcagggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtatccccgcaggttcagtgtcagtgggtctgggacagagttcactctcaccatcagcagcctgcagtctgaagatttgctactttattactgtcagcaatataatgactggttctcgatcaccttcggccaagggcacgactggagattaacgactgtggctgacaccntctgtc

SEQ ID NO: 123298 - DNA, 498 bp, Homo sapiens
  misc_feature: GYAE6OF01EL531.22.73.G07.1.454.CMB.1.raw
  modified_base (389)..(389): a, c, t, g, unknown or other
  misc_feature (389)..(389): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgcaggttcagtgccagtgggtctgggacagagttcactctcaccatcagcagcctgcagtctgaagtntttgctactttattactgtcagacaattataatgacttggttctacgtatcaccgttcggaccaagggaccacgactggagtattaaacgactgtgctgcacatctgtc

SEQ ID NO: 123299 - DNA, 486 bp, Homo sapiens
  misc_feature: GYAE6OF01A7Q6A.22.73.G07.1.454.CMB.1.raw
  modified_base (196)..(196): a, c, t, g, unknown or other
  misc_feature (196)..(196): n is a, c, g, or t
  modified_base (480)..(480): a, c, t, g, unknown or other
  misc_feature (480)..(480): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagtctggtaccagcagagacctggccaggctcccaggctcctcatctatggtgcttctaccagggccatggtactccccgcaggttcagtgccagtgggtctgggacagagttcactctcaccatcagcagcctgcagtctgaagtatttgctactttatactgtcagctaatataatgactggttctcgatcaccttcgaccaaggacacgactggagtattaacgaatgtgctgcacntctgtc

SEQ ID NO: 123300 - DNA, 516 bp, Homo sapiens
  misc_feature: GYAE6OF01BLHSY.22.73.G07.1.454.CMB.1.raw
  modified_base (316)..(316): a, c, t, g, unknown or other
  misc_feature (316)..(316): n is a, c, g, or t
  modified_base (509)..(509): a, c, t, g, unknown or other
  misc_feature (509)..(509): n is a, c, g, or t
tcagacatacgcgtcacgaccggtgctcgatttagctctacgctcagggggaggaactgcctcacgttagggaccctagacggaacctatggtaagccccagcgcagcttctcttcctcctgctactctggctcccagataccactggagtaaatagtgatgtaacgcagtctccagccaccctgtctgtgtctccaggggaaagagccaccctctcctgcgacgggccagtcagagtgttagcaacacttagtctggtaccagtcagagacctggccaggctcccaggctcctcatctagtggtgcttcgtaccngggccactggtactccccgcaggttcagtgccgagtgggtctgggacagagttcactctcaccatcagcacgcctgcagtctagaatattttcgactactttatactgtacagcaatactaatgacttggttactcgatcctacttcggacctaagggcacgacgtggacgtattaacgactgtgctgcactntctgttc

SEQ ID NO: 123301 - DNA, 593 bp, Homo sapiens
  misc_feature: GYAE6OF01DQFW0.22.73.G07.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (465)..(465): a, c, t, g, unknown or other
  misc_feature (465)..(465): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagtctaggtaccagcagagacctggccaggcctcccgaggcctcctnatctatggtnccttcaccgaggcccagtggtacctccccgcaggttccaggtcgccgaggtggggtctggggactaggacgtttccactctcaacctatcagcacgcctgcctagtctaggaaacgttgttttcgacttaagttttatactgtacaggtctaagttattaagttcngggtccttcgggtaaccgtttcggaccgtaacgggaaccgtaagggttagggtaaagtaccgaaaacgtacgttgggtacgacgtcgacctaaccattcgtacgttacttctacgttccgttaccccg

SEQ ID NO: 123302 - DNA, 502 bp, Homo sapiens
  misc_feature: GYAE6OF01DIEY2.22.73.G07.1.454.CMB.1.raw
  modified_base (196)..(196): a, c, t, g, unknown or other
  misc_feature (196)..(196): n is a, c, g, or t
  modified_base (498)..(498): a, c, t, g, unknown or other
  misc_feature (498)..(498): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgcaggttcagtgccagtgggtctgggacagagttcactctcaccatcagcagcctgcagtctgaagtattttgctactttattactgtcagcaatataatgacttggttctcgtatcctaccgttcggaccgaagggacacgacgtggaagtaattaaacgaatgtgctgacacatntgtc

SEQ ID NO: 123303 - DNA, 549 bp, Homo sapiens
  misc_feature: GYAE6OF01C3PIT.22.73.G07.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagcaacaacttagtctggtaccagcagagacctggccaggctcccaggcctcctcatctatggtncttctaccagggccactggtactccccgcaggttcagtgcctagtgggtctgggacagagttcactctcacatcagcagcctgcagtctagaagtattttgactacttttattactgtctagtactaatataatgtacttggttctcgtatcctaccgttcggaccaagggtaccacgtacgtagggtaacgtaagttaaaccggacgttggtacgggacttacggacctaaccctattccgttcggtttacc

SEQ ID NO: 123304 - DNA, 533 bp, Homo sapiens
  misc_feature: GYAE6OF01C0ITE.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatggtgcttctaccaggggccactggtactcccccggcctaggttccagtcgccaggtgggtctgggacaggagttcactctcaccatcagcagccctgcagtctgaagtatttgctactttattactgtcagctaattataatgtacttggtttcctgtacttcctaccgttcggaccgtaacgggacacggacgtgggaacgtaattaaacggaactggtggactgaccacacttcgtgttacc

SEQ ID NO: 123305 - DNA, 555 bp, Homo sapiens
  misc_feature: GYAE6OF01DY4K3.22.73.G07.1.454.CMB.1.raw
  modified_base (313)..(313): a, c, t, g, unknown or other
  misc_feature (313)..(313): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctcgtgcgactccatcactagttactactggagctggctccggcagtcccgagggaggactggagtggattgggtatatctattacactgggancacgactacacgcccctctcatgagtcgagtcacctatttcactagacacgtaccaaagaacctacgttcctaccctagaaaccgtgaacggttctacggtacgaccgcgtcgcggaccgaccggcttactacttacgtgtcgtacgtagtagtttgtcttttggagttcggttacgccgtgttgactaggtcgggccgtaggaccctggcctacgtcctcacacgccctccgccgaaccgg

SEQ ID NO: 123306 - DNA, 490 bp, Homo sapiens
  misc_feature: GYAE6OF01BLK5T.22.73.G07.1.454.CMB.1.raw
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacactctcctgcagggccagtcagagtgttagcagcagcttagcctggtaccagcagaacctggccaggctcccaggctcctcatctatggtgcatctacgagggccactggtatcccagccaggttcagtggcaggtgggtctgggacagagttcactctcacatcagcagcctgcagtctgagtatttgctagtttattactgtcagcactataataactgccttcgtactagtttcggcgtagggaccagcgtggagtactacgaacgaactggtagntcgcnctac

SEQ ID NO: 123307 - DNA, 147 bp, Homo sapiens
  misc_feature: GYAE6OF01C2UU9.22.73.G07.1.454.CMB.1.raw
  modified_base (147)..(147): a, c, t, g, unknown or other
  misc_feature (147)..(147): n is a, c, g, or t
tcagacatacgcgtcacgaccggtgctcgatttagctctacgctcagggacacgactggagattaaacgaactgtggctgcaccatctgtcttcatcttcccgccatctgaacgcgtatgtatgagcgggctggcaaggcgcatagn

SEQ ID NO: 123308 - DNA, 505 bp, Homo sapiens
  misc_feature: GYAE6OF01EFOYB.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatggtgcttctaccagggccactggtactccccgcaggttcagtgccagtgggtctgggacaggagttcactctcaccatcagcagcctgcagtctgaagtattttgctactttattactgtcagctaatataatgacttggttctcgtattccaccgttcggccaagggaccacggactggagtaattaaacgactgtggctgacaccatcgtgtcc

SEQ ID NO: 123309 - DNA, 524 bp, Homo sapiens
  misc_feature: GYAE6OF01CJSCL.22.73.G07.1.454.CMB.1.raw
  modified_base (197)..(197): a, c, t, g, unknown or other
  misc_feature (197)..(197): n is a, c, g, or t
  modified_base (391)..(391): a, c, t, g, unknown or other
  misc_feature (391)..(391): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagtctggtaccagcagagacctggccaggctcccaggctcctcatctatggtgcttctaccagggccactggtactccccgcaggttcagtcgccagtgggtctgggacagagttcactctcaccatcagcagcctgcagtctgaagtntttgctactttatactgtcagctaatattaatgtacttggttctcgtatccaccgttcggaccaagggaccacggacgttaggaacgtaattaaaacggcttaggttcggacttggaccactatcgttgtacc

SEQ ID NO: 123310 - DNA, 505 bp, Homo sapiens
  misc_feature: GYAE6OF01EGW6L.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatggtgcttctaccagggccactggtactccccgcaggttcagtgccagtgggtctgggacaggagttcactctcacatcagcagcctgcagtctgaagtattttgctatttattactgtcagctaatataatgacttggttctacgtatcaccgttcggccaagggaccacggacgtggaagtagttaaacgactgtggctgacacctatctgttcc

SEQ ID NO: 123311 - DNA, 710 bp, Homo sapiens
  misc_feature: GYAE6OF01D29RD.22.73.G07.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
tcagacatacgcgtcacgaccggtgctcgatttagctctacgctcgaagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggccagtcagagtgtagcaactacttagtctggtaccagcagacgacctggccaggcctcccgaggcctcctcattctagtggtnccttcgaccgaggcctagtcggtacnccccgctaggttcagtcgccgtaggtcgggtctagggacaggtacgttccaacgttcctaccaaccattccgacgtcctacggtcccgttaggaccgtacgttccgtaaggtaaacgtttacgtttttacggaacctttaaccgttttaacgtttaccgttacggtttaaccgtaagtaaccttaaatttaacgtaacgtttcggtaaccgtttacggtttaccttaccggtaaccgttacccgtaacccgtttaccgggaaccgtaacggggtaaccctaaccggtaacgttacggggtaaacgttaaaccgtttaaaaccggtacgttacgggtacgacgttacggaccctaacccgttacgttccgtcgtttacccg

SEQ ID NO: 123312 - DNA, 550 bp, Homo sapiens
  misc_feature: GYAE6OF01ARB6C.22.73.G07.1.454.CMB.1.raw
  modified_base (196)..(196): a, c, t, g, unknown or other
  misc_feature (196)..(196): n is a, c, g, or t
  modified_base (396)..(396): a, c, t, g, unknown or other
  misc_feature (396)..(396): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccattcagagtgttagcaacaacttagtctggtaccagcagagacctggccaggcctcccaggcctcctcatctatggtgcttctaccagggccacgtggtactccccgctaggttcagtcgccaggtgggtctgggacagtagttcactctacaccatcagcagcctgcagtctagaagtntttgctactttatactgtcagactaatataatgtacttggttctacgtacttcctacccgttcggaccgtaagggacctaccgtacggtaggtaacgtaagttaaaacggtacgttgtacggtaccgtacggacccaacgtcttcgtcggttcc

SEQ ID NO: 123313 - DNA, 514 bp, Homo sapiens
  misc_feature: GYAE6OF01BHPHB.22.73.G07.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
  modified_base (390)..(390): a, c, t, g, unknown or other
  misc_feature (390)..(390): n is a, c, g, or t
  modified_base (504)..(504): a, c, t, g, unknown or other
  misc_feature (504)..(504): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagtctggtaccagcagagacctggccaggctcccaggctcctcatctatggtcgcttctaccagggccactggtactccccgctaggttcagtgccagtgggtctgggacngagttcactctcaccatcagcagcctgcagtctagaagtntttgactactttatactgtacagctaatataatgtactggttctcgtactctaccgttcggaccaagggccacgacgtaggataagttaaacgcttggtgactaggaccacctnttccgtgtcc

SEQ ID NO: 123314 - DNA, 552 bp, Homo sapiens
  misc_feature: GYAE6OF01DZ4UN.22.73.G07.1.454.CMB.1.raw
  modified_base (313)..(313): a, c, t, g, unknown or other
  misc_feature (313)..(313): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctgggcactccatcactagttactactggagctggctccggcagtcccagggaaggactggagtggattgggtatatctattacactgggancaccgactacacgcccctcctcatgagtcgagtcacctatttcactagacacgtaccaaagaaccagttctccctagaaactgaggtctgtcgaccgctgcggacaccggccgtctattactgtgcgtagtatttgtcgtttttggagttggttacgtccgtcgtttcggtacgttacgtcggggccgtagggacccgtggtccaccgtcctcctcacgccctcccgacccgtaacggg

SEQ ID NO: 123315 - DNA, 536 bp, Homo sapiens
  misc_feature: GYAE6OF01CXJLF.22.73.G07.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (406)..(406): a, c, t, g, unknown or other
  misc_feature (406)..(406): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaanagcccaccctctcctgcagggccagtcagagtgttagcaacacttagtctggtaccagcagagacctggccaggcctcccaggcctctcatctagtggtncttcaccgagggccactggtactccccgctaggttcagtcgcctaggtcgggtctggggacaggtacgtttcacttctacaccatccagcagcctgcagtcagtaagtntttgctatttatactgtcagctaatatatgacttggttctcgtactcgaccttcggactaagggacacgtagtaggaacgtaattaaacgaccgttggacgtctacgaccaaccgtcttcgtgttacccg

SEQ ID NO: 123316 - DNA, 534 bp, Homo sapiens
  misc_feature: GYAE6OF01AYZZ1.22.73.G07.1.454.CMB.1.raw
  modified_base (197)..(197): a, c, t, g, unknown or other
  misc_feature (197)..(197): n is a, c, g, or t
  modified_base (400)..(400): a, c, t, g, unknown or other
  misc_feature (400)..(400): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagtctggtaccagcagagacctggccaggctcccaggcctcctcatctagtggtgcttctaccgagggcccactggtactcccccgcaggttcaggtcgccaggtgggtctgggacaggtagttcactctcaccatcagcagcctgcagtctgaagtntttgctatttattactgtcagtcaatatatgtacttggttctcgattcctaccgttcggacctaagggaccacggtactgggaacgtagttaaacggacgtggtaggctacggacctaaccgtattcgtgttcc

SEQ ID NO: 123317 - DNA, 516 bp, Homo sapiens
  misc_feature: GYAE6OF01BAUP9.22.73.G07.1.454.CMB.1.raw
  modified_base (196)..(196): a, c, t, g, unknown or other
  misc_feature (196)..(196): n is a, c, g, or t
  modified_base (389)..(389): a, c, t, g, unknown or other
  misc_feature (389)..(389): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgcaggttcagtgccagtgggtctgggacagagttcactctcaccatcagcagcctgcagtctgaagtntttgctactttatactgtcagctaatataatgtacttggttctcgtatctaccgttcggaccgtaagggacacgacgtaggacgtaattaaacgacgttggtcggactcgacacctatcgtgttacc

SEQ ID NO: 123318 - DNA, 632 bp, Homo sapiens
  misc_feature: GYAE6OF01D8E73.22.73.G07.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (324)..(324): a, c, t, g, unknown or other
  misc_feature (324)..(324): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgtagcaacacttagtctggtaccagcagagacctggccaggctcccgaggctcctnatctagtggtncttcaccgagggccacttggactccccgntaggttcagtcgcctaggtcgggtctgggacaggtacgtttcgacttcgtccaaccgtatccgagccgagtccctggacctagttcctagtaaagtattttcgactacgttttaatacgttgtaccaggtctaaattacgtaaatcgtaacgttggttccttaccgtacttccgtaaccgtttcgggaacccgtaaacggggtacctaccgggtaacttacggggaacgttaaacggttaaaacccgtaacgtttcggtacgggtaccgttacggaccccgtaaaccgtacttccgttgtttaacccg

SEQ ID NO: 123319 - DNA, 584 bp, Homo sapiens
  misc_feature: GYAE6OF01DGD17.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtcgcttctaccgagggccacgtggtactcccccgcaggttcagtcgccgtagtcgggtctgggacagtacgttcactctcaccatcagcagcctgccagtctagaagtattttgcttactttattactgtcagtacaattattaatcgtaactttgggtttacctcgtaacttcccgtaaccgtttccgggaaccgaaaggggtacccaaaccgggtacgtagggaaacgttaaagttaaaaccggacttcgggtcggtactcgaccctaccttaacgtccgttgttacccg

SEQ ID NO: 123320 - DNA, 741 bp, Homo sapiens
  misc_feature: GYAE6OF01BC9WY.22.73.G07.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaactaacttagtctaggtaccaggcaagagtacctggccaggcctcccgaggcctaccctnacttcctagtggtacgcctttcgaccgaggggcccaacgttcgggtaacctcccccggacgtagggtttccaaggttcgcccgtaagggttcggggtcctaggggaacctagggtacgtttacccaacctttccgtaccaaccccgtaagttccgaaacggtccgaacggtccccgtttacggaccgttacgttacccgttaggtaaacggtttaacttttttacggtaacctttaaccttttttaacgtttaaccgttaggtttaccgtaacggtaaccttaaatttaacttaagtttacgtaaccgtttagggtttacccttacggtaacttcccgtaacccgtttaccggaacccgtaaacgggacctaaccggtaacgtagggtaacttaaacgttaaacgacgttacggtaggacctacgaccaacctacgttcgttcgttcc

SEQ ID NO: 123321 - DNA, 618 bp, Homo sapiens
  misc_feature: GYAE6OF01CRLRY.22.73.G07.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (307)..(307): a, c, t, g, unknown or other
  misc_feature (307)..(307): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctcncctgcagggccagtcagagtgttagcaaacgtaacttagtctggtaccaggcaaggacgacctggcccaggcctcccgaggcctcctcatcctatggtnctttcaccgaggccactggtactccccgcaggttcagtcgccgtaggtcgggtctggggacaggtacgttccacgttcctacgacctatccgagtcacgtcctggacctagtctagtaagtagttttcgacttactttattactgtacagtactaaattataatgtacgttggttctcgtattccgtaccgttacggacccgtaaagggtacctaaacgtacggtagggtaaacgttaaagtttaaaaccggtaacgttgggttacggtaccgttacgtaccctaacccgtaatttccgttcggtttaccc

SEQ ID NO: 123322 - DNA, 500 bp, Homo sapiens
  misc_feature: GYAE6OF01A70CQ.22.73.G07.1.454.CMB.1.raw
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagacatacgcgtcacgaccggtgctcgatttagctctacgctcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaaggccactggcatcccagccaggttcagtggcagtgggtctgggaanagacttcactctcacatcaaacagcctagancctgacgattctgcagtttattactgtcagcagcgtaccaagtggcctcgtactttggccaggggccaagctggagatcagacgaacgtgtggctgcgaccatctgtcttcatctccccg

SEQ ID NO: 123323 - DNA, 540 bp, Homo sapiens
  misc_feature: GYAE6OF01E3O6W.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtcccagggagggactggagtggattgggtatatctattacactgggagcaccgactacagcccctcctcatgagtcgagtcacctatttcactagacacgtccaaagaaccagttcctccctagaaactgaggtctgtcgaccgctcgcgacgaccggcgtcctattactgtcgcgagtatttgtctttttggagttcggttacgccgtcgtttgacgtacgtgggccgaggtaccgtggtctaccgtcgtcctcacgccctcgaccgaaccggg

SEQ ID NO: 123324 - DNA, 646 bp, Homo sapiens
  misc_feature: GYAE6OF01DD6QR.22.73.G07.1.454.CMB.1.raw
  modified_base (328)..(328): a, c, t, g, unknown or other
  misc_feature (328)..(328): n is a, c, g, or t
  modified_base (505)..(505): a, c, t, g, unknown or other
  misc_feature (505)..(505): n is a, c, g, or t
  modified_base (629)..(629): a, c, t, g, unknown or other
  misc_feature (629)..(629): n is a, c, g, or t
tcagacatacgcgtcacgaccggtgctcgatttagctctacgctcgagggtctccgaaggcttcaccagtcctggacctcctgtgcaagaacatcgaaacatctcgtggttcttccttctcctggtgcagctccagatggtcctgtccagctgcagctgcaggagtccgggcccaggactgggtcgaacgtcccttcggacgtacccctgtcccctcacctgctattgtctcgtcggcgacttccagtcacttagttaccatggagcgtggctccggcacgtcccgagggaaggactggagtgaagtttggtaatagtctagttaacncgtgggacgaccgaccgaacgtacaccgtccccttcctcgacttcgacgttcgaacgtcaaccgtactttaccaacgtacgaacaccgtacaaacgacctacgttcctacccagaaacgtgaacggtctgtacgaccgtactggccggaacgccggtccttacttaacgttacccgngttacgaccgtagttacgtttggtcgttttgggagttccggtacgtccgtcgtttacgcgttacggtccgggtacgacgggttaacccttgggtacccctaccgtccgtcctacgacgtccccnccgtacccgaacccggg

SEQ ID NO: 123325 - DNA, 528 bp, Homo sapiens
  misc_feature: GYAE6OF01D8NYE.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttagggcccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgttagcaacacttagtctggtaccagcagagacctggccaggctcccaggctcctcatctatggtgcttcaccagggccactggtactccccgctaggttcagtcgccaggtgggtctgggacaggtagttcactctcaccatcagcagcctgcagtctagaagtatttgcttactttattactgtcagactaatataatgtacgttggttctcgtacttcctaccgttcggaccgaagggacacgacgtaggaagtaattaaacgacgttggtgcgtcgaccacctattcgttgtacc

SEQ ID NO: 123326 - DNA, 571 bp, Homo sapiens
  misc_feature: GYAE6OF01CQF04.22.73.G07.1.454.CMB.1.raw
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccagggactggtgaagccttcggagaccctgtccctcacctgcattgtctctggcactccatcactagttactactggagctggctccggcagtcccagggaagggactggagtggattgggtatatctatacactgggancaccgatacagcccctccncatcgagtcagttcacctattcactagacacgtcaaagaccngttctccctagaactgagtctgtcgaccgntgcggacacggcgtctattactgtgcgagtagtttgcgtttttggagttggttacgccggttcgtttcgaccttacggtcgggtacccgtaggggaaccccgttgggtaccctacccggttccgttccccgttacgtacccgcccttcccgaacccgtaacccgggg

SEQ ID NO: 123327 - DNA, 584 bp, Homo sapiens
  misc_feature: GYAE6OF01BDP3U.22.73.G07.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaaacacttagtctggtaccagcagagacctggccaggcctcccgaggcctcctcattctagtggtncctttccaccgagggcctacgtggtactcccccggctaggttcaggtcnccgaggttcggggtctggggacaggtacgttcacgttctacacctatcagcagcctgctagtctagtaagtacttttgcttacttttattactgtacagtacaattataatgtacttggttacctcgtattccgtaaccgttcggaccgtaagggaccacggtaacgtagggaacttaacgttaaacgaacgttcgggtacggcttacggcctaaccgtattcccgttggttaccc

SEQ ID NO: 123328 - DNA, 513 bp, Homo sapiens
  misc_feature: GYAE6OF01D77OU.22.73.G07.1.454.CMB.1.raw
  modified_base (196)..(196): a, c, t, g, unknown or other
  misc_feature (196)..(196): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccacgtggtactccccgcaggttcagtgccagtgggtctgggacagtagttcactctcaccatcagcagcctgcagtctgaagtatttgctagtttattactgtcagctagtataattctggtcctcgggtacgttcggaccgaagggaccaagggtggagtacaaacgtaacgtgtggctgcaccatctntcttctntcgttcccg

SEQ ID NO: 123329 - DNA, 539 bp, Homo sapiens
  misc_feature: GYAE6OF01A0E00.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacacttagtctggtaccagcagagacctggccaggctcccaggcctcctcatctatggtgcttctaccagggccacgtggtactccccgctaggttcagtcgccagtgggtctgggacagtagttcactctcaccatcagcagcctgcagtctagaagtatttgctactttattactgtcagactaatataatgtacttggttctcgtatcctaccgttcggaccgtaagggaccacggtacgtacgggaagtaagttaaacggacttggtacggtactcggaccaccctattccgttgttacc

SEQ ID NO: 123330 - DNA, 540 bp, Homo sapiens
  misc_feature: GYAE6OF01D2R5Y.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggcctcccaggctcctcatctatggtgcttcaccagggccactggtactccccgcaggttcagtcgccgaggtgggtctgggacaggtagttcactctcacatcagcagcctgcagtctagagtatttgcttactttattactgtcagactaatatatgtacttggttctcgtattcctaccgttccggacccgtaaagggaccaccgggtaagtgggtaataaacgttaaaccggacttgggtacggctcggacccaccgtattcgtgttcc

SEQ ID NO: 123331 - DNA, 579 bp, Homo sapiens
  misc_feature: GYAE6OF01B1AXD.22.73.G07.1.454.CMB.1.raw
  modified_base (296)..(296): a, c, t, g, unknown or other
  misc_feature (296)..(296): n is a, c, g, or t
  modified_base (398)..(398): a, c, t, g, unknown or other
  misc_feature (398)..(398): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggcctcccaggcctcctcatctatggtncttcaccgagggccacgtggtactccccgcgaggttcagtcgcaggtgggtctgggacagtacgttcactctcaccatcagcacgcctgctagtctagaagntggtggtcttagttttatactgtacagtactaattatttactactttccctaccgttacgtaggtaccgtttcggaccgtaaacggggtacccaaaggggttaggaaaactacgaaaacggtaacgtgggtcgacgttacggaccctaaccgtattaccgttacgttcctttaccgtaccg

SEQ ID NO: 123332 - DNA, 615 bp, Homo sapiens
  misc_feature: GYAE6OF01D5WJV.22.73.G07.1.454.CMB.1.raw
  modified_base (321)..(321): a, c, t, g, unknown or other
  misc_feature (321)..(321): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagacccctgtcccctcacctgctattgtctctggcacctccatcaacttagttactactggagctggcctccggcacgtcccgaggggaaggctggagtggagttgggtatatctatacagtgggancaccgactacacgtcccctcctcagtgacgtcgagtccacctatttcacttacgactacgtaccaaagaaccctagttacctaccctagtaaacctggacggttctgtacgaccgcgtacggcggaccgccggaccgttctattactgtgacgtagtagtttgtcgtttttgggagttcggttacgtccgttcgtttacgtaccgttacggtcggggtaccgtacgggtaacccgttcggtacccgtacccgttccttacccgtcgaccgtccctcccgacccggtaacccggg

SEQ ID NO: 123333 - DNA, 771 bp, Homo sapiens
  misc_feature: GYAE6OF01B2J7V.22.73.G07.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaacncgcccaccctntcctgcagggccagtcagagtgtagcaactattagtctggtaccagcagagacctggccacggcctcccgaggtcctcctnacttctagtgggtctccttcgtaaccgagggccctaacgttcgggtacctcccccggcagggtttccaggttcgccgtaggtcgggtctgggactaggtactttccgacttccgtacacctatccgaagcacggccttaggaccgtaacggttccgttaggtaaacgtttagtttttacgacctttaacgttttacgtttaaccgttagttaccgtaacgttaattaaacgtttaacttaaacgtttcggtaaccgtttcggggttttaacctaccggttaacgtttacccgttaaccccgggtttaccgggaaaccccgttaaaggggggtaacccctaaaccggggttaaccggttaacggggtaaaaccgggtttaaaccgtttaaaaaccgggtaaacgtttcggggttaccgggttacccgttaccgggtaacccttaaacccgttaacgtttcccgttttaggtttaacccccg

SEQ ID NO: 123334 - DNA, 551 bp, Homo sapiens
  misc_feature: GYAE6OF01CFRZJ.22.73.G07.1.454.CMB.1.raw
tcagacatacgcgtcacgaccggtgctcgatttagctctacgctcagggtctccggaggcttcaccagtcctggacctcctgtgcaagaacatgaaacatctgtggttcttccttctcctggtggcagctcccagatgggtcctgtcccagctgcagctgcaggagtcgggcccaggactgggtgaagccttcggagacccctgtccctcacctgcattgtctctggccactccatcactagttactactggagctggctccggcagtcccagggaaggactggagtggattgggtatatctattacacgtgggagcaccgactacacgcccctcctcatgagtcgagtcacctatttcactacgacacgtaccaaacgaaccagttcctccctagaactgaggtctgtcgaccgctgcggtacacggccgtctattctgtgcgagtattgtcttttggagttggttacgcgtcgttgactacgtcggggtccgacgggtacccgtcggtccgtaccgttccttcctcacgtccctccgacccgaaccggg

SEQ ID NO: 123335 - DNA, 580 bp, Homo sapiens
  misc_feature: GYAE6OF01DQD6C.22.73.G07.1.454.CMB.1.raw
  modified_base (565)..(565): a, c, t, g, unknown or other
  misc_feature (565)..(565): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccagtcagagtgtagcaacaacttagtctggtaaccagcagagacctggccaggcctccaggctcctcatctatggtgcttctaccgagggcctacgtggtactccccgcaggttcagtcgccgtaggtcggggtctggggactaggtacgttcactctacaccatcagcacgcctagacgcctagaagttatttgacttagtttacttactgtcagtcagcgtagctaacctcccgtacgtaccgggttcgggacgggtaacgggaccgtaaggggtcggaacgtaacgtaccgaaacggtaacggtggtagggtctcggacctaccgagttcctagttccttacncgttcccgtaccccg

SEQ ID NO: 123336 - DNA, 582 bp, Homo sapiens
  misc_feature: GYAE6OF01C2QFT.22.73.G07.1.454.CMB.1.raw
  modified_base (313)..(313): a, c, t, g, unknown or other
  misc_feature (313)..(313): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatggtcctgtcccagctgcagctgcaggagtcgggcccaggactggtgaagccttcggagaccctgtccctcacctgcattgtctctggcactccatcactagttactactggagctggctccggcacgtcccagggaaggactggagtggattgggtatatcgtattacacgtggancaccgactacagcccctcctcatgagtcgagtcacctatttcactanacacgtaccaaagaaccagttccncctagaaactgaacggtctgtcgaaccgtctcgcggacacggcctctacttactgtcgacgtagtagtttcgtacgtttttggagttcggttacgccggttcggtttagaccgttacggtcggggcccgtaagggtaaccccgttgggtacccgtaccggttcctcccgtacacggcccctcgaacccgtaacccggg

SEQ ID NO: 123337 - DNA, 704 bp, Homo sapiens
  misc_feature: GYAE6OF01CGZKG.22.73.G07.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagacatacgcgtcacgaccggtgctcgatttagctctacgctcgaagggggaggaaactgcctcaggttaggacccagacggaaccatggaagccccagcgcagcttctcttcctctgctactctggctccagataccactggaagaatacgtgatgacgcagtctccagccaccctgtctgtgtctccgaaggggaaanacgccaccctctcctgcagggccagtcagtgtgttagcaaactacttagtctggtaccagcaggacgacctgggccagggctcccgaggtcctccgtnatcgtagtggtcgcttacgaccgagggtcctagtcggtactccccgactaggttcagtcgccgtaggtcgggtctgggactaggtaacgttccacttccgtacaacctataccgaacgtccaccgacctcgacctagtacctaggtaaacgttagttttacgacctttaacgttttacttacgttcgttacctaacgtactaaacgttaagttaacgttcggtaaccgtttacggggtttaccttacggtaactttacccggtaacccggtttaccgggaacccgtaaaacgggggtaccctaacccgggtaacggttaggggtaaaccgttaaacgttaaaaccggtacgttacgggtacggtaccgttacggaccgtacccgttacttccgttcgtttaccc

SEQ ID NO: 123338 - DNA, 631 bp, Homo sapiens
  misc_feature: GYAE6OF01A87Q9.22.73.G07.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagtctggtaccagcagacgacctggccaggcctcccgaggcctcctcactctagtggtntccttcgtaccgagggcccacgttcgggtactcccccggctagggttcaggtcgcctaggtcggggtctggggacaggtagttcactctccacctatcagcacgcctggcctagttcctagtaagttattttcgcttaacttttattactgtactagtactaattataagtcgtaacttcggtttacctacggtacttcccgtaccggtttccggaacccgtaaacggggacctaccgggtaacgttagggtaacgttaaactttaaaaaccgggaagttcggtacgggtacctacggacccctaaccgttacttcccgttggtttaccc

SEQ ID NO: 123339 - DNA, 578 bp, Homo sapiens
  misc_feature: GYAE6OF01CBS6D.22.73.G07.1.454.CMB.1.raw
  modified_base (197)..(197): a, c, t, g, unknown or other
  misc_feature (197)..(197): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (565)..(565): a, c, t, g, unknown or other
  misc_feature (565)..(565): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgtagcaacaacttagtctggtaccagcagagacctggccaggcctcccgaggcctcctcatctagtggtgccttcctaccgagggcccacgtcggtactcccccggcctaggtttcagtcgccgtaggtcggggtctggggacaggtcgttcactctacaccntcagcacgcctgcagtctagaagtntttgcttactttattcctgtactagtactaattaataatgtacgttggttcttcgtactcctaccgttcggaccgtaaacgggcaacggtacgtagggaacgtaaatttaaaaccggacttgggtacgtacctacggaccaacccgtnttccgtgtttccc

SEQ ID NO: 123340 - DNA, 643 bp, Homo sapiens
  misc_feature: GYAE6OF01D7LDZ.22.73.G07.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagacatacgcgtcacgaccggtgctcgatttagctctacgctcagggggaggaactgcggtcagttaggaccagacggaaccatggaagccccagcgcagcttctcgttcctcctgctactctggctcccagataccacgtggagaaagtacgtggactgacgcacgtctccagccacctgtctgtgtctcaggggaancgccaccctntcctgcagggccagtcagagtgttagccaacacttagctaggtaccagtcagacgaccgtggccaggcctacccgaggcctcctccaactctatcggtcgtctttacgaccgacgggccacgttcgggtacctccccgactagggttccacgtcgaccgtaggttcgggtctcggggaccaggtacgttccacgttcctaccacctaacgtccgacgtccaacgtcctcgcgtacgttctaggtaacgttacgttttacggacttacttttacttaccttagtacacgtactaattaattaagtcgtacttcggttactacgtacttccgtaccgttccgggacgtaacggaccgtaccggtacgtacgggtaacgtaacgttaaacgaccgtcggtacggtactccggacctaccgtcttcgtcgttaccc

SEQ ID NO: 123341 - DNA, 703 bp, Homo sapiens
  misc_feature: GYAE6OF01CPKSA.22.73.G07.1.454.CMB.1.raw
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgctatttgtcctctggcgactccatccaacttagttactatggagctggctccggcacgtcccgagggtaaggacctggacggtggaagtttcgggtaatatcttaattacgacgtgggacncgaaccgactaacncgtcccctctacagtcgagtcgacgtacaacgtactttcaactacgaacacgttaccaaaacgtaacctcgttacctacccgtagtaaaccgtggtaggttacctggttacgacccggtcgtacgccggtaaccgtaccggtccgttacgtaactttaccgtacggttggacgtaagttcgttttacggttcgtttttagggacggtttcgggttacccggtaccggttcggttttacggaccgtttacgggacggggttacccgaaggggttaacccctggggttaaccccgtacccggttaccttacccggtaccgtaccggtaccccttaccggaaccccgtaaacccgggg

SEQ ID NO: 123342 - DNA, 509 bp, Homo sapiens
  misc_feature: GYAE6OF01ER199.22.73.G07.1.454.CMB.1.raw
  modified_base (196)..(196): a, c, t, g, unknown or other
  misc_feature (196)..(196): n is a, c, g, or t
  modified_base (374)..(374): a, c, t, g, unknown or other
  misc_feature (374)..(374): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctccctgcagggccaatgagagtattagcgactacttagcctggtaccaacagaggcctggccaggctcccaggctcctcatgtatgatgcttccaaaagggccactggcatcccagccaggttcagtggcaggtgggtctggaagagacttcactctcaccatcaacngcctagagcctgacgattctgctagtttattactgtcagcagcgtacaagtcggccctcgtactttcggccgaggggaccaggcgtaggagatcgacggtacgaacgtgtggctgaccacctatctgtcttaccg

SEQ ID NO: 123343 - DNA, 710 bp, Homo sapiens
  misc_feature: GYAE6OF01AVYBY.22.73.G07.1.454.CMB.1.raw
  modified_base (195)..(195): a, c, t, g, unknown or other
  misc_feature (195)..(195): n is a, c, g, or t
  modified_base (297)..(297): a, c, t, g, unknown or other
  misc_feature (297)..(297): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaangccaccctctcctgcagggccagtcaggagtgttagcaacaacttagtctggtaccagcagagacctggccaggcctcccaggcctcctcatctagtggtcnccttactaccgagggtccacgttcgggtacctcccccggacgtacgggtttccacggttcgacccgtagggttcggggtcgtcggggaactaggtacgtttccaaccgttcctaccaaccctataccgaacgccgtacggtccctaggactaacggttcttaggtaaacgtttacgtttttacggacccttttaaccttttttacgtttaccgttacggttaccaaggtaaccttaaattacgttaaagttcggtaacgtttcgggtttaccttaccgtactttacccgtaaccgtttaccgggaaccgtaaacggggtacctaacgggtacgtagggtaaacgtaaactttaaaaccgggacgttcggtaacggcttacggaccttaacccgtagtttccgttacgttaccc

SEQ ID NO: 123344 - DNA, 576 bp, Homo sapiens
  misc_feature: GYAE6OF01EJSEX.22.73.G07.1.454.CMB.1.raw
  modified_base (198)..(198): a, c, t, g, unknown or other
  misc_feature (198)..(198): n is a, c, g, or t
  modified_base (427)..(427): a, c, t, g, unknown or other
  misc_feature (427)..(427): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcagggccagtcagagtgttagcaatacttagtctaggtaccagcagagacctggccaggcctcccaggcctcctcatctagtggtgtccttcgtaccgaggggccctacgtcgggtacctcccccggactagggttcaggtcgccgtagggtcgggtctgggacaggtacgttcacttctaccactatcgagcagcctgctagtctagaagtntttgacttacttttattactgtacagtactaatataatgtacttcggttctacgtactccgtaccgttcggaccgtaacgggacctacggtacgtaggaagtaagttaaacgtacgtaggtcgacgtcgactaacctacttcgtgttcc

SEQ ID NO: 123345 - DNA, 525 bp, Homo sapiens
  misc_feature: GYAE6OF01A2O2R.22.73.G07.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (400)..(400): a, c, t, g, unknown or other
  misc_feature (400)..(400): n is a, c, g, or t
  modified_base (516)..(516): a, c, t, g, unknown or other
  misc_feature (516)..(516): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgtagcaacacttagctggtaccngcagagacctggccaggctcccaggctcctcatctagtggtcgcttctaccgagggccatcggtactcccccgctagggttcagtcgcctaggtgggtctgggacaggtagttcactcctacaccatccagcagcctgcagtctagaagtntttgctatttattactgtcagcaatataatgtacttggtctcgattcctaccgttacggaccgaagggacacggagtaggagtaacttaaacgacgttgtggactgacctaccctnttctgttac

SEQ ID NO: 123346 - DNA, 582 bp, Homo sapiens
  misc_feature: GYAE6OF01AYPJ9.22.73.G07.1.454.CMB.1.raw
  modified_base (314)..(314): a, c, t, g, unknown or other
  misc_feature (314)..(314): n is a, c, g, or t
  modified_base (421)..(421): a, c, t, g, unknown or other
  misc_feature (421)..(421): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcagggagtcgggcccaggactggtgaagccttcggagaccctgtccctcacctgcattgtctctggcgactccatcactagttactactggagctggctccggcagtcccagggaaggactggagtggattgggtatatctattacactgggancaccgactaccagtcccctcctcatgagtcgatcacctatttcactagacacgtaccaagaaccagttacctcctagaaactgagtctagtcgaccgctagcggacncggccgttctattacgtgtgacgagtactttgtcgtttttggacgttggttaccgtccgtcgtttcggacgttaccggtcggggtcccgtacgggtaacccgttcgggtaccctacccggttccttaccctcggactcccctcccgaacccggtaaccggg

SEQ ID NO: 123347 - DNA, 525 bp, Homo sapiens
  misc_feature: GYAE6OF01EV9MV.22.73.G07.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcaacacttagtctggtaccagcagagacctggccaggctcccaggctcctcatctatggtgcttctaccgagggccacgtggtactccccgctaggttcagtgccagtgggtctgggacagagttcactctcacatcagcagcctgctagtctagtaagtntttgctactttattactgtcagactaatataatgtacttggttctcgtattccaccgttcggacctaagggacacgagtacggaagtaagttaaacggacttaggtgacgttacggacaccctattcgtgttcc

SEQ ID NO: 123348 - DNA, 653 bp, Homo sapiens
  misc_feature: GYAE6OF01CJTSK.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgccacctctcctgcagggccagtcagagtgttagcaacacttagtctggtaccagcagagacctggccaggcctcccaggcctccgtcatcctagtggtcgccttctaccgagggccacgttgggtacctcccccgactagggttccaaggtcgccgtaaggttcggggtctggggacaggtacggtttccaacgttctaccgaacctataccaacgtccacggccttaggcctaaggtccttaggtaaagttctttttacggacctttaacttttaacttaacttgttaccagtacctaaattaattaagttcgtaacgttcggttcctacggacttccgtaaccgttcggaccgtaacgggtacaccgggtactggggtaacgtaaagttaaaaccggtcgttcggtacgggtccgtaacggtaccctaacccgtacgttcgttcggtttaccc

SEQ ID NO: 123349 - DNA, 689 bp, Homo sapiens
  misc_feature: GYAE6OF01BL4WF.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggacgtcgggcccaggactgggtgaagccttcggagacccctgtcccctcacctgctattgtctctggcactccatcactagttactactggagctggctccggctacgtcccgagggaaggctggagtggtagttggtatatctattacgacgtgggactaccaccggactacgacgtcccctcctcactgacgtcgacgtccacctattcaactacgactacgtaccaaagaacctagttcctaccgtagtaaactgtaacgttctaggtcgaaccgtgtcggaccggaccgtaccggtccgttactaacgtttacgtggtacgtacgtaagttacgttttcgttacgttttttagggacggtttaccgggttacccggtcccggttcggttttaccggtaaaccgtttaccgggtacgggggtaccccgtaacggggtaccccgttcgggtacccgttaaccccgttcccgttacccgtaccgtaccgtcccccgtaaacccgtaaccccggtaaaccccgggg

SEQ ID NO: 123350 - DNA, 666 bp, Homo sapiens
  misc_feature: GYAE6OF01BBW7P.22.73.G07.1.454.CMB.1.raw
  modified_base (202)..(202): a, c, t, g, unknown or other
  misc_feature (202)..(202): n is a, c, g, or t
tcagacatacgcgtcacgaccggtgctcgatttagctctacgctcgagggggaggaactgctcagttaggacccagacggaaccatggaagccccagcgcagcttctcttcctcctgctactctggctcccagtttcagataccactggagaatagtgatgacgcagtcctccagccacctgtctcgtgtctccaggggaangccgacactctcctgcaggccagtcagagtgtagcagcagcttagcctggtaccagtcacgaaaccgtggaccaggcctaccccgagggtccctcccgtactaacgtcctagtgggtcgaccaagttccgtaacgggaccggggtaccctacggttacgggttaacctaccccgaaggtccccgtaagggtttccaagggttcgggaccgtaagggttcggggtactacggggggaacctaggtacgtttccaacgttcgtaccaccgactcgacgcacgtaccgtgcgtacgtccgtagtaacgttagtttacgacgttagtttacttacgtcgtacgtaacgtactaacttaattaacttaacgtcgtacccttacgtacgttacggtttcggaccggtacgggaccgtaggcgttaggaacgtacgtaaccgtaaacgacgtaggtacggcgtcgtaaccg

SEQ ID NO: 123351 - DNA, 584 bp, Homo sapiens
  misc_feature: GYAE6OF01EA67R.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctcccgaggcctcctctatctagtggtcgtcctttcaccgagggtcccacgttcggtacctcccccggacgtaggtttccaggtcgaccgtagggttcgggtcgtacgggacaggtacgttcactctacaccatcagcacgtcctgctagtcgtagtagttatttgacttacttttacttacgtgtacagtactaattataatgtacgttcggttctacgtactccgtaccgttcggaccgtaacggacacgtacgtagggaacttaagtaaacggtgtcggtggtcgtacgacctaacctcttcgtcgttac

SEQ ID NO: 123352 - DNA, 545 bp, Homo sapiens
  misc_feature: GYAE6OF01ESHQ1.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtcccagggaagggctggagtggattgggtatatctattacactgggagcaccgactacacgcccctccctcatgagtcgagtcacattcactagacacgtcaagaacctagttctccctagaaactgaggtctgtcgcgctgcgacgacggcgtctattactgtgcgtagtagtttgtcgtttttgggagttggttacgtccgtcgtttcgacttacgtcgggaccgtagggacccgtcggtccaccgtcgtccctacacgccctccgaccgtaaccggg

SEQ ID NO: 123353 - DNA, 587 bp, Homo sapiens
  misc_feature: GYAE6OF01AJD6H.22.73.G07.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagngtgtagcaacaacttagtctggtaccagcagagacctggccaggcctcccgaggcctcctcatctatggtntcttcgaccgagggcctagtggtactccccgctaggttccaggtcgccgtaggtcgggtcgtggggacaggtacgttccacgtcctaccaacctatccaacgtccaacgtacctggctacggtctagtaagttacttttacgccttaactttattactgtacagtactaattattaagtgtacgttggttactacgacttacctacccgttacggaccgtaaagggacctacggtacgtaggaacgtaagttaaacggacttggtacggctaggaccacattccgtgtcc

SEQ ID NO: 123354 - DNA, 604 bp, Homo sapiens
  misc_feature: GYAE6OF01ANYJQ.22.73.G07.1.454.CMB.1.raw
  modified_base (325)..(325): a, c, t, g, unknown or other
  misc_feature (325)..(325): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagacccctgtccctcacctgcattgtctctggcactccatcactagttactacgtggagcgtggcctccggcacgtccccgaggggaagggacctgggagtggagttgggtatatctattacacgtgggancaccgactacacgcccctcctcatgagtcgagtcacctatttcactacgactacgtacccaaagaaccctagttcctccctagaaactgagtctgtcgaccgcgtggccggtacgccggtccgtctacttacgtgtgcgtagtatttgttctttttagggcgtttacggttaccgtccgttcgtttcgtaccgttacggtcggggacccgtacgggtaacccttgggtcccgacccgttccgttacccgtccaccggcccttcccgaccgtaacccggg

SEQ ID NO: 123355 - DNA, 637 bp, Homo sapiens
  misc_feature: GYAE6OF01BMUPZ.22.73.G07.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (438)..(438): a, c, t, g, unknown or other
  misc_feature (438)..(438): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgcccaccctctcctgcagggccagtcagngtgttagcaacacttagtctggtaccagcagacgacctggccaggcctcccgaggtcctcctcattcgtagtggtactccttcgaccgaggtcctacgtcgggtacctccccggcgtaggttccaggtcgacctagggtcgggtactgggacnggtacgttccacttcgcaaccntacagtacacgtccctgcctgtactaggtaacgttntttcgactttacgtttacttactgttacaacgtactaaattataacgtgttaacgtttcgttaccgttacgtacttacccgtaccggttaccggtaaccgaaacgggtacctacgggtaacgtagggtaaaccgttaaagttaaaccggtcgtaggttacgggacttacggaccctaacgtcgtttcgttcgttaaccg

SEQ ID NO: 123356 - DNA, 747 bp, Homo sapiens
  misc_feature: GYAE6OF01CY1BA.22.73.G07.1.454.CMB.1.raw
  modified_base (199)..(199): a, c, t, g, unknown or other
  misc_feature (199)..(199): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaanacgccaccctctcctgcagggccagtcagagtgttagcaaactacttagtctaggtaccagcagacgaccgtggaccaggcctacccgaggtccttcctctaacttctagttcggtcgtacctttaccgtacccgagggcccctaacgttcgggttaccctcccccggacgtagggttccaggttcgacccgtagggttcggggtctaggggaactagggtacgtttccaaccgtttccaccgaacctaagtaccgacggtccaaccggtcccgtaggacccgttaggttacgttaaggttaaacgtttactttttacggaaccttttaacgtttttaatttaccgttacggtttaccaaggttaaccttaaagtttaactaaacgtttcgtaaccgtttcgggttacctacgtaaccttcccgttaacccgttacgggaacccgtaaaggggtaccaaaccggtacgtaagggtaaacgttaaacgttaaaaccggacggtttacgggacggtccgtacgacctaactacgttccgtttcgttaccc

SEQ ID NO: 123357 - DNA, 577 bp, Homo sapiens
  misc_feature: GYAE6OF01DXEQX.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgttagcaacaacttagtctggtaccagcagagacctggccaggctcccaggctcctcatctagtggtcgtcttcctaccgagggccacgtcggtactcccccggctaggttcaggtcgccgtaggtcgggtctggggactaggcgttcactctcaccatcagcagcctgcagtctagtaagtattttgacttacttttacttacttgtacagtactaattataatgacttcggttctacgacttactacccgttacggaccgtaacgggtaccacggtacgtagggtaacgtaattaaaccggaacgttggtacggcttcggacctacctacgttccgtcgtttccc

SEQ ID NO: 123358 - DNA, 565 bp, Homo sapiens
  misc_feature: GYAE6OF01EVTH3.22.73.G07.1.454.CMB.1.raw
  modified_base (252)..(252): a, c, t, g, unknown or other
  misc_feature (252)..(252): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcacttagttactactgganctggctccggcacgtcccgaggggaacgggactgggaggtggagtttggggtatatctattacacgtgggagcacgactacacgcccctcctcagtcgagtcgagtcacctatttcactacgactacgtccaaacgacctagttcctaccctagaaactgtacggtctagtacgccgtctcgcggaccacggcctcttattaccgtgtgcgtagtagtttgttcgttttggagttcggttacgccgttgttcgactcgtgggcctagggaccctggtccgtacgtccgtcctcacgccctaccgcgtaaccgg

SEQ ID NO: 123359 - DNA, 622 bp, Homo sapiens
  misc_feature: GYAE6OF01BWN9I.22.73.G07.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtcctgtgtcctccgaaggggaaacncgcccaccctctcctgcagggccagtcagagtgttagcaactaacttagctggtaccagcagagacctggccaggcctcccgaggtcctcctnacgtctatggtcncttacaccgacgggccagtcgtacctccccgcgtaggttcagtcgccaggtcggtcngggacagtacgttcactcgacacatcacgcacgcctgcaggtctagtaagttatttcacgttaactttagttactgttacgatactaaattattaagtgtaaccgtttcggttaccttaccggtaacttcccgttaacccggtttcgggaacccggaaagggtacccgaacgtaacggtacgggaagttaaaccgttaaacggacccgtttagggtacccggtctaacggccctaaaccgtactttcgcgttttaccc

SEQ ID NO: 123360 - DNA, 562 bp, Homo sapiens
  misc_feature: GYAE6OF01B47UD.22.73.G07.1.454.CMB.1.raw
  modified_base (421)..(421): a, c, t, g, unknown or other
  misc_feature (421)..(421): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcactagttactactggagctggctccggcacgtcccagggaaggctggagtggattgggtatatctattacacgtgggacgcaccgactacacgcccctcctcatgagtcgacgtcacctatttcactagacacgtccaaagacctagttactccctagaaactgagtctgtcgaccgctcgcggacncggccgtactattactgtgcgtagtacgtttgtacgtttttggagttgggttacgtccgtcgtttagacgttacggtcggggtccaagggtaccctgggtcctaccgtctccctcgaccgccctccgaaccgtaacccggg

SEQ ID NO: 123361 - DNA, 546 bp, Homo sapiens
  misc_feature: GYAE6OF01A3MIM.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacacttagtctggtaccagcagagacctggccaggctcccaggctcctcatctagtggtgcttcaccagggccacttgggtactcccccgcaggtttcagtgcctaggtgggtctggggacaggagttcactctcacatcagcagcctgcagtctagaagtattttgctacttttatactgtacagtctaattataagtgtacgttcgttctcgtatacctaccgttcggaccgtaagggtaccacggtactagggaacgtaagttaaacgcgttacggtaggctcggacctaaccgtacttcgttggttacc

SEQ ID NO: 123362 - DNA, 662 bp, Homo sapiens
  misc_feature: GYAE6OF01A4LQE.22.73.G07.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (384)..(384): a, c, t, g, unknown or other
  misc_feature (384)..(384): n is a, c, g, or t
tcagacatacgcgtcacgaccggtgctcgatttagctctacgctcagggggaggaactgctcagttaggacccagacggaaccatggaagccccagcgcagcttcctcttcctcctgctactctggctcccagataccactggagaaatgtgatgacgcagtctccaggcaccctgtcgcgtgtctccgaaggggaacncgcccaccctgtcgtgtaagccagtcagatgttaacaacngatatagacgtcctggtatcagtcagacgacctggcagtctcccgttctccttcgtctttcgggtcgccggccgtacggcggtcccgaccgggctacgtcccgtgaccaggtacttcgaggtcggcgtacggtggggtcccggtnacgtacttacgtcctggcctacgaccgtacgtcgggcggttaccgtaggtaacccgttgggtaactcgtttacgtacggtacctaatacgttacttacgtcgttacgtacgtactttagttcgtttaattcctaaccgttccgttaccggtataccgttcggtttacgggaccgtaacgggacctacgggacgttacggaaggtactaaccggaacctacggttcgggtacgtacgttacgtacgtaacccttagttaccgttcgtttcccttaaccg

SEQ ID NO: 123363 - DNA, 640 bp, Homo sapiens
  misc_feature: GYAE6OF01BUCVI.22.73.G07.1.454.CMB.1.raw
  modified_base (198)..(198): a, c, t, g, unknown or other
  misc_feature (198)..(198): n is a, c, g, or t
  modified_base (418)..(418): a, c, t, g, unknown or other
  misc_feature (418)..(418): n is a, c, g, or t
  modified_base (441)..(441): a, c, t, g, unknown or other
  misc_feature (441)..(441): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgccagggccagtcaggagtgttagcaaacaactttagtctggtaccagcagagacctggccaggcctcccgaggcctcctcatctagtggtgcctttaccgaccgagggcccacgttcgggtactccccccggacgtagggtttccaggtcgcctagggttcggggtctaggggaactaggtacgttcacctctaccaccatccgancagcctgctagtctagtaagttntttcgacttacttttattaccgtgtacctagtactaaatattaacgtgtaacttggttactacgtacttccgtaccgtttcggaacccgtaagggacctacgggtacgtacgggaaacgttaacgttaaaaccgggtcgtttagggtacgggtaccgttacggacccttaacccgttacgtttccgttcggtttacccc

SEQ ID NO: 123364 - DNA, 545 bp, Homo sapiens
  misc_feature: GYAE6OF01DWYUB.22.73.G07.1.454.CMB.1.raw
  modified_base (197)..(197): a, c, t, g, unknown or other
  misc_feature (197)..(197): n is a, c, g, or t
  modified_base (421)..(421): a, c, t, g, unknown or other
  misc_feature (421)..(421): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcaacacttagtctggtaccagcagagacctggccaggcctccaggctcctcatctatggtgtcttctaccgagggcctacgtggtactccccgctaggttcagtcgccgtaggtgggtctgggacaggtacgttcactctcaccatcagcagcctgcagtctagtaagtatttgcttactttatactntcagtctaatataatgtacttggttactcgtatcctacgttcggaccgtaaggtaccaccgtagtaggaacgtaattaaacggtacgttgtcggtactcgacctaccgtactcgttcgttaccg

SEQ ID NO: 123365 - DNA, 623 bp, Homo sapiens
  misc_feature: GYAE6OF01BX0UK.22.73.G07.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (611)..(611): a, c, t, g, unknown or other
  misc_feature (611)..(611): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagcaactaacttagtctggtaccagcagagacctggccaggctcccgaggcctcctcatcgtatcggtgtccttcgtaccgacgggccacgtggtactcccccgcaggttcaggtcgccgtaggtgggtcgtgggactaggtacgtttcacttcctacacctagtccagcacgtccctagcctagtctagtaaacgttgttttacgccttaacttttattaccgtgtctagtacttaagttaactaagttctaacgttggttaccttacgtacttccgtaccgttacgggacctaacggggacctaccggtaacgtagggtaacgttaaacgttaaaccggtacgttagggtacggtaccttacggaccctaacgtacgttnttcggtttaccc

SEQ ID NO: 123366 - DNA, 587 bp, Homo sapiens
  misc_feature: GYAE6OF01A68Y8.22.73.G07.1.454.CMB.1.raw
  modified_base (197)..(197): a, c, t, g, unknown or other
  misc_feature (197)..(197): n is a, c, g, or t
  modified_base (416)..(416): a, c, t, g, unknown or other
  misc_feature (416)..(416): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcaacaacttagtctggtaccagcagagacctggccaggctccaggcctcctcatctagtcggtgccttcaccgagggccctacgtcggtactcccccgctaggttccaggttcgccgtaggttcggggtctggggacaggtacttcgacttcacaccatcagcagcctgctgtctagtaagtntttgacttactttattactgtacagtactaattactaatcgtaacttcggttactcgtacttccgtaccgttcggaccgtaagggcctacggtacgtagggtaacgtaaagttaaacggacgttgggtacggtacttaccggacctaacccgttattcccgttggttaccc

SEQ ID NO: 123367 - DNA, 563 bp, Homo sapiens
  misc_feature: GYAE6OF01EJ7XT.22.73.G07.1.454.CMB.1.raw
  modified_base (339)..(339): a, c, t, g, unknown or other
  misc_feature (339)..(339): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcactagttactactggagctggctccggcacgtcccagggaggactggagtggattggggtatagtctattacacttggggagcaccgactacacgccccctcccncactgacgtcgagtccacctatttccacttacgactacgtaccaaaggaaccctagttcctacccctagaaactgacggtctgtcgaccgctcggcggtacgaccggtccgtctacgttactgtcgcgtagtgtttgtcgttttgagttggtacgccgtcgttgctacgtgggccagggtacccgtggtcctaccgtctccgtcacgcctccgaccgtaccggg

SEQ ID NO: 123368 - DNA, 690 bp, Homo sapiens
  misc_feature: GYAE6OF01EDYF4.22.73.G07.1.454.CMB.1.raw
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccactggagaaatagtgatgacgcagtctccagccaccctgtctgtgtctcgaggggaaancgcccacctctccgtgcagggccagtcagtagtgttacgacaactaacgttgtctaggtaccagcagacgaccgtggccaggcctcccgaggtcctcctcatctagtgggtcnccttctaccgacgggtcctacgttcggtacctccccggctaggttcagtcgccgtaggtcggtcgtgggactaggtacgttccaactccgtactaaccgtataccgacgccacggtcccgtagtccgtacggttcttaaggtaacggtttactttttacggaccttttaacctttttataaccggttcgttaaccgaagtaacccttaaagttaacttaacgttacggttaccgttttacgggttaccttaccggttaacctcccggttaaccccggttacgggaacccggtagggtaacccacgggtacgtaacggtaagtaaacgtaaacggtccgtggttaccgcgttacgacctaccttacgtccttcggttaccc

SEQ ID NO: 123369 - DNA, 597 bp, Homo sapiens
  misc_feature: GYAE6OF01EYMYH.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagcaacacttagtctggtaccagcagagacctggccaggcctcccgaggcctcctcatctagtggtcgcttctaccgagggccacgtggtacctcccccgccgtagggttcaggtcgccgaggttcggggtctggggactaggtacgtttcactctcaccatcagcagcctgctagtctagaagttatttgactacttttattactgtacagtactaattataagtcgtacttcggttctacgtacttccgtaacccgttcggaccgtaaaggggaccaacggtacgtagggaaacgttaagttaaaacccggtagttacggtcgggtaccttacggaccctaacccgtacttccgttggttaccc

SEQ ID NO: 123370 - DNA, 686 bp, Homo sapiens
  misc_feature: GYAE6OF01DGG3S.22.73.G07.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaanacgcccaccctctcctgcagggccagtcagagtgtagcaaactaactttagttggtaccagcagagacctggccaggcctcccaggcctcctnatctaagtggtgcttacaccgagggcccagtcggtaacctccccgactaggttcagttcgaccgtaggtcggggtctaggggactaggtacgtttccacttctccaacctagttacacggacctacggcccttaggacctaaggttccgtaaggtaaacgttatttttaccggacttaactttttaattacgttcggttacaagtacctaaaattaattaaagttgtaacgtttgggttacctacggtaaccttaccgtaaccccgtttacgggacccgtaaaggggtaaccctaacgggtaccgtaagggtaaacggtaaaaacttttaaaaccgggacttagggtaccggacgttaccgtaccctaacctatttccgtacgttccttaacccg

SEQ ID NO: 123371 - DNA, 592 bp, Homo sapiens
  misc_feature: GYAE6OF01AF8LD.22.73.G07.1.454.CMB.1.raw
  modified_base (208)..(208): a, c, t, g, unknown or other
  misc_feature (208)..(208): n is a, c, g, or t
  modified_base (411)..(411): a, c, t, g, unknown or other
  misc_feature (411)..(411): n is a, c, g, or t
  modified_base (466)..(466): a, c, t, g, unknown or other
  misc_feature (466)..(466): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctnacctgcattgtctctggcgactccatcactagttactactggagctggctccggcagtcccagggaggactggagtggatttgggtatatctattacacgtgggagacaccgactacacgcccctccctcatgagtcgagtcactatttcactacgacacgtcaagaccagttcctcctagaaactgacggtctgtcgaccgntgcggacaccggtccgtctattactgtcgcgtagtagtttgttacgtttttgggngttagggttacgccgtcgtttcgaccgttacggtcggggtcccgtaaggggtaaccccttcgggtacccgtaacccgttccgttccccgtacgaccgtccccttacccgaacccggtaaacccggg

SEQ ID NO: 123372 - DNA, 595 bp, Homo sapiens
  misc_feature: GYAE6OF01EQ6DW.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcaacaacttagtctggtaccagcagagacctggccaggcctccgaggcctcctcatctagtggtgtccttccgtaccgagggccctacgtcggtacctcccccgcagtacttcgagttcgccgtagggtgggtcgtggggactaggtacgttcacctctccaccatcagcagcctgctagtctagtaagttattttcgacttacttttattactgtacagtactaagttataagtgtacgttcggttactcgtacttaccgtaccgttacggaaccgaagggtacctacggaacgttagggtaagttaaacgttaaacggaacgttggtacggtctacggacctaaccgtgttcccttacgg

SEQ ID NO: 123373 - DNA, 711 bp, Homo sapiens
  misc_feature: GYAE6OF01DVCLZ.22.73.G07.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctccagataccactggagaaatagtgatgacgcagtctccacgccaccctgtctgtcgtctccgaaggggaaacncgccaccctctccngcgacgggccagtcagtagtgtacgacaaactaacttagtcgtacggtaccagcgaagacgaccgtcggccacggcctacccgaggccttccgtactacttcgttacgtcgggttacgtcctttaccgtaacccggagggtacccaacgttcgggtaaccctccccggtacgtaacggtttccacggttcgaccggtagggttcgggtacgttacggggaactacggtacgtttacaccgttacctaccgaacctagtccgaagccgtacggtcctagacgtacggttacgtaggtaaacgttagttttcgaacgtttacttttaacgttacgttacgtactaacgtacttaaattaataacgttcgtaacgttcggttactacgtacttaccgtaccgtacggaaccggtaacggtaccgacggtaacgtagggtaaacgttaaataaacggtacgttacggtacggactacggaccaacttcgttcgtcgttacc

SEQ ID NO: 123374 - DNA, 764 bp, Homo sapiens
  misc_feature: GYAE6OF01ELQVH.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcaacattagtctggtaccagcagagacctggccaggcctcccaggctcctcatctatggtcgcttctaccgagggcccagtggtacctcccccggctaggttccaggtcgccgaggttcgggtcgtaggggactaggtacgtttccacgttcctaccgaaccctatcccgaaggtcccaacggtcccttaggaccgtagggttacccgttaggtaaaacggtttactttttacgggaccctttaacgttttttaacgtttaaccgttgggttacccaaacggtaaccttaaaagtttaacgttaaacgtttcggttaaaccggtttcggggttttacccttaaccgggttaacctttccccggttaaccccggttttacccggggaacccgtaaaacggggggtaaccctaacccggggttaaacggttaacggggtaaaacggttaaacttttaaaaacccgggacgtttacgggttacgggaccgtttacggacccttaaaccgtacgttttccgtcggtttaacccc

SEQ ID NO: 123375 - DNA, 575 bp, Homo sapiens
  misc_feature: GYAE6OF01EUIQD.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcacgtcccagggaaggctggagtggattgggtatatctattacactgggagcaccgactacacgcccctccctcatgagtcgagtcaacctatttcactagacacgtaccaaagacctagttctaccctagaactgacggttctagtcgaccgctggcggacaccggtccgtactacttacgtgtcgcgtagtagtttgtcgtttttggagtttcggttacgtccgtcggtttcgtacgtacggtcggggccctaaggggtaccctggtacctaccgttcctcctcgacgcccttaccgacccgtaacccggg

SEQ ID NO: 123376 - DNA, 763 bp, Homo sapiens
  misc_feature: GYAE6OF01D73Y5.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangcccaccctctcctgcagggccagtcagagtgttagacaaactaacgttagtctaggtaccagcaagacgaccgtggccaggcctacccgaggtcctcctcattctagtcggtcgtcttcgtaccgagggccctacgttcgggtacctcccccggcgtaggttccaggtcgccgtagggttcggggtacgtaggggactaggtacgtttccaccttcctaccgaaccctagtaccgacggcctaacggtcccttaggacccgttaggttaccgttaaggtaaacggtttactttttaccggaaccgttttaacgttttttaacgtttaaccggttacggttaacctaacgggttaacctttaaaatttaaacgttaaacgtttacgggttaaccgttttacgggtttaccttaaccggttaacttaccccgttaacccggtttaccggggaaccgtaaacggggtaacctaaccgggtacgttaacgggtaaacgttaaacgtttaaaaaccggcgttagggtacggacttacgaccgttaaccctagtttcccgttggttaccc

SEQ ID NO: 123377 - DNA, 759 bp, Homo sapiens
  misc_feature: GYAE6OF01DUKS7.22.73.G07.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtcgtctaccgaggggaaancgcccaccctctcctgcagggccagtcagagtgtanacaactacttagtctaggtaccagcaggacgaccgtggaccaggccctaccggacggtcctcccctatacttcgtagtcgggttccgtacctttaccgaaccggacgggtaccctacggttaccggtacccctcccccggacgttaacgggttcaacggtccggacccggttaggggttccgggttaccggtaacggggaacgtaacgggttaccgtttaccctactttaccgtaccccaactcgttacgacgtaccgtaccgtcccgttacgaccgttacggttacgttaaggttaaagtttcgtttttacgaccgtttttaactttagtttacgtacgtacgtaacgtaacttaattaagttaacgttgttaaccgttacggttttacctacgttaccgttaccttaccggttaccggaaaccggtacgggtaactacggtaacggtagggtaaaccgttaaagttaaacggtacggttaggtacgtacgtaccgtacctaccgttacttcgttcgtttacc

SEQ ID NO: 123378 - DNA, 714 bp, Homo sapiens
  misc_feature: GYAE6OF01DHLMB.22.73.G07.1.454.CMB.1.raw
  modified_base (320)..(320): a, c, t, g, unknown or other
  misc_feature (320)..(320): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttacagtggagctcggctccggcacgtcccgaggggaacggctggagtggtagttgggtatatctattacacgtgggacncaaccgactacacgcccctacctcagtcgacgtacgacgtaccaacctatttaccacgtacgacctaacgtaccaaacgaacctacggttcctaccctagaaacgttggaggttcctggtacgaccgtcgtcggaccggaccgaccggtccgttactttacgttacttgggtacgtacgtaggttacgttttcggttacgtttttacgggacggttttaccgggttaccggtccgggtttaccggttttacggaaaccgtttaccggggttaccgggggtacccgtaaaccgggggttaacccccgtttcggggttaacccctaaccccggtttcccgtaccccgttacggaccccgttaccccgttaccccggaaaccggtaaacccccgggg

SEQ ID NO: 123379 - DNA, 638 bp, Homo sapiens
  misc_feature: GYAE6OF01B9BDM.22.73.G07.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (456)..(456): a, c, t, g, unknown or other
  misc_feature (456)..(456): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgccaccctctccngcagggccagtcagagtgttagcaacaacttagtcctggtaaccagcagagacctggaccaggcctcccgaggtcctcctcacttccgtaagttcgggtctccttacctaaccgacggggtaccctaacgttcggggtaaccttccccccggaccgtaagggtttccaaggttcgcccgtaggtcgggtctaggggacagtacgttcacgtctacaccatcagcagcctgcagtctagaagtntttacgacttactttattacgtgtacacgtaactaatacttaatcgtacgttggttaccttacgtattacccgtaccgttaccggaaccggtaaggaacctacggtaacgtaggtaaacgttaaacgttaaaacggtacttgggtacggtactacgaacgtacctacgttccgttcgttacc

SEQ ID NO: 123380 - DNA, 661 bp, Homo sapiens
  misc_feature: GYAE6OF01CVA9R.22.73.G07.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgtagcaacaacttagctggtaccagcagagacctggccaggctcccaggctcctcatctatggtncttcaccngggccacgtgtacctccccgcaggttcaggtcgccgtaggtcgggtcgtggggacctaggtacgtttaccaccttctaccgaaccctagtccgaagccgaacgcccttaggaccgtagtccgtaggtaaacggttaatttttacggacctttaacttttaactttacgttaggttacaacggtactaaatttaacttaaagtaggttaaccgtttacggttttaccttacgtaacgttccgtaacccgtttcggaacccggaaacggggtaccaacggtacgttacgggtaaacgtaacgtttaaaaccggacgttacggtaggtaccgtcgacctacctaacgttccgttgttacccc

SEQ ID NO: 123381 - DNA, 706 bp, Homo sapiens
  misc_feature: GYAE6OF01BN2MF.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactgggtgaagccttcgggacgtaccctggtccctcgaccttgcctagttcgtctcgtcgggctaccttccatcaacttagttactacgtggagcgttggcctaccggctacggtacccgaggggaacggacgtgggaggtggtagttggtatatctagttacgtacgtggacacgacgactacgaccgcccctcctacagtacgacgtacgacgtacctactacttacaactagacctacgtaccaaacgaacctacgttcctacctagtaacgtcgtaggtctcgtacgacccgtgtacggccggtaacgaccggttcccgtacgttaacgttaaccgttgggtacgaccggttaggttacgtttttacggttcggtttttagggacggtttaccgggttacggtccggttacggttttcggaccgtttacgggtcggggtacccgtaacggggtacccgttcgggtacccgttaaccgttcccgttccgttaccgtaccggtccctaccgaacccggtaacccggg

SEQ ID NO: 123382 - DNA, 573 bp, Homo sapiens
  misc_feature: GYAE6OF01EESL9.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtcccagggaagggactggagtggattggggtatatctattacactgggagcaccgactacagcccctcctcatgagtcgagtcaccatttcactagaccacgtaccaaagaacctagttcctccctagaacctgacggtctgtcgaccgctgcggacgaccggtccgtctattactgtgcgagtatttgtcgtttttggagttggttacgccggtcgtttgacgtacgtcggggccgtaggggtaacccgtgggtacctacccggttccttcccgtaccgaccgtccctcccgaacccgtaaccgggg

SEQ ID NO: 123383 - DNA, 636 bp, Homo sapiens
  misc_feature: GYAE6OF01BF1OP.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagctaactacttagtctggtaccagcagacgacctggccaggcctcccgaggcctcctcatctagtggtcgtcttcctaccgagggccctacgtcgggtacctccccggaccgtaggtttccaggttcggcccgtaggtcggggtcgtacgggaacaggtacttccaccttcctaccaacctgtaccgtagccgtacgtccctaggcgtacgttcgtaaggtaagttacgttttcgaaccttacttttagttacgtcgtacagtactaaatataagtcggtaattcggttacctacgtactacccgtaccgttacggaaccgaaacggaccgtaaccgagtaggtaacgtaacgttaaaccggtacgtggtaggtaccgtgaccttaacctcttcgttgttaccc

SEQ ID NO: 123384 - DNA, 639 bp, Homo sapiens
  misc_feature: GYAE6OF01E2HBP.22.73.G07.1.454.CMB.1.raw
  modified_base (201)..(201): a, c, t, g, unknown or other
  misc_feature (201)..(201): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtcctccagccaccctgtctgtgtctccgaaggggaaacncgcccaccctctccgtgcgacgggccagtcagtagtgtagacaactacgttacgtcgtacggtaccagcaaggacgacccgtggccaggcctacccgaggtccctcctcattcgtagtggttctcctttaccgacccggagggccctacgtcggtaccctcccccggactagggttccacggtcgaccgtagggttcgggtctagggactaaggtcttccactcaccactactcacgcacgtcctgctagttacgtagtaagttcttttcgtaccttaactttacgttactacgtacagtacttaattataacgttcgtacgttcggttactacgttacttccgtaccgtacggaccgtaacgggacctacgtacggtaggaacgttaacgtaaacggtacgtggtacgtcgtacgacctaccgtcttccgttgttcc

SEQ ID NO: 123385 - DNA, 646 bp, Homo sapiens
  misc_feature: GYAE6OF01DDA5H.22.73.G07.1.454.CMB.1.raw
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggacgaccctgtccctcacctgctattgtctctggcactccatcactagttacagtggagctggctccggcacgtcccgagggaacggcgtggagtggagttggtatatctatacncgtggacncaccgacacacgcccctcctanactgacgtcgactcactactttacactacgactaccgtaccaaagtacctcgttacctacccgtagtaactggaacggttcgtcgtcgaccgtcgtacggccggacgtaccggccttacttacttacgtgtcgtacgtagttagttttcgtttcggttttggtacggtttcgggtttaccgtccggtttcggtttacgtaccggttacgggtccgggggtaccgtaacggggttaccccgttcggtaccccgttacccgttcccgttcccgtaccaccggtacccctacccgaaccggtaaccccggg

SEQ ID NO: 123386 - DNA, 650 bp, Homo sapiens
  misc_feature: GYAE6OF01BRQBM.22.73.G07.1.454.CMB.1.raw
  modified_base (196)..(196): a, c, t, g, unknown or other
  misc_feature (196)..(196): n is a, c, g, or t
  modified_base (443)..(443): a, c, t, g, unknown or other
  misc_feature (443)..(443): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgcccaccctctcctgcagggccagtcagagtgttagcaacacttagtctggtaccagcaggagacctggccaggctcccgaggcctcctacattcgtagtggtcgtcttccgtaccgagggtcctacgtggtacctccccgctacggttcagtcgaccgtaggtcgggtcgtgggacaggtcgttcacgttcctaccaccattaccgagaccgtacgccgtacggcctagttctaggtaaacgttnttttacggaccttaacgttttacgttaacgtggtactaagtacttaattaacgttaacgtgtacgtttacggttccgttaccgtacttacccgtaccgttacccgggaccgtaaagggtaccaacggtacgtacgggaaacgttaacgttaaaacggacgttacggtacggtacgttacgaacctaccgttacttccgttcgttacc

SEQ ID NO: 123387 - DNA, 687 bp, Homo sapiens
  misc_feature: GYAE6OF01ENEEC.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctgcgactccatcactagttactactggagctggctccggcacgtcccgagggaacggactggagtggattgggtatatctattacacgtgggagcaccgactacacgcccctccctacatgacgtcgacgtcacctatttcactacgaccacgtaccaaacgaacctagttcctaccctagtaaacgtgtaacggttctacggtcgaaccggtccgttacgggaccggaaccgtaccgggtcccgttacgttacgtttaacgtgttcggacgtaacgttagttttgggtttaccgtttttttaggggaacggtttcgggtttacccggttcccggtcggttttaccggaccgtttaccggttcgggggtacccgttaaccgggggtaaccccgttcgggttacccgtacccggttcccgttcccgtaccgtaccgtccccgtacccgaacccggtaaacccgggg

SEQ ID NO: 123388 - DNA, 677 bp, Homo sapiens
  misc_feature: GYAE6OF01CJW0G.22.73.G07.1.454.CMB.1.raw
tcagacatacgcgtcacgaccggtgctcgatttagctctacgctcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacgctggccaggcctccaggctcctcatgtatgatgcttaccgaaaaggccactggcactccagccaggtcagtggcgaggtggtcgtaggaagagacgttacactcctacaaccgatacaaacacgacctaaggacgtcctacggaacgtactttcgtacgtacgtaagttttaacgtttaccttcggttactacgtacgaacggtcccggttaaacccgaacggttccgggtacccgttacccggttaccggtttttacggggaaccccgtaacggggggtacccgtaaacggtcggtacgggtaacgaaagtacccgaaaggaaaccggtaaccggttacggtacggacggtaccgtacccgaactaacgttcccgttacgtttcccgttaccttaccgttcccgtttaccccccgg

SEQ ID NO: 123389 - DNA, 773 bp, Homo sapiens
  misc_feature: GYAE6OF01AQ062.22.73.G07.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccacctgtctgtcgtcctccgaaggggaaancgccaccctctcctgcagggccagtcagngtgttagctaacacttagtctggaccagccagacgacctcggaccaggtcctcccgaggtcctcctcacttctagtcggtcgtcctttaccgtaacccgaggggtccctaacgttcgggttacctcccccggcctaacgggtttccaaggttcgcccgtagggttcggggtaccgtaggggaccaaggttacgtttaccgaccttccgtaccaaaccctagtccaaggtcccaacgtcccgttaggccgtaacggttccttaacggtaaacggtttactttttacggacctttaaactttttaactttaaccgttcgtttaccaagtaacttaaacttaaacttaacgttacgtaacgtttcgggtttaccttaccgtaaccgtttcccgtaacccggttaccggaacccggtaaacggggtaccaaaccggggtacgttaacggggtaaaccgttaaaagttaaacccgggtaaacgttacggggtacggttaacccgtaccggtaaccccgtaaaccgttacttcccgtttacgtttacccc

SEQ ID NO: 123390 - DNA, 661 bp, Homo sapiens
  misc_feature: GYAE6OF01BGDK4.22.73.G07.1.454.CMB.1.raw
  modified_base (319)..(319): a, c, t, g, unknown or other
  misc_feature (319)..(319): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagacccctgtcccctcacctgctattgtctctggcactccatcactagttactactggagctggctccggcacgtcccgagggaacggactggagtggattgggtatatctattacacgtgggancaccgactacacgcccctcctcatgacgtcgacgtcacctatttacactacgactaccgtaccaagaacctagttcctacctagaactggtacgttctcgtacgaccgtctcggccggaccgtaccggtcccgtcttaacgtttcgtgtcggacgtaagttagttttcggtttcgtttttaggggacggtttacgggttaccgtcccggttacggttttacggaaccgtttaccgggttcgggggaccccgtaacggggtaaccccgttcgggttacccctaccccggttcccgttcccgtaccgtaaccggtcccccgtacccgaacccggtaaccccggg

SEQ ID NO: 123391 - DNA, 564 bp, Homo sapiens
  misc_feature: GYAE6OF01A160Z.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttaccaaaagggccactggcactcccagccaggttcaggtggcaggtgggtctggaagagacttcactctcaccatcaacagacctagagcctgacgtattctgctagtttattactgtcagcagcgtaccaagtcggtcctaccgtacgttttcgggacccgtagggggaccaaggctagggacgtagtccgaagaaccggtaacgtggtacggtcgtacgacccgtacccgtaacttccgttaggttccttccgtaacgtttcccccg

SEQ ID NO: 123392 - DNA, 724 bp, Homo sapiens
  misc_feature: GYAE6OF01A8MKV.22.73.G07.1.454.CMB.1.raw
  modified_base (344)..(344): a, c, t, g, unknown or other
  misc_feature (344)..(344): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctccagatgggtcctgtcccagctgcagctgcaggaggtcgggccaggactggtgaagccttcggacgaccctgtccctcacctgctattcgtctcgtggcactccatctacttagttactacgtggagcgtggcctccggcaccggtcccgaaggggaacggacgtagggtaggtggtagtttgggtaattacgtacttagtacgacgtgggacnccgacgactacgaccgcccctcctacactgacgtcgacgtacctacctatttacgacttacgacctaaccggtaaccaaacgtaaccctacgttaccgtacccgttaagtaaaccgtggtaacggttccgtaggtccgtaaccgtcgtcggtaccggtaaccgtacccgggtccgttaacgttacgttacggtacgttcggtacgtacggtttacgtttcgggtttacgtttttacggggtacggtttacgggtttaccgtaccgggttcggtttacgtacccggttacgggtaccgggtaccggtaacgggtacccgttcgggtaccctaccgtcccttaccgtccgtaccggtcccctacccgtaaccggtacccggg

SEQ ID NO: 123393 - DNA, 586 bp, Homo sapiens
  misc_feature: GYAE6OF01ARJV4.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcacgtcccgagggaagggctggagtggattgggtatatctattacacgtgggagcaccgactacacgcccctcctcatgagtcgactcactattcactagactacgtaccgaaagaacctagttcctcctagaaactgacgtcgtcgtcgaccgctgcggacgcggctctacttacgtgtcgcgtaagtagtttcgtcgtttttggagtttcggttacgtccggttcgtttcgaccgttacggtcggggtaccgacgggtacccgttgggtcctaccgttacccgtcccgtacgaccgtcccctcccgtaacccgtaacccggg

SEQ ID NO: 123394 - DNA, 680 bp, Homo sapiens
  misc_feature: GYAE6OF01CUJDK.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatggtcctgtcccagctgcagctgcaggagtcgggcccaggactggtgaacgccgttcggacgacccctgtcccctcgacctgctattcgtctcgtggccgaccttccattcactagttactatggagctggcctccggcacgtcccgagggacggacgtggagtggacgttggtatatactatacgacgtgggacgaccgaccgactacgaccgccccctcctacagtgaacgtcgacgtccaactacttacactacgacctaaccgtccaaaacgtaacctacgtttaccctacctaacgtaaacgtggtacgtcgttagtacggaccgtcgtcgaccggaccgtaccggtaccgttaccttaacttaccgtgtcggtacgtaggttacgttttcgttcggtttttaggacggtttcggttaccgtccggttacggtttcgaaccgttaccggtcggggacccgtaaccgggtacccgttccgggtacccgtacccgttcgttacccgtccgaccgtcccctacccggaaccggtaacccggg

SEQ ID NO: 123395 - DNA, 764 bp, Homo sapiens
  misc_feature: GYAE6OF01BE11Q.22.73.G07.1.454.CMB.1.raw
  modified_base (202)..(202): a, c, t, g, unknown or other
  misc_feature (202)..(202): n is a, c, g, or t
tcagacatacgcgtcacgaccggtgctcgatttagctctacgctcagggggaggaactgctcagttaggacccagacggaaccatggaagccccagcgcagtcttctcttcctcctgctactctggctcccagataccactggagaaatagtgatgacgcagtctccagcccaccctgtctgtgtcctccgaaggggaaacncgcccaccctctcctgcgacgggccagtcagtagtgtagcaaactacttagtctaggtaccagcagacgaccgtggacccaggcctcccgaggcctcctctatcgtagtggtcgtcctttaccgaccgacgggtccctacgttcggtacctcccccggactacgggtttcacggtcgaccgtagggtcgggtacgtacgggactacggtacgttacctaccgtacctaccaaccctagtccgaacggacctaccggtcccttacggaccgtaacggttcgttaaggtaaacgtttacgtttttcggaaccctttaaccttttttagtaacctttcggtaactaaggtaacttaaagttaacgttaaagttcgtaccgtttcgggttaccttaccgtaacctttcccgttaacccgggttcccgggaacccgtaaacggggtaacccgtaacccggttaacggtaaccgggttaaacgtaaactttaaaacccgggtagttaccggtaccgggtaccctccggtaacccctaaccttacggtttcccgttcgtttaacccccg

SEQ ID NO: 123396 - DNA, 653 bp, Homo sapiens
  misc_feature: GYAE6OF01CU28K.22.73.G07.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggaagaaatgtgatgacgcagtctccagccacctgtctgtgtcctacgaaggggaaancgcccacctctccngcagggccagtcagagtgttagactaactacttagtctaggaccaggcaagacgacctggacacggcctcccgaggtcctacctntatcgtagtcgggtctacctttaccgaaccgacgggtccctaacggttgggtaacccncccccggtacgtaggttccaggttcgaccgtaggtcgggtacgacgggaactacggtacgttcaacttcgacaactagtcgaacgtcgtacgccgtagccgtagttacgtagtaaacgttgttttacgactttaactttttagtaccgtagtacaacgtaacttaattaacgtaagttcgtaacggttcgtactacgtacttaccgtaaccgtacgggaccgtaaaggaccgagtacgtaacgggtaataaacgttaacgcgttaggtacgactacgacctaagtcttcgtcttaccg

SEQ ID NO: 123397 - DNA, 824 bp, Homo sapiens
  misc_feature: GYAE6OF01EL7E6.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctcgtccacgctgcagctgcaggagtcgggcccgaggacgtggtgaagccttcggagaccctcgtccctccacctgctattgtctctggcgacctccatctactacgttacttacgtggacgctcggtccgtccggcacgtcccgaagggaagggacgtggaggtggtagttgggttatacgtctattaacgacgtgggtacgacgaccgtaacgtaccgaaccggcccccttaccctactaacgtcggtaacgtaccggtaacgtacccgtaacccttaacgtttaccgtaacccgttaaacggaaccctaaaccggtaaccctaaaaaccggtaaaaccccgttaccgggttttacccttaacccccggtaacgttaaaaacgtcgtaagggttcccgttaacggtaccggacccgtacgtcggtaccggtaccggtaaccggtcccttacgtaacgttaccgttggtcggtacggtaacgttacgttttcggttaccgttttttaggggaacccggttttagggttaacccgggtcccggtttcggttttaccggaaccgttaccgggttaccggggggtaccctacccggggtaaaccccggttgggttaccccgtaaccccgtttccgttcccttaccggacccggtacccttacccggaaacccggttaacccggg

SEQ ID NO: 123398 - DNA, 697 bp, Homo sapiens
  misc_feature: GYAE6OF01C9RLW.22.73.G07.1.454.CMB.1.raw
  modified_base (166)..(166): a, c, t, g, unknown or other
  misc_feature (166)..(166): n is a, c, g, or t
  modified_base (201)..(201): a, c, t, g, unknown or other
  misc_feature (201)..(201): n is a, c, g, or t
  modified_base (414)..(414): a, c, t, g, unknown or other
  misc_feature (414)..(414): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccacgtggaagaaatagtgatgacgcagtcnccagccaccctgtctgtgtctaccgaaggggaaanacgcccaccctctccgtgacgagggccagtcaggtagtacgtacgacctaaactaacgttaggtccgtacggtaaccagacgaagacgaccgtggaccgacggcctcccgaggtcctctcaacttctagtggtacgtccttacgaaccgagggtaccctacgttggaccctccccgacgtaacggttcaggttcgccgtaaggtgggtaccgngggacaaggtcgttacacgtctaccgactatccgaagacacgccgtcgtacgtacgtacgtagtaagtttatttacgtacttacgttttacttacgttagtacctaagtaactaaagttaactaagttacgtacgttcggtttaactaccgtaacttacccgtaaccggttaccggaaccggtaaaccgggtaccgaaccggtaacggaaggtaaaccgttaaacgtaaacggtacgtagggtacggtacctacggaacctaccgtacttcgttcgttacccg

SEQ ID NO: 123399 - DNA, 643 bp, Homo sapiens
  misc_feature: GYAE6OF01D3BN3.22.73.G07.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctcaggggaaancgccaccctntcctgcagggccagtcagagtgtagacaaacaactttagctaggtaaccagacagagacctggccgacggcctcccaggcctccctactctcgtagtcggttcgtaccttacgtccgaacggtccgtactccggtacctccccggtaccgagtttcgaaccgtaggtcccggaacgttggggggtacccttagggggaacctacgaacgtttccgaacttacctactacccaagtccaaggcctaggccctagcagtactgttaaggatttgtctacgtttagttactagtacaacgtactaactaactaacgtaaccgtcggtaccgttaccgttacgtacgtttacgggaccgaacgggtaccgtaaggacgtaggtacgtaacgtaactaaacggtacgtacgtaggaccgtacgtactacctacttcgtcgtac

SEQ ID NO: 123400 - DNA, 791 bp, Homo sapiens
  misc_feature: GYAE6OF01BE705.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccagggactgggtgaacgtccgttcgggacgacccctgtccctcacctgctattgtctcgtcggcacctccatctacttacgttacacgtggacgcgtcggcctccggctacggtacccgaaggggaacgggtacgtgggaggtgggtagtttggggtaattacgtacttaacgttacgacggtcggggtacgccaaccggtaactaccgaaccggtcccccttaccctatacgtacgacggtacgacgtaccaccgtaactttacgaactaacgaccaaccgtaaccaaacgtaaccttacgttaccctacccgtaacgtaacgttagtacggttcctaggtccgaaccgtcgtacgggaccggtaccgtaccggtacccgttacttaacgtttacgtacggttacggtacgttaacgtttacgttttcggtttacggtttttacgggtacggtttaccggggttacccgtcccgggtttaggtttttacccggaaccggttaccgggtacggggaccccgttaacgggggtacccccttcgggtaccccgttacccggttacccgttacccgttaccgacccgttacccttaccccggaaacccggtaaccccggg

SEQ ID NO: 123401 - DNA, 688 bp, Homo sapiens
  misc_feature: GYAE6OF01COSIO.22.73.G07.1.454.CMB.1.raw
  modified_base (199)..(199): a, c, t, g, unknown or other
  misc_feature (199)..(199): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctaccgaggggaaanacgcccaccctctcctgccagggccagtcagtagtgtacgacaaactaacttagtctacggtaaccagcgaacggacgtaccgtggacccagggccctacccgaggtcctcctacgtattccgttagttcggggttctaccttttaccgaaccggtacgggccctaacggttacggttacccctaccccccggtcgttaacgggtttccgaacggttccgacccggttaggggttcggggtccgtaggggacctagggttacttccacgttccctacaacctactaccgacgcgacgtcccgtgacgtacgttcgtagtaacgttagtttacgtacttacttttaacttacgtcgtactagtactaattaagttaactcgtacgttagttaccgtactacttccgtaccgtacggaaccgtaacggtacacggtagtaggtaaactaacgttaaacgtgtggtcgacgtacgaccactactgttcgtac

SEQ ID NO: 123402 - DNA, 760 bp, Homo sapiens
  misc_feature: GYAE6OF01AO5GL.22.73.G07.1.454.CMB.1.raw
  modified_base (182)..(182): a, c, t, g, unknown or other
  misc_feature (182)..(182): n is a, c, g, or t
tcagacatacgcgtcacgaccggtgctcgatttagctctacgctcagggggagtaactgctcagttaggacccagacggaaccatggaagccccagcgcagcttctcttcctcctgctactctggctcccagataccactggagaaatagtgatgacgcagtctccagccaccctgtctgtntctccgaggggaacacgccaccctctcctgcagggccagtcagagtgtacgcaactacttagtctacggtaccagcagacgaccgtcggaccgacggcctcccgaggtcccttacctcctactccttagtcggtatcgtacctagttaccgttacgacgggtacccacgttcggcctaacctcccgacggccgtaacggttccgaacgggtcgggaccggagggtttcggggtaccgtacgggggaaccctacggtaccgtttacgacccgttaccctaccgtacccgtataccggacgtcccgtaacgtacccgttaacggaccgtaccgttaaggtaacgtttacgttttacgaaccgttttaagttttactttacgttacgtacgtacggtacgtaccgttaacgtaccgtaccctaacccgttccccgttaccgtaaccggggttaccgggtaccgggtaacccgggtaaccggttaacggggtacgtaaccggtaaacgtaacccggtaaacggtacggttcggtacgggtcccttaacggacccctaaccgttccgttcgttcccgttaccg

SEQ ID NO: 123403 - DNA, 511 bp, Homo sapiens
  misc_feature: GYAE6OF01CM5X9.22.73.G07.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcaggggccagtcagagtgttagcaaacaacttagtctggtaccagcagagacctggccaggctcccaggctcctcatctatggtncttcaccagggccatgtactccccgcaggttcagtcgccagtgggtctgggacagattcactctcaccatcagcagcctgcagtctagaagtattttgactactttattactgtacagacaatataatgtaacttggttactgtatctaaccttcgaccgaagggacacgactaggacgtaattaaaacggaactgtgctcgacacatctgttc

SEQ ID NO: 123404 - DNA, 602 bp, Homo sapiens
  misc_feature: GYAE6OF01BVSWP.22.73.G07.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (449)..(449): a, c, t, g, unknown or other
  misc_feature (449)..(449): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaacngccaccctctcctgcgagggccagtcagtagtgtacgacaactaacgttagtctaggtaccaggcaaggacgaccgtggaccgacggcctcccgaggtcctcctanattctagtggtctcttctaccgaggcctacgttcggtacctccccgacgtacggttcaggtcgccgtaggtcgggtcgtacgggactaggtacgttccacgtcctacgacctagtcagcgacgcctgcgtagtcgtagtaagttntttacgactttactttaattctacgtacagtactaattaatagtcgtacgttcgttactcgtactcctaccgtacggaccgaagggtaccaacgtacgtaagtaacgtaaagtaacggacgttcgaggtctacggtacatacttcgtcgttcc

SEQ ID NO: 123405 - DNA, 663 bp, Homo sapiens
  misc_feature: GYAE6OF01DA4XJ.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatggtcctgtcccagctgcagctgcaggagtcgggcccaggactggtgaagccttcggacgaccctgtccctcacctgctatttgtcctctggcgacttccaatccaacttacgttaactacgttggacgcgtggctccggctacgtcccgaagggaacggacgtggacgtggagtttggtatatcttattacacgtgggacacacgactacgacgcccctcctcatacgacgtacgacgtcactattcaactacgacacggtacaaacgacctagttacctacccgtagtaaacgtgaacggttctgtacgtaccgcgttacgaccgggaaccgaccgggtaccttacgttaaacgttacgtggtacgtaacgtacgttacgttttcggttacgttttttagggacgttcggtttaccgcggtttcgtttacgacgttacgggtcggggtaccgtacgggttaacccgttcggtaccctacggttcccttccgtacaccgtccccgtaccgaacccggtaacccggg

SEQ ID NO: 123406 - DNA, 631 bp, Homo sapiens
  misc_feature: GYAE6OF01CH6QQ.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtcctaccgaaggggaaacgacgcccaccctctcctgcacgggccagtcagagtgttagactaactacgttagtctagtacagcagagctcggcaggcctcccgaggcctccactactctagtcggtcgtctttaccgaacccgagggaccctacgtcggtaccgccccgtacgtacggttcaaggtccgacccgtaggttcggcgtacggggactaggtacgttcaccgtccaccgtaaccgatacccgagcctacgtcctggaccgtagttctaaggtaagttagtttcgactttaactttacttacagttacacgtacaaattacgtagtcgtacgttcgttactacgtacttaccgtaccgtaccggacgtaaaggaccgtacgaagtcggtaaacgtaacgtaacgtacgtggacgtcctacgtaccactacttcgtgttaccc

SEQ ID NO: 123407 - DNA, 973 bp, Homo sapiens
  misc_feature: GYAE6OF01CT2N3.22.73.G07.1.454.CMB.1.raw
  modified_base (202)..(202): a, c, t, g, unknown or other
  misc_feature (202)..(202): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccactggaagaaatgtgatgacgcagtctccagcccacctgtctgtgtcctaccgaaggggaaaanacgcccaaccctctcctggacgaacggggcctaggtcaaggtaggttgttaacggacctaaacgtaacgtttaggtccgtaggggtaacccaggaccgaaggtacggacccttcggggacccaacgggtaccctccccggaacgggtccctacccgttacgaactttaccgttaaggttcggggtccgttacccttttcccggaaacccggtaccgggggaccctaaccggtttcggggtaaaccccttccccccgggtaccgttacgggtttacccaagggttccggaccgttaaggggttccggggttacggttacgggggaactacgggttaacgtttcccgtaacccgtaccgttacccaaccgtaagtttaccccgaaagggtccccgtaaaccgggtccccgtacgggtacccgttaaggttaccgtttaaaggttaaacggtttaacgttttttaccccggaacgttttaaaccttttttaaactttacccggtacggttacccgtaaacggtaaccttaaaattttaaagtaaacggtttaccgtaacccgggtttttaggtttaccccgtacggttaaacccttttaccccgttaaccccgggtttaccgggaaacccggttaaaccggggaaaccttaaccggggtaacggttaacggggtaaaacttaaacccggttttaaaaacggaaccggtttagggtaaccggggtaccttaccgggaacccttaaaccgtcgtttccgtttccggtttaaccccg

SEQ ID NO: 123408 - DNA, 619 bp, Homo sapiens
  misc_feature: GYAE6OF01BDGIA.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagcaacacttgtctggtaccagcagacgacctggccaggcctcccaggcctcctcattctagtcggtgcctttccgtaccgagggtcctacgtggtactcccccgctaggttcagtcgccgaggtcgggtctggggactaggtagttccactcctacaccatcgagtccacggccttgccgtagttcgtagtaaacgttattttcggacctttatttttaacttcgttacgttacgaagtactaaattacttaatcggttaaccttgggttacctacgtacttacctacccgttcgggaaccgtaaaggggaccctacggtaaccgttggaacgttaaagttaaacggcttagggtcgaccgtcgaccgtacctacgttcttggtccc

SEQ ID NO: 123409 - DNA, 627 bp, Homo sapiens
  misc_feature: GYAE6OF01CPICU.22.73.G07.1.454.CMB.1.raw
  modified_base (199)..(199): a, c, t, g, unknown or other
  misc_feature (199)..(199): n is a, c, g, or t
  modified_base (355)..(355): a, c, t, g, unknown or other
  misc_feature (355)..(355): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggaagaaatagtgatgacgcagtctccagccaccctgtctgtgtctccgaggggaaancgccctaccctctcctgccagggcctagtcagagttgtacgcaaactaactttagtctcggtaacagtccaaggacgacctggccaaggcctcccgaggtcctcctcatctatggtcgcttcacgaggccactggtactccccgcaggttcagtcnccgtagtgggtctgggacaggtacgttcactctacgactatccagcacgccgtgactagtcgtagtaagtacgttttgaccttacgtttaacttaacttgtactaacgtactaaagtaattaagtacgtacgttacggtttacacgttattaccgtacccggttcggaaccgtaacgggtaccgtaacgtaaccggtggtaaacggtaagtttaaaaccggacgtttacggacggttactacgtacctaacctaacgttccgttggttaccc

SEQ ID NO: 123410 - DNA, 620 bp, Homo sapiens
  misc_feature: GYAE6OF01EQJT0.22.73.G07.1.454.CMB.1.raw
  modified_base (197)..(197): a, c, t, g, unknown or other
  misc_feature (197)..(197): n is a, c, g, or t
  modified_base (449)..(449): a, c, t, g, unknown or other
  misc_feature (449)..(449): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcgagggccagtcagagtgtagcaactacttagtctggtaccagcagacgacctggccaggcctcccgaggcctccctcatctagtggtcgtccttcgtaccgacgggcctacgttcggtacctcccccggactagggtttcaggttcgccgtaggggttcgggtcgtaggggactagtacgtttccaaccttcctaccaaccgtatcgacgcacgccctgctagtctaggaacgttntttcgaccttacttttattactgtacagtactaattagtaagtcgttaacgttggttctacgttacttcccgtaccggttaccggaccgaagggacctaccggacgttagggaaactaacgttaaaccggacttgggtacggcttacggacctaactcttgtcgttacccg

SEQ ID NO: 123411 - DNA, 743 bp, Homo sapiens
  misc_feature: GYAE6OF01AHMT2.22.73.G07.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (348)..(348): a, c, t, g, unknown or other
  misc_feature (348)..(348): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaancgcccaccctctcctgcagggccagtcagngtgtagacaactacgttagtctaggtaccagcagacgaccgtggaccaggcctacccgaggtcctcctctagtctagtggtctcctttacgaccggacgggtccctaacggtcggttaccncccccgtcgtacggttcgacggtcggaccgtaggggtcgggttcggtacgggaacgtaggtaacgttctaccctaccgtacaacccctataccgacggcacggtcccgtcgtcgtacgttacgttaacggtaaagtttacgttttcgtaacctttaactttttaacgtttaactttccgtacgtaacggtaacttaaagtttaattaaacgtttcggtaaccgtttacggtttaccctttacgtaaccgttaccgttacccggtttaacccgggaaccggaaaccgggtacgaaacccgggttacggtaacgggtaaacgtaaaccgttttaaaacgggacggtttacgtacggtacttaccggaccctaacccgttgtttccgttcgtttaccc

SEQ ID NO: 123412 - DNA, 658 bp, Homo sapiens
  misc_feature: GYAE6OF01CVQOR.22.73.G07.1.454.CMB.1.raw
  modified_base (325)..(325): a, c, t, g, unknown or other
  misc_feature (325)..(325): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaacgccttcggagaccctgtccctcacctgctattgtctctggcgactccatcactagttactactggagcgtcggctccggctacgtcccgaggggaacggacgtggagtggagttggtatatctattacgacgtggganccgaccgactaccacgtccccctcctctacgtcgacgtcgacgtctacctatttcaactagacaacgtacaaacgtacctacgttacctaccgtagtaaaccgtgtacggtcgtacggtacggacccgtgtcggaccggtaaccgacccggtcgttacttacttaccgtgtacgtcgtagttacgttttaggttcgttttagggactttagggttaccgtaccggttcgtttacgaaccgttcggtccggggtcctacggggtaacccgtcggtaccccgtaccggttccttacccggacgtaccgtcccctacccgtaaccggtaacccggg

SEQ ID NO: 123413 - DNA, 688 bp, Homo sapiens
  misc_feature: GYAE6OF01DSNMU.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatggtcctgtcccagctgcagctgcaggagtcgggcccaggactggtgaagccttcggacgacccctgtaccctcacctgcctattcgtctcgtggcgactccatcaactagttacacgtggagctcggcctccggcacgtcccgaaggggaacggactgggagttgggagtttcgggtaatctacgttattacgacgtgggacaccgaaccgtactaccaccgtcccctcctcagtcgacgtcgacgtcctaaccgtatttacaacgttacgacctaaccgtaaccaaacgtaaccgttacgttccgtacccgtacgtaaacgtaggtacgtcttggtacgaccgtcgtacgggaccgtacgaccggtccgttacttacgttacgtgtacgacgtacgtttagttttcgttgtttttagggacgtttcgggttaccggtccgttacggtttgaccggtttacggtacggggtaccgtaacggggtacccgttcggtacccgttaccgttaccctacgtaccgtaccgtcccgacccgtaaccggtaacccgg

SEQ ID NO: 123414 - DNA, 930 bp, Homo sapiens
  misc_feature: GYAE6OF01DZ22G.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccaggactggtagaacgccttacggacgaccctggtccctcaccgttgactattcgctctggaccactcatctacgttagttactacgtggacgtcgtggccgttaccggctaaccggtcccggaaggggtaacggtaccgttgggacggttaggtagtttcgggaattacgttacttaattaaccgtaggtacggggaactacccggtaacccgtaacgttaaccgtaccggtaccccccttccgaacgttaacgtacggtaaccggttaccgtaaccgttacctaaccgttaacggttttaccaaacgtaaaccgtaaccgttaaacccgtaacccgtaaaaacggttaacccgttaccggttttacccaacccgtttaaacgaaaaccggttcggttaaacccgggttaccgttacgggttaaccggaaccccgggttacgttacccgggtaccgggaaacccttaccccgggtttccgttaaaccgttaaccgtttaacgggttcgttaaccggggtaacgttaaggtttaaccgttttcggtttaaccgggtttttacgggaagggttttaccggtttaccgggccccgtttagggtttaaccgtaacccgtttaacggggtaccgggggttacccccggtaaacggggtttaccccgttaacgggttaccccgttaacccgggttttacccgtaccccgttacggtaaccccgttacccccgtacccgttaaaaaccccggggtccccggg

SEQ ID NO: 123415 - DNA, 704 bp, Homo sapiens
  misc_feature: GYAE6OF01EV3LL.22.73.G07.1.454.CMB.1.raw
  modified_base (197)..(197): a, c, t, g, unknown or other
  misc_feature (197)..(197): n is a, c, g, or t
  modified_base (325)..(325): a, c, t, g, unknown or other
  misc_feature (325)..(325): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccacgtggaagaaatagtgatgacgcagtctccagccacctgtctgtgtctccgaggggaanacgccaccctctcctgcgagggccagtcaggtagtgttagacaaactaacttagtctaggtaaccagcaagacgtacctgggcccaagggcctccccgaggtcctcctactactcgtagtcgggttcncctttccgtaacccggacgggtccctacgttcgggtaccctcccccggacgttagggtttccaggtcgacccgtagggttcggggtcgtaggggactaggtacgttccaacttcacaacctatccgaagccacgtcctgaccgtagttccgtagtaacgttagttttcgacctttaacttttaagttaccgttgtacagtacttaaagtattaagtcgtacgttacggtttctacgttacttacccgtacccggttaccgggaccgtaaagggtacccgtaaacggtacggttaacgggtaaacgttaaaacgttaaaccggtacggttacggtacggtccgtaacgtaccctaacgtttacttccggttcgttacccg

SEQ ID NO: 123416 - DNA, 744 bp, Homo sapiens
  misc_feature: GYAE6OF01D0E9C.22.73.G07.1.454.CMB.1.raw
  modified_base (360)..(360): a, c, t, g, unknown or other
  misc_feature (360)..(360): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccgttcggacgtacccctgtcccctcaccttgctatttcgtctcgtggccaccttcccaattcctaacttacgttactacgttggacgcgttggcctcccgggctacggtccccgaaggggaacgggactgggagttgggagtttggggtattagtctaattacacgtgggancaccgtactacacgcccctcctcatgagtcgacgtcacctatttcaactagaccacgtaccaaagaaccctgttacctacccgtagtaaaccgtggtaacggttcgtggtacgtaaccgtcgtcgtacgaacgacccgtaccgggtcccgttaacttacgtttacgtgtacggtaccggtaagttacgtttttacggttcggttttttagggacgggtttcgggtttaacccggtcccggtttaccggttttaacggtaccgttaccggggttacggggggaaccccgttaaccgggggttaaacccccgttcggggttccccgaaccccggtttccttaccccgttaccgtaaccgtcccccgtaacccgtaaacccccgggg

SEQ ID NO: 123417 - DNA, 779 bp, Homo sapiens
  misc_feature: GYAE6OF01D50CS.22.73.G07.1.454.CMB.1.raw
  modified_base (222)..(222): a, c, t, g, unknown or other
  misc_feature (222)..(222): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagacatacgcgtcacgaccggtgctcgatttagctctacgctcgaggggggaggaactgctcagttacggacccagacggaaccatggaacgccccagcgcagcttctcttcctcctgctactctggctccctagtttcagactaccagtggaagaaatagtgatgacgcagtcctaccacgccctacccttgtcctgtcgtcctaccgaaggggaaacncgccactaccgtcctacctggccgacgggcctagtacgaggtagttgtagcgagctagtcttacggccttacgggtaaccaggacctaacggaaccgtcggaccgacggccctaccgacggtcctacctnacttcgtaggtcggtnactacgtccgtaacggcggacctagtcgtactacccgacgtccgtaggtcgtaggcggcggtaggtcgggtcgtagggactagtacgttcaccgtactaccgaacctactcgaacgtccgacgttccgacggtactacggttactaaggttaaacgtttatttacggtacgttttaaggttttaaccttaggttacgtacgtaacctttaaccgtaaactttaaacgggtaaactttaccgggtacccgttacccgttaacccgggttaacggtttacggggtttacccgggaacccggtaaacggggtaacccgtaagggtaccggtttaacgggaaacgttaaacccggtaaaccggtaaaaacggttacggttaccgggttaacccggtcttaacccgggtaaccccg

SEQ ID NO: 123418 - DNA, 792 bp, Homo sapiens
  misc_feature: GYAE6OF01BFAFD.22.73.G07.1.454.CMB.1.raw
  modified_base (203)..(203): a, c, t, g, unknown or other
  misc_feature (203)..(203): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggagaaatagtgatgacgcagtctccagccaccctgtctgtcgtcctaccgaaggggaaacncgacccaccctctccgtgaccgacgggtccagtcaggtagttaggttacgacctaaactaacgtttacggtaccgttacgggtaacccaggaccgaaaggaccgtaacccgtcgggacccacggggtccctaccccggtaggtccccttaccccgtactaacgtttaccgttaaggtccggggttccctaccgttttacccgaacccggtacgggtacccctacggttacgggttacccctcccccggtaccgtacgggtttcaacggttccgaccggttagggttcgggtacgtaggacgtaaggtacttccacgtcctaccaacgtatccgaagccgtacgccgtcgactacgtacgtagtaacgttacgtttacgtactttaactttacgtttaccgttacgtacgtaacgtaacttaataacgttaacgtacgttaccggttacgttaccgttacgtaaccttacccggtaaccgttaccggaacccgtaacggtaaccgacggtaacggtacggtaaacgtaagttaaaccggacgttacgggtacgtaccgtacgtacctaacctacgttcgttcggttaccc

SEQ ID NO: 123419 - DNA, 665 bp, Homo sapiens
  misc_feature: GYAE6OF01AIBKC.22.73.G07.1.454.CMB.1.raw
  modified_base (198)..(198): a, c, t, g, unknown or other
  misc_feature (198)..(198): n is a, c, g, or t
  modified_base (432)..(432): a, c, t, g, unknown or other
  misc_feature (432)..(432): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaanacgcccaccctctcctgcgagggccagtcagagtgtagacaactacttagtctggtaccagcagacgacctggccaggcctcccgaggccttcctcacttctagtggtctcctttaccgtaccgagggtccctacgttcggtaccctcccccggacgtagggttcacggtcgcccgtagggttcggggtcgtacggggactaggttacgttccaaccgttcctaccaacccgtntaccgacggtccacgtccgtgaccgtagttcgtaagttaagtttctttcgtacctttacgttttacttaccgtgtacacgtactaatactaagtcgtaacttggttacctacgtacttccgtacccggttcggaaccgaacgggtacctacggtacgtaacggaacgttaaacgttaaaccggtcgttacggtacggtccgtacgacccgtaaccgtctttccgttcgttacc

SEQ ID NO: 123420 - DNA, 713 bp, Homo sapiens
  misc_feature: GYAE6OF01DMR9B.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccacccgtctcctgcacgggccagtcagagtgttagcaactaacttagtctaggtacagcagacgacctggaccaggcctcccgaggcctcctcactctatgggtcgtcctttaccgaccgacggggcctacgttcgggttaacctccccggtcctaagggtttccaggttcggacccgtaggggttcggggtccgtaggggactaacggttacgtttaccgaaccttccgtaccaacccgttagtacccgaacggcctaacggtcccctaggtaaccgtacgggtttacctaagggttaaagtttacgtttttacgacccgtttaactttttaacgttaccgtttacggtactaacggtaacctaaagtttaacgttaacgtacgttaacgttcgggttttacctacgttacgttacccgtaccgttacggaaccgtaacgggaccacggtacgtacggaaagtaaacgttaacggacgttggcggactcggaccactagtccttgttcccg

SEQ ID NO: 123421 - DNA, 656 bp, Homo sapiens
  misc_feature: GYAE6OF01BH2HX.22.73.G07.1.454.CMB.1.raw
  modified_base (199)..(199): a, c, t, g, unknown or other
  misc_feature (199)..(199): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcgagggccagtcagagtgttacgcaaacaacttagtctaggtaccagcagagaccgtggccaggcctcccgaggtcctcctcattctagtggtctcttaccgaccgacgggcctacgttcgggtacctcccccggacgtaggttccaggttcgccgtagggtcgggtcgtggggactaggtaccttcaccttctaccaacctatacgacgccgacgcctgactaggttctaggtaagttactttcggactttacttttaattacgttcgtacagtactaaattaataagttcgtacgtttcggttaccgttacgtacttacccgtacccggttacgggaacccgtaacggggacctaaccgggtacgttaagggaaacgttaacgttaaacgggtcgttcgggtacggtcgtacggaccctaactacgttcgttcgttacc

SEQ ID NO: 123422 - DNA, 590 bp, Homo sapiens
  misc_feature: GYAE6OF01D5Q7S.22.73.G07.1.454.CMB.1.raw
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
tcagacatacgcgtcacgaccggtgctcgatttagctctacgctcgagggggaggaactgctcagttaggacccagacggaaccatggaagccccagcgcagcttctcttcctcctgctactctggctcccagataccactggaagaaatagtgatgacgcagtctccagccacctgtctgtgtcncgaggggaancgccacctctcctgcagggccagtcagagtgtanacaactacttagcctaggtaccagccagacgacctcggaccaggcctacccgaggcctccctatatcttagtggtacgtctttacgaccgacggggtccctacggttcggtaacctcccccggtacgtacgggtttaccagggttccgaccgtaggttcggggtacctaggggaacctaggtcgttccaactctacaccaatcacgcagcctgcatctagtagtatttagacttatttatactacgtacacgtactaataatatagtacttgtactacgtattaccaccgttacggacgaaacggacacggagtagtaacgtaagtaacgtacgtagtgacttgacactactcttgtacc

SEQ ID NO: 123423 - DNA, 632 bp, Homo sapiens
  misc_feature: GYAE6OF01CO20I.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtagcaactacttagtctggtaccagcagacgacctggcccagggcctcccgaggcctcctacattcgtagtgggtcgtcctttccgtaccgacggggtccctacgtcgggttaaccctcccccggcgtagggtttccagtccgccgtaggttcggggtctggggactagtacgttccactctacacctatcagcagcctgacctagtctagtaagttacgttttgaccttacttttattaactgtacagtactaattaataagttgtaacgttggttacctgtacttacccgtaccgttccgggaaccgtaacgggctaaccgggtacgtacgggaaacgttaacgttaaacggtaccgttggtccggactacggaccctaccgtaacttgttcggtttaccc

SEQ ID NO: 123424 - DNA, 768 bp, Homo sapiens
  misc_feature: GYAE6OF01AK4TJ.22.73.G07.1.454.CMB.1.raw
  modified_base (193)..(193): a, c, t, g, unknown or other
  misc_feature (193)..(193): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatgtgatgacgcagtctccagccacctgtctgtgtctcgaggggaanagcccacctctcctgcgagggccagtcagagttgttagaccaactaacgttagtctacggtaccagccgagacgaccgtcgggcccgacggtcctcccgaggtccctcctcattctacgttggtctcctttaccgaccgtacgggccctacgttcgtaccgtccccgtaccgtaggttccgagtcgaccgtaggtcgggtcgtacggggacacggtacgtttaccgacctttaccgtccgtaacccgtagtacccgaacggtaccgtacggttcccgttacggtacccgttaacggtttcgttaaagggttaaacgtttagtttttacggtacccttttaaacgttttttaccgtttacgttacggttaacctaacggttacttaaaacgtttaacttaacgtcgggtttaaccgttttcggtttaacccgttacgttacttacccgttaacccggttaccggaaccgtaacgggaccgtacggaacgttacgggaaagttaacccgttaaacgacgggtttacggtcggttacgtacggtaacccctaaccgttactttccgttcgtttacccg

SEQ ID NO: 123425 - DNA, 876 bp, Homo sapiens
  misc_feature: GYAE6OF01BAWOC.22.73.G07.1.454.CMB.1.raw
  modified_base (99)..(99): a, c, t, g, unknown or other
  misc_feature (99)..(99): n is a, c, g, or t
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
tcagacatacgcgtcacgaccggtgctcgatttagctctacgctcagggtctccgaaggcttcaccagtcctggacctcctgtgcaagaacatgaaacntctgtggttcttccttctcctggtggcagctccagatgggtcctgtcccagctgcagtctgcaggngtcgggccaggactggtagaagccgttcgganacccttgtaccctnaccgttgactagtttcggtctcgttagggacctacctaccgtatacctaaccgttacgttaacctaacgtagggtacgtcgtcggcctttacccgggaccgttaaccggtaccccggaaggggaaacgggtaccgtacggggagttcggggtaatttagggggttaacttaacgttcgttaactttaaccgtacggtcgggacgtaccgtaaccgtaaacgttcccggaaccgtcccccgttccgttacggactttacggacggttaccgttaaccggtactaacccgttacgtttacgaacccgtttaagaccgttaccgttaaccgaaacgtacccttagttaccctacccgtaagtaaacgtcggtacgttacgttacggaccggtaccgtacgttacgggaccggtaaccgtaccgggtcccgtttaaaacggttcgtttaaccggtggtacggtaacgtaagtttccgtttcggttttaccgttttaggggtaacggtttaccgggttaaccggtccgtttaccgggtttacggaccgtttaacgggtcccgggggttaaaccttacgggggtacccctttaacggggacccgttaccccggttaactaccccggggttacaccccggttaaccgtaaccgttacccgggaaaccccggg

SEQ ID NO: 123426 - DNA, 796 bp, Homo sapiens
  misc_feature: GYAE6OF01BS0MP.22.73.G07.1.454.CMB.1.raw
  modified_base (144)..(144): a, c, t, g, unknown or other
  misc_feature (144)..(144): n is a, c, g, or t
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccagtgganaaatcgtgatgacgtcagtctccacgcctacctgtctgtntcctacgaggggaancgcccacctctccgngcgacggccagtcagtgtntagacctaatacgttagtcctagggtaccagtcgacgacgtacccgtaggccgtacggacctacccgacggtcccttccgtacacgttaccgtagttcggtacgttcctaccggtaaccggtaccgggtcctaacggttccggtaccctaccccggtccgttaaggttccgacggtcgtccggtagggttcgggtaccggacggtacgtacgggtacgttccaaccgtttccacctaacgtataccggacgtaccgtagtccccgtggtaacctacggttcgttaaagtacgttttacgttaccgttaccttaaacgtttttcgtaaaccgttcgtacccgtaagtactttaaaccttagttaacggttacggtagttttacccggcgtttacgtacccgtttaaccgtccccggttaaccgggacggttaaccccgggtaaccgtacccggttaaccgggtaacggttaaaccggttaaaccgtttaaacccgggtcgttaaacgggtcggtaacccttaccggacccttaaaggttcccgtttccgttaaccggtttcccc

SEQ ID NO: 123427 - DNA, 851 bp, Homo sapiens
  misc_feature: GYAE6OF01BPJ8X.22.73.G07.1.454.CMB.1.raw
  modified_base (143)..(143): a, c, t, g, unknown or other
  misc_feature (143)..(143): n is a, c, g, or t
tcagacatacgcgtcacgaccggtgctcgatttagctctacgctcagggtctccgaaggcttcaccagtcctggacctcctgtgcaagaacatgaaacatctgtggttcttccttctccgtggtggcagctccagatggtccngtcccagctgcagctgcgaggaggtccgggcccgaggacgttgggacgtaacgtccgttacgggacgtaccccgtcgtccctcgaccctgtctacgtttcgccttggtacggcctacctccaattcctaacttaacggttactacgtggagtcgtcggccgtccggctaccgtcccggaaggggaacggtcggtggagggtgtaggtttgggtaattattacgttaattacgacggtagggacaccgaaccggtaccttaaccgaccgtccccctacgtcctaacgtcggaacgtcgtaccggtactaccttacttaccgaaccgttaacgaaccctaaccgtaaacccgaaacgtaacccgtaacgttttcccgtaacccgttaaggtaaccggtggttaaaccgggttcttaacgggttacgacccggtacgtaccggggaaccgttaccggcccgggttaccttacgttaacgtttacggcggttacggtaccgttaacgttttagtttccggggtttacgttttacgggacggttttaaccggggttaccctccgggttttaacggttacggtacccgttttacgggtaccggggggtaacccgtacccggggttaaccccgtgggttaccccgtaccggttaaccccttccggtacccgttaaacccgccccgttaaacccgggacccgggttaaaccccggg

SEQ ID NO: 123428 - DNA, 615 bp, Homo sapiens
  misc_feature: GYAE6OF01A16QH.22.73.G07.1.454.CMB.1.raw
  modified_base (252)..(252): a, c, t, g, unknown or other
  misc_feature (252)..(252): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactgganctggcctccggcacgtcccaggggaagggactgggagtggagtttggggtattatcctaagttacacgtgggacgcaccgactacacgcccctcctcatgacgtcgagtcactattcactacgacacgtccaaacgacctagttctaccctagaacctgtacggtctgtcgaccgctagccggaccaccgggccgttactactttacgtgtcgacgtagtatttgtacgtttttgggacgtttgggttaccgtccggttcgtttacggtccgttacggtcggggtccctaacggggtacccgtcgggtccctacccggttccgttccctaccgaccgtcccctccgtaacccggtaacccggg

SEQ ID NO: 123429 - DNA, 634 bp, Homo sapiens
  misc_feature: GYAE6OF01CH27K.22.73.G07.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctntcctgcagggccagtcagagtgtagcaaacaacttagtctggtaccagcaagacgacctggccaggcctcccgaggcctcctcatctatggtgtccttacaccgagggtcccaacgttcggtacctcccccgacagggtttccaggttcgcccgtaaggtcggggtcgtggggaactaggacgtttccacttcctacaacctataccagcacggtcctgctagtctagaagttatttgacttacgtttattacgtgtcaagactaattaacgttaagtagtaacgtttacggtttactacgtaccttacgttaacccgttaccgggaaccggaaacgggacctaaccggtaacgtacgggaagttaaacttaaaacggtaacgttgggtacgggtactacggaccaacccgtatcgttcggttaccc

SEQ ID NO: 123430 - DNA, 648 bp, Homo sapiens
  misc_feature: GYAE6OF01CGH29.22.73.G07.1.454.CMB.1.raw
  modified_base (201)..(201): a, c, t, g, unknown or other
  misc_feature (201)..(201): n is a, c, g, or t
  modified_base (315)..(315): a, c, t, g, unknown or other
  misc_feature (315)..(315): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagactaccactggagaaatagtgatgacgcagtctccagcccacctgtctgtcgtctccgaaggggaaancgcccaccctctcctgcgagggcccagtcagtagtgttagacaactacgttagtctaggtaccagcagacgacctcggaccgaggcctcccaggcctcctcatctagtcggtcncttaccaccgacggtccctacgtcgggtacccttcccccggcgtaggtttccaacggtcgtacccgtaggttcgggttacgtacggggactagggtaccgttactaccgttcctacctaacccgtactcaacggccgaacgtccctacgacgtcgtacgttagtaagttagtttctacctttactttaattactcgtactcgaaactaattaagttatacgtagttcggttactacgtctaccgttccgtacggtaccaacgggtccaacgtgttacggaataacgttaaacggcgtagtacgtcgtacgacacctattccgtacgtttcccg

SEQ ID NO: 123431 - DNA, 583 bp, Homo sapiens
  misc_feature: GYAE6OF01AO0E4.22.73.G07.1.454.CMB.1.raw
  modified_base (418)..(418): a, c, t, g, unknown or other
  misc_feature (418)..(418): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagacccctgtccctcacctgcattgtctctggcgactccatcactagttacactggagctggctccggcacgtcccgagggaaggactcggagtggattgggtatatctattacactgggagcaccgactacacgcccctcctccatcgagtcgacgtcacctatttcactagacacgtaccaaagaacctagttctccctagaactgagtctgtacgaccgcncgacggacgaccggcgttctaacttactcggtgcgagtatttgtacgtttttgagttcggttacgtccggtcgttcgtacgttaccgtggggtacccgtacgggtacccgtcggtccgtacccgttccgttcccgtacaccgtcctacccgtaccgtaacccggg

SEQ ID NO: 123432 - DNA, 713 bp, Homo sapiens
  misc_feature: GYAE6OF01B6SUI.22.73.G07.1.454.CMB.1.raw
tcagacatacgcgtcacgaccggtgctcgatttagctctacgctcagggtctccgaaggcttcaccagtcctggacctcctgtgcaagaacatagaaacatctgtggttcttccttctcctggtggcagctcccagatgggtcctgtcccagctgcagctgcaggagtcgggcccaggactggtgaagccttggacgaccctgtccctcactgcattgtctcgtggccgactcatctaactagttacacgtggacgctggctccggacacgtacccgaagggaacggacgtggaggtggagttgggtatacgtctagttacacgtggacgaccaaccgactaccgaccgtaccccgttcctacgactggaacgtacgacgtctaacccgtctttaccgaactacgacctacgtaccaaacgtaaccctacgtttcccgtacccgtaagtaaaccgtcggtacggttccgtacgttaccggacccgtacgttccggaccggtaaccgtaaccgggtcccgtttagtaacctttacgtggtacgagttacgttacgttttggttaccgttttaggacggtttcgggttaaccgtccggtttcggtttacggaccgttacggtaccggggtacccgtaacggggtacccggttacggttccctaacccggttcctacccgtacgtacccgtcccctaaccggacccgtaacccggg

SEQ ID NO: 123433 - DNA, 712 bp, Homo sapiens
  misc_feature: GYAE6OF01EN7A5.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggagaaatagtgatgacgcagtctccagccaccctgtctgtgtctcgaggggaanagccaccctctcctgcagggccagtcagagtgttagcaactacttagctggtaccagcagacgacctggcccaggcctacccgaggtccttccctactattcgtagttgggtctccttacgtacccggagggccctacgttcggtaccctcccccggcgtaacgggttcacggtcgccgtagggttcgggtcgtagggactaggtacgtttcaccttctacccgaacctagtccaagccgtaacgtcccgttacggactacgttcgttaaggtaaacgtttatttttacgacctttaactttttaactttaacgtgtttacgaattacgtaaaatttacttaagtcgttaacggtttcgtttaccgtacgttaaccttaccgtaccccggtttacgggaacccgtaaggggtaaccctacgggtaacgttacgggtaaaactaaacgtttaaaacggaccggttcggttaacggaccgttaccggaacctacccgttattcccgttcgttaacccg

SEQ ID NO: 123434 - DNA, 723 bp, Homo sapiens
  misc_feature: GYAE6OF01CAURT.22.73.G07.1.454.CMB.1.raw
  modified_base (207)..(207): a, c, t, g, unknown or other
  misc_feature (207)..(207): n is a, c, g, or t
tcagacatacgcgtcacgaccggtgctcgatttagctctacgctcaggggaggaactgctcagttaggaccagacggaaccagtggaagccccagcgcagcttctcttccgtcctcgcttactctggcctcccagacttaccactggacgaaagtagtcgatgaccgcagtctccagccacctgtcctgtgtctccgagggtaaacncgccaccctcgtcctgccacgggccagtccaggtacgtgttaacgacaaactaaacgtttagggtactgggtaaccagtcgagtacggaccctgggacccaaggcctcccgaaggcctccgtccattcctagtcggtctcctttcaccgagggtcccacgttcgggtactcccccgacgtagggttcacggtcgccgtaggttcgggtactggggacctaggtacgtttcaacgttacctacgacctactcagccaacgtccctaggacctaacggttccttaggtaaacgtttcgttttacgaccttaacgtttttactaacgttgttacacggttactaaagttacgtaacgttcggtaacctttacgggtttacctacggtaacctttacgtaacccggtttccgggaaccgttaacggggaacctaacgggtacgttacgggtaactaaacggtttaaaccgtacgttgggtccgaccgtacaccggtaaccttacgttcccgttgttaccc

SEQ ID NO: 123435 - DNA, 775 bp, Homo sapiens
  misc_feature: GYAE6OF01C7Q1R.22.73.G07.1.454.CMB.1.raw
  modified_base (318)..(318): a, c, t, g, unknown or other
  misc_feature (318)..(318): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagagaccaccggagaagttgtgttgacactagtttccagcccacctgtctttgtctccgaggagacggccggcccaccctctccgtgcgaggccaatcgagagttattagcgtactacgtacgccgtaggtaaccaagacggacggccgtcggccgaggcctcccgaggtcctcctcagtgtatagtntcgtcttaccgaaaacggtccacgtcggactaccgtacccgacgtacccgtagggtttcgaggtacggtacgtacggggttcgggttcgttaaggggaaaacgtacgggttaacccctttacggtaacccttacccgtaccctaaaccgtaacttaacgaaaccgtaacgtcccgttaaggacccgtcccgtagaaccgttactttcgaacggttaccgttaagttttaccgtttagttaccggttacgaaccgtaccgtaacggtacccggtttaaacaacgggttccgtaaccccggtttccggttaccggtttacccggggacgggtaccgggacctaacgggtcggtacgggactacggtaacggaccggtaaggtaaccgttggtacgggacggttcaacccgttactcgttaaccgtcggttacctttaccgacccgtttccccgtacccg

SEQ ID NO: 123436 - DNA, 975 bp, Homo sapiens
  misc_feature: GYAE6OF01BJ5A3.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccaggactgggtgaacgtccgttcggacgacccgttcgtccccgtcaccctgactattcgtctcgtggcctacctccatcacttacgttactacgtggacgcgtcggccgttccggccgtaccggtccccggaagggggaacgggtacgtaggggtaggtcggtaaggtttacggggttaacttacgttaccgttaagttaaccgtacggttaaggggaccgtaccgtaacccgtaaccgtaacccgtaaccccggtcccccttaccccgtaccgtaacgttacggtaaccgggttacccgtaacgttacccgtaaacccttaacgttttacccgaaccgttaaaccggtaaacccgtacccggtaaacccgtaaaaccggtaacccgttacccggttttaaccccgttaaccccggttaaaggtaaaaacccgtttcggggtaaccggtttacccggttacgggtaaccgacccccgggttacgtaacccgggggtacccggtaacccggtaacccgggtttacccgttaacgtttaacgtttaaccggttcgggtacggttacggttaacgggttttacttttcgggttttaaccgggttttttagggtaccgggttttaccgggttaccccggtttaccgggttacggttttaccgggtaaccggtttaccggggttaccgggggtacccggtaacccggggttaaaccccggttcgggttaccccgttacccggttacccttcccggtacccgttacccgggtaccccctaaacccgggaacccggttaacccccggg

SEQ ID NO: 123437 - DNA, 584 bp, Homo sapiens
  misc_feature: GYAE6OF01BNAV7.22.73.G07.1.454.CMB.1.raw
  modified_base (198)..(198): a, c, t, g, unknown or other
  misc_feature (198)..(198): n is a, c, g, or t
  modified_base (401)..(401): a, c, t, g, unknown or other
  misc_feature (401)..(401): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcaacacttagtctggtaccagcagacgacctggccaggcctcccaggcctcctcatctagtggtcgtcttccgtaccgagggcctacgttcggtacctcccccgcgtaggtttccacggtcgccgtaggttcgggtcgtggggacaggtacgttcacttctcaacntcagcacgcctgctagtctagtaagttatttgaccttatttaacttacgttgtactagtactaattaataactgacttcggttacttacgtattccctaccggttcggaccgtaacggacacgtacgtaggtaacgtattaaacggacttggtacggctacgacctacctattcgtgttaccg

SEQ ID NO: 123438 - DNA, 690 bp, Homo sapiens
  misc_feature: GYAE6OF01C2IQR.22.73.G07.1.454.CMB.1.raw
  modified_base (261)..(261): a, c, t, g, unknown or other
  misc_feature (261)..(261): n is a, c, g, or t
tcagacatacgcgtcacgaccggtgctcgatttagctctacgctcagggtctccgaaggcttcaccagtcctggacctcctgtgcaagaacatgaaaacatctgtggttcttccttctcctggtggcagctcccagatgggtcctgtcccagctgcagctgcagggagtcgggcccaaggactggtgaagccttcggagaccctgtccctcacctgctatttcgtctctggcgactccaatcaacttagttactactgganctcggctccggctacgtacccgaagggaacggtacgtggagtggtaagttggtatactgtaacttacgacgtgggacacgaaccgtactacaccgcccctcctactagtcgacgtacgtacgtaccaacttacgtttacaactacgaacctaccgtaaccaaacgtaaccctagttaccctacccgtaaggtaaaaccgtggaacggttcgttggaccgtaacgcgtacgtaccgacggtaaccgacggtaccgttacttaacgtttaccgtggtacgaccgttaagttagttttcggtacgtttttagggagtttcggttaccggtcccgttgtttacggaccgttacggtacgggtacccgaaggggtaaccctcgggttacctaacccgttcgtaccctccgaacgtcccgtaccgtaaacccggg

SEQ ID NO: 123439 - DNA, 593 bp, Homo sapiens
  misc_feature: GYAE6OF01AQIPO.22.73.G07.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
  modified_base (398)..(398): a, c, t, g, unknown or other
  misc_feature (398)..(398): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgtagcaacacttagtctggtaccagcagacgaccgtggccaggcctcccgaggcctcctcatctagtggtcncttcctaccgagggcccacgtggtacctcccccggctacgggtttcaggttcgccgtaggttcggggtctggggacaggtacgttcacttctcaccntcagcacgcctgctagtctagtaagttatttcgcttactttacttactgtacagactaattataatgtacgttcggttctcgtacttccgtacccgttcggaccgtaacgggacctaacggtacgtagggtaacgttaacgttaaaccggtacgttcgggtacggcctacgcctaacccgcttccgttcgttacc

SEQ ID NO: 123440 - DNA, 768 bp, Homo sapiens
  misc_feature: GYAE6OF01EXSYI.22.73.G07.1.454.CMB.1.raw
  modified_base (136)..(136): a, c, t, g, unknown or other
  misc_feature (136)..(136): n is a, c, g, or t
  modified_base (741)..(741): a, c, t, g, unknown or other
  misc_feature (741)..(741): n is a, c, g, or t
tcagacatacgcgtcacgaccggtgctcgatttagctctacgctcagggtctccgaaggcttcaccagtcctggacctcctgtgcaagaacatgaaacatctgtggttctttccttctcctggtggcagctccagntgggtcctgtcccagctgcagctgcaggcggtccgggcccaggtactgggtacgaacgtccgttcggaacgtcccttcgtccctaccaccttgcttagttcgtctcgtcggaccactccatctacgttacgttactagtggacgtcgtcggccgtccgcgtaccgtcccggaagggacggtacgtggtacggtggtaggtttagggtattacgttacgtataccggtacggtcgggtacaccgaaccggttactacccgtaccgcccttcccagtacgtagtacgtaccgtacgtacctaaccgttacttaccgaacgttaaccgaccctaacgtaaccgaaacgtaacccttcgggtttacccctaccggttaaagtaaccggttggtaaccgttcgttacgtacggaccgtacgtccgggaaccggtaccgtaccgggttccttaacgttacttcggtacggagttaaccggttagtttaccggtttggtttagggtttacggtacggttccgggttacgttccggtttacgttccggtaaacggtccgggttaacgggcccgtaagggttaccctcgtaacccgtcgttacccgtccgtacncccgtttacacccgtaacccggtaccg

SEQ ID NO: 123441 - DNA, 944 bp, Homo sapiens
  misc_feature: GYAE6OF01EM9JZ.22.73.G07.1.454.CMB.1.raw
  modified_base (262)..(262): a, c, t, g, unknown or other
  misc_feature (262)..(262): n is a, c, g, or t
tcagacatacgcgtcacgaccggtgctcgatttagctctacgctcgaggggggagggaactgctcagttaggacccagacggaaccagtggaacgccccagcgcagcttctctcctcctgcctactctcggcctcccagtactaccgacgtagggaagtaaagtggtgtacgtacggaaccggcctaacggttccctacccgacgaccccctaccccgttggtccgttacgggttcgtaccgtaccgggaaagggggaaacnccgtacccctaccctcttccgcggacgtacggggacctaggtacgaaggtaggttacgttaacgaacctaaacgttaacgtttacggttaccgtaaccggtaacctaggacgaacggaacgtacccgacggacccgtacggccctacccgaacggtcccctaccttactacgttacgttacggttcggttaccgttaccgtacccggttaacccgggaccgggtacccgttaaccgttaccgggttaccccgacccccggtacggttaaccgggttcgaccgggtttccggaaccgggtttcggggttcggggtaaccgttacggggtaacgtaccggttaaccgtccctaaccgttacccctaacccaaaccgtacgtaccggaacgttccgaacccggtccgtcggtacgttaacggttacgttacggttaacgtttactttacgttacccgttttaacttttacgtaccgtttacgtaacgttaaccgtaattaacgtaagtttaccgtacggtttaccttacgggtccgttacgtaccgtaccgttacccggtaccggtaaaccggtaggtaacccgacggtaaacggttaacgggaaaccgtttaaagttaaccggtccggtaccggttacggtaccgtacctacccgtaacccttccgttaacgttccgtttaccc

SEQ ID NO: 123442 - DNA, 713 bp, Homo sapiens
  misc_feature: GYAE6OF01BSMRY.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggcctcccagactaccactggaagaaatagtgaatgacgcagtcctccagcccacctgtcctgtcgtctaccggaaggggaaacgcgcccctaccctctccgtgccgagggtccagtcaggtagtacgtagacaaactaacgttacgtacgtcgggtaccgagacgaaggaccggtaaccgtcggacccgaacggtccctacccggagggtcccttcctaccgtaacgttccgttagtcgggttactccgtttaccgacccgtacgggtccctaacgttccggttacccgcccccggtcgttaaggtaccgacggtcggaccggtaggttcgggtacggcgggaacgtagttacgtactaccgtcctactaacctactaccacggtctacggtccgtcgacctacggtacgtacgtaagttactttacgtacctttaactttacttacttacgtactaaggactaataagtaatcgtaacgttcgttacgtctaccgtcctaaccgtcggaacgacggtacacggagtacggtaactaacgtaacggtcgttacggcgtacgtacgacctagtacttcgttacttacccg

SEQ ID NO: 123443 - DNA, 802 bp, Homo sapiens
  misc_feature: GYAE6OF01A7RSW.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangcccacctctcctgcagggccagtcagtagtgttagaccaactactttagtctaggtaccagcagagacctggaccagggcctccgaggcctcctcacttcgtagttcggtactcctttaccgtaccgacgggtccctacgttcggtaccctcccccggccgttagggttccacggttccgaccgtaggggttcgggtacgtcgggaactaggtacgttcaacgttcctacccaaccgtattccgaacgggtaccacggtacccgtgtacccgtaggttacgtacggttaaaggttacgtttttacgtaaccctttaacgttttttaactttacgttacgttacctaacggttaacttaaactttaacgttaagttacggttaaccgttttacgggttttacccgttaaccggttaaccgttttaccccgtaacccgggtttacccgggaaaccggttaaaaccggggggacctaaaccggggttaaacgttaccgggggtaaaaaccgttaaagtttaaaaaccccgggacggtttaggggtaccggtaccggttaaccggttacccgtaaacccgtttaacgttcccgtttcgggtttaacccc

SEQ ID NO: 123444 - DNA, 667 bp, Homo sapiens
  misc_feature: GYAE6OF01CDKQP.22.73.G07.1.454.CMB.1.raw
  modified_base (195)..(195): a, c, t, g, unknown or other
  misc_feature (195)..(195): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
tcagacatacgcgtcacgaccggtgctcgatttagctctacgctcagggggaggaactgctcagttaggacccagacggaaccatggaacgccccagcgcagcttctcttcctcctgctactctggctcccagataccactggagaaatagtgatgacgcagtcctcagccaccctgtctgtgtctcgagggaancgccacctctcctgcgaggccagtcagtgtgtagactaaactacttagtctcggaccagcagtacgacgtcggaccaggcctcccgaggtccttacccgtctacgtcctagtgggttcgtcctttaccaccggacggtcctacggtcggttacccgtaccccgtcgtacggtttcncggttcgaccgtaggtcgggttgtacgggacgagtcgttcacgttcctacgactatacncgcgacgcctacgacgtcgtgtaagtaagttacgttttcgatttaacgttttagttactcgtactaacgtactaattaactaacgttacgtaccggttacccctacggttaaccgtttcggtttacggtaacccggaacgggtaaccgacggtacggtgtaaaccgacgttaaacggaaaccggtaacggttcggacgtcgtacgaccgtaactacgttacttccgttcttaacccg

SEQ ID NO: 123445 - DNA, 814 bp, Homo sapiens
  misc_feature: GYAE6OF01D9YJJ.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcgagggccagtcagtagtgttaagaccaaactaactttagtctaggtaaccagcaagacgaccgtggccacggcctaccccgaggtcctcctctactaccgtagttcggttcgtacctttccgtaacccggacggggtaccccaacggtttcgggtaaccctccccccggtacgtaacgggtttcaacggtcggacccgtaggggtttccgggggtacgtacgggggaaactacggttaacgttccaccttaccgtaccaacccgtaattaccggaagacccgtaacggtcccttacggaccgtagttacgttaacggttaaagttacgtttttacgaacctttaacgtttttaacgtttaccttaggttacctaacggtaacttaaacttaaagttaagttacgttaaccggttttcgggttaccttaccggtaactttaccccgtaacccggtttaccgggaaccggtaaaacggggtacccgtaaacccggttaacggtaacggggtaaaacgttaaaccggtttaaaaacgggtacggttacgggttacggtaccgttacgaaccctaacccgtttacgttccgttacgtttaccc

SEQ ID NO: 123446 - DNA, 674 bp, Homo sapiens
  misc_feature: GYAE6OF01BG4VV.22.73.G07.1.454.CMB.1.raw
  modified_base (160)..(160): a, c, t, g, unknown or other
  misc_feature (160)..(160): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (514)..(514): a, c, t, g, unknown or other
  misc_feature (514)..(514): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagagtggtcctgtcccagctgcagtcngcaggcgtcggccgaggtcgtggagaacgtccgttacggagtacccgtgtcccctcacctgctagttcgtctcgtcggctacctctatacgtactacgttacgtacgttcggacgcgtggtccgtccggacgtaccgtaccggaaggggacggtacgtgggaggttaggtagtttcggtaattacgtacgttagtaccgtgagggactccgaaccacgaccgacctccctctnagcgtacacgtnactactatcaactacgtacgacgacgaacgacctcgttcctacgtacgtaacgtagcgtacgttacgacgtacgacgtgccgtacgtaccgtacgtctaacgtgttagngtcgtagtttagttcgtttacggtttagcgttacggtacgtcgttcggttactacgggttagggtccggtaccgggtaaccgttacggtccgggttacctaccccggttaccgtccgttaaccgcccgttaccgtaaaccggtaccccggtaacccgggg

SEQ ID NO: 123447 - DNA, 962 bp, Homo sapiens
  misc_feature: GYAE6OF01AUYBS.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggacgtcgggcccatgacgtggtagaacgtccgttacggacgtacccttcgtcccctcacctgtctattcgtctcgtacgcctactccataccgtaacttacgttacttacgtggacgtcgtcggtacccgtccggaccgaccggtacccggaaggggtaacggtaccggttaggacggttagggtaggtttagggtacttacgttacttaacgtttaccgacgggttagggacgtaacccgtaacccggtaacgtaacccgtcccgtcccccgtttaccgaccgttaacgtacggtaaccgttaccggtaaccgttaccctaacccggttaactttaccccgtaaacgttaaaccgtaaccccgtaaccgtaaaccccgtaaacggttaaaccccctttaccggtttcccgtaacccggttaaacgtaaaaccggttcgggtaaccggtttacgtccggttacgggtaaccccgttcgtaccgggaccccggaacccggttacccggtaccgtttaacgttaaccgtttaccggttacggtacggttacgttaacgttttcgggtttttaaccggtttccggtttttaaagggtcccgggttttaacgggtttccccggtcggttttaaccgggtttacggttaaacccggggttacgggtaaccccggggttacccgggtaacccggggtttaaccccggttacccgggtttaacccccgttaccccggtttaccccgttacccggttacccctaaaccccgggtttccccccgtaacccgggtaaaaccccccgggg

SEQ ID NO: 123448 - DNA, 707 bp, Homo sapiens
  misc_feature: GYAE6OF01BP1JX.22.73.G07.1.454.CMB.1.raw
  modified_base (195)..(195): a, c, t, g, unknown or other
  misc_feature (195)..(195): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaancgcccaccctctcctgccagggccagtcagagtgtagcaacacttagtctggtaccagtcaagacgacctggccaggcctacccgaggcctcctcacttctagtggtcgccttaccgtacgacgggtcctacgttcggtacctcccccggcgtagggttcacgtcgccgtaggtcgggtcgtaggggacctaggtaccgttcgacttcctaccgaacctagtaccgacggacctacggtcccgtgtaccgtagttccgtaggtaaacgtttacgttttacgacctttaacttttacgtttaaccgttcgttacgaacgtacttaagttaactttaacgttcgtaacggtttacggtttaccgttaccgttaaccttacccggtttaccccggttaccgggtaacccggtaaacggggtaacctaccggtaacggtaagggtaacgttaaacgttaaacggtacgttcggtacgtacggttaccgacctacccgttattcccgttagttcccg

SEQ ID NO: 123449 - DNA, 755 bp, Homo sapiens
  misc_feature: GYAE6OF01CULKN.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggaagaaatagtgatgacgcagtctcagccaccctgtctgtgtctccgaggggaanacgccaccctctcctgcagggcccagtcagagttagtacgactaaactacttacggtctacggtaccaggtacaaggacgacctcgggccctaacggccttacccgacggtcctccgttcattcttagttcggtctcctttaccgtacccggtacggggtaccctacgttcgggttaaccctcccccgggaccgtacgggtttaccaacgggtccgtacccggtaaggggtttcggggttacgtacggggaactacgggttaacgttccgtacctaccttaccgaacctacttaccgaacgtccgaaccgtcccgtgtaccgtagttaccgtagttaaacgttagtttttcgtacctttaactttttaattaccgttacggtacctaagttacgtaaatttaacttaacgttacgtacgtttgggtttacctcggttacgttacccgttaccgttccgggtaaccaaacggggtacctaacgggtaggtacggtaaacgtaaacggttaaacggtaacgtcgttaggcctaccgaactcgtaacttcgttcgttaccc

SEQ ID NO: 123450 - DNA, 811 bp, Homo sapiens
  misc_feature: GYAE6OF01E4NL1.22.73.G07.1.454.CMB.1.raw
  modified_base (89)..(89): a, c, t, g, unknown or other
  misc_feature (89)..(89): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagacatacgcgtcacgaccggtgctcgatttagctctacgctcagggggagaactgctcagttaggacccagacggaaccatggaanccccagcgcagcttctcttcctcctgctactctggctcccagactaccacgtggaagaaatagtgatcgacgcagtcctccagcccaccctgtctgtcgtctaccgaaggggaanacgccctacctctaccgngccgagggcctagtcaggtagttgtaacgacaactacgttagtcgtacgtaccagcgaaggacgtacccgtggacccgtacggccctaccgacggtccctaccgtataccgttcgtagttccgggtacgtacccgtttacccggtaaccggacggtaccctacggttacccggttacccacccccggtggttaaccgggtttcaacgggttccgtaaccggtcggttacgggggttacccggaagggtaaccttacgggtaacgtttaccccaccggtttccttaaacccggaccctaacgtaccgacggtaccgtaccggtacccgtagtacgtaacgtttacgtaacggttaaactttcgtttacgttaactttacttttaacgttacgttacggtactacgtaataaacgttaataacggtcgttagtaccggttacgttaccgtaccttaacccgttaccgttaccgggacccgtaaacggggtccctaaacgggtaccggttaaacgaaacgggttaaagttaacccggtacgttacggtaacggtccgtacgtacctaccgtacgttccggttcttaacccgg

SEQ ID NO: 123451 - DNA, 902 bp, Homo sapiens
  misc_feature: GYAE6OF01C6YLZ.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatcgggtcctgtcccagctgcagctgctaggagtcgggcccaggtactggtcaggtccttcggacgtaccctgtccctctacctgcctattgtctcgtcggcgaactccagtccaacttagttacctacgttcggagtcgtggccgtaccggtaccgtaccgtacccggaaggggtaacggtaccgtaggacggttgggtaagtttcgggttaattacgtcgttaaacgtttaaccggtacggttacgggtaaccgaccggaaaccggtaccgttaaccgaacccgtcccccccgttaccgtacgtaacgttacggtaccggtaaccggttacccgtaaccgtaaccctttaacgttaccgtaaccgtaaacggtacccgtaaaccggtaacccgtaaaaacgaaaccccgtttacgttaccccgttaacccgtaaggttaaacccggtagggtaaaccgttacccggtttgggaaaccggtacccgggtacgttccggggaacccggtaacggtaccccgggtcctttaacccggtttacgttacggttcgggtaccggtaaccggttaggtttacgttttacgggttttcggtttacgggtacggttttaccggggttaccggttccggttaccgggttttaagacccgtttagggggtacccggggtaaccgtaacccgggttaccggttcggtaaaccgttccccggttaccgtacccgtacccggtacgttcccccctaaacggtaaccccgggttacccgg

SEQ ID NO: 123452 - DNA, 675 bp, Homo sapiens
  misc_feature: GYAE6OF01ARYIB.22.73.G07.1.454.CMB.1.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
  modified_base (624)..(624): a, c, t, g, unknown or other
  misc_feature (624)..(624): n is a, c, g, or t
tcagacatacgcgtcacgaccggtgctcgatttagctctacgctcagggggaggaactgctcagttaggacccagacggaaccatggaagcccccagcgcagcttcctcttcctcctgctactctggcctcccagataccactggagaaatgtgatgacgcagtcctccagccaccctgtctgtgtcacgaggggaaancgccaccctctccgtgccgacgggccagtcagtagttagtacgactaaactagtttagtctaggaccaggcagcgaccgtggccgcggcctcccgacgccttcccntacgtctaggtcggtctcctttaccgaccggtacgggccctaacggttccggttaccgtcccccggtacgttagggttcacggttcggacccgtagggttcgggttaccgttcggggaactacggttaccgtttccaaccttccgtaccctaacctagttccgaacgtccacgtccgttacggacgttacgttcgttaaggtaacgttttagtttacgtaacctttacctttttagtacgttcgtaccgacgttataaacttagtaacgttgtaaccgttcggttactcgtacttccgtaccgttagaccgtagcacgngtaggactaagtaaccgtgtcgtaggtactcgaacctatcttcgtcgttac

SEQ ID NO: 123453 - DNA, 736 bp, Homo sapiens
  misc_feature: GYAE6OF01AS6D5.22.73.G07.1.454.CMB.1.raw
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagacatacgcgtcacgaccggtgctcgatttagctctacgctcagggtctccgaaggcttcaccagtcctggacctcctgtgcaagaacatgaaacatctgtgttcttccttctcctggtgcagctcccagagtggtcctgtcccagctgcagctgacaggagtccgggcccaggtactgggtacgaacgtccgttacggacgtaccccgttgtcccctacacccgtgtctaagtttcgtcttccgtggaccgtaacctccattccgtaacgttacgttaacctgtggaacgtcgtcgccgtccggacctaccggtacccggaagggaacgcgtagggtaggacggtaggtttggaacttacgtttactaacgttacgaacggtggaccacgtaaccgtactaacgccgtcccctaccgtcgatcgagtccngtacctacttntacgacgtacgacccaacgttaccgaaacgacccttaggtcccttacgagtaaactcggtacgttcgtacgtacgaccgttccgtaacgggccggtaacgtaccccgtcgtaacgtttctaacggtcgtaccgtaagggtacttttacggtttcggtttcggtttaacgttcgggtaaccgttccggaccgtttgttaccggacgttacccgggtgggacccgttaacgggccggttcctacccgacctttcgtccgtaccacccggtcctaacccgaccgggtaacccgg

SEQ ID NO: 123454 - DNA, 799 bp, Homo sapiens
  misc_feature: GYAE6OF01ECXY7.22.73.G07.1.454.CMB.1.raw
  modified_base (199)..(199): a, c, t, g, unknown or other
  misc_feature (199)..(199): n is a, c, g, or t
  modified_base (317)..(317): a, c, t, g, unknown or other
  misc_feature (317)..(317): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggaagaaatagtgatgacgcagtctccagcctaccctgtctgtgtctacgaggggaaancgcccaccctctccgtgcgacgggccagtcagagtgttacgacaactaacgttacgtcgtacggtaccagacgaaggacgacccgtggcccgacggccctacccggacggtccttccnctacttacgttaggttcgggttcgtacctttaccgaaccgtacggggcccttacggttacgggtaccctccccccggtacgttacgggttactacgggtccgaccggttaggggtcgggttaccggtacggggaactacggttacgtttacccaccgttcctaaccgtacctactaccgaacgccgacgtccgttacgaccgtagtttacgtaggtaaacgtttcgtttttacgaacctttttaacgtttttaacctttacggttacgttaacctaacgttaaacgttaaattaagtttaacttaacggggttaccgttttacgggtttacccttaacggttacccttacccgggtaccgtttaacccgggaaccggtaaacgggaccgtaccgttaaagggtacggtaaacgttaaaccggttaaacggtcgggttacggtacgtacctcggacccttaaccgtctttcgtcgtttaaccc

SEQ ID NO: 123455 - DNA, 809 bp, Homo sapiens
  misc_feature: GYAE6OF01EX66N.22.73.G07.1.454.CMB.1.raw
  modified_base (196)..(196): a, c, t, g, unknown or other
  misc_feature (196)..(196): n is a, c, g, or t
  modified_base (802)..(802): a, c, t, g, unknown or other
  misc_feature (802)..(802): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatgtgatgacgcagtctccagcccacctgtctgtgtctccgaggggaaancgccctaccctctccgtgcgacggggccaggtcaagtaggttacgttacgactaaactaacgtttacgtcgttacgggtaacccagaccaaggtaaccgtacccgtaggacccgtaacggcctaccccgaggtccctacctacgtacttcgttacgtggggttctacctttccgaacccggacggggtaccctaacggttcggtaacccgttccccccggtaccgttaacgggtttcgaggtccgccggttacggggtttcggggtcggtacggggaacacggtacggtttccaaccttcctaccgaacctagtacccgaggacccgtacgtacccgttcgtacgtaacggttacttaacgggttaagttacgtttttacgaccttttaacgtttttacgttaaaccgtttacgttacgttaacggtaaccgttaaatttaaacgttaagttcgtaacggtttcggttacttaccgtaagttccccgttaacggtacccgggtaaccgtaaacggggtaacctaaccgggtacgtacgggtaaacgttaaacgtaaaccggttacgtaggttacggaccttacggaccctaccgttacttccggtnttacccg

SEQ ID NO: 123456 - DNA, 686 bp, Homo sapiens
  misc_feature: GYAE6OF01CP6SX.22.73.G07.1.454.CMB.1.raw
  modified_base (198)..(198): a, c, t, g, unknown or other
  misc_feature (198)..(198): n is a, c, g, or t
  modified_base (650)..(650): a, c, t, g, unknown or other
  misc_feature (650)..(650): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctcagccaccctgtctgtgtcctccgaaggggaaanacgccctaccctctcctgcgagggccagtcagacgtgttacgctaactaacgttagtctaggtaaccagcaagacgaccgtggccacggcctacccgaggtcctcctactactccgtagtcgggtctaccttccgtaccgacggggtcctaacgttcggtaacctcccccggacgtacgggtttaccaggttcgaccggtagggttacggggtccgtacgggggactaacggtacgttctaaccgttccctacgaacctatacgaacgccaacgtcccgttagacctaggttcctaagtaaacgtttacttttacgactttaaccttttaattaccgtacgtaccgtaagtactaaattaacttaagtcgttaacgttcggtttacctacggtaacttccgtaccgttacggaccgtaacggacacgtacgaggtaacgtaattaaaccggntagggtagtaccgtacacaccgtatccgttgttacc

SEQ ID NO: 123457 - DNA, 785 bp, Homo sapiens
  misc_feature: GYAE6OF01C9UJP.22.73.G07.1.454.CMB.1.raw
  modified_base (248)..(248): a, c, t, g, unknown or other
  misc_feature (248)..(248): n is a, c, g, or t
tcagacatacgcgtcacgaccggtgctcgatttagctctacgctcagggtctccgaaggcttcaccagtcctggacctcctgtgcaagaaacatgaaacatctgtggttcttccttctcctggtggcagctccagagtgggtcctgtcccagctgcagctgcgagggacggtccgggacccagggtacgtgggtaggaacgtccgttcggacgtaccccgtgtcccctcaccgtgctattcgtctcgnggcactccatctacgttacgttactagtggacgtcgtcggccgtccggacgtaccgtacccggaaggggtaacggtacggtagggtaggttgggtaacggtttagggttaacttaacgttacgttaaacgttaaccggtaacgggttacgggaaccgaaccgtaaacccgtaaccgtaaccgtaccccgtcccccgtcctacgacgtacggtacgtacgacgtaccaacttcttaccgaacgtacgaaccgtaccgtaacaaacggtacccttacgttacccgtaaccgtaacgtaacgtcggtaacggtcttgggaccgtaccgtcgacggccgtaccgccggtacttacgttattccgtggtacgtacggttagtttacgtttgggtttacgtttacgggaacgtttcccggtacggttccgttacggtttaccgtaaccggtccgggtaggggtacccgtaaccgggttaccgttcggtaaccctccgttccgtaccctacggacccgtacccctaccgtaacccgggtacccg

SEQ ID NO: 123458 - DNA, 627 bp, Homo sapiens
  misc_feature: GYAE6OF01EY9E2.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctccctgcagggccagtcagagtgttagcaaactacttagtcctaggtaccagcaagagacccgtggcccaggcctcccgaggcctcctctatgtatgatcgtaccgttaccgaaaacgggccacgtggacctacgtcccagccgtaggttcgaggtggcagggttcggtcgtagggaagacgtacttccactcaccaccaataccaactcgacctagacgtcctaggactattctgtacttagtttacttctgtacagactacgtacgtaaccgtaaggtccggtcccgttccggttaaccggtttcgggacccgggtaggggtacctaaggtcgttacggggactacggtaccgtaaggaaccggtacgtgggtacggaccgtacggacccgtaacctacgtttccgtggttacccg

SEQ ID NO: 123459 - DNA, 645 bp, Homo sapiens
  misc_feature: GYAE6OF01BHY99.22.73.G07.1.454.CMB.1.raw
  modified_base (326)..(326): a, c, t, g, unknown or other
  misc_feature (326)..(326): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgctattgtctctggcgactccatcactagttactacgtggagcgtggcctccggcacgtcccgagggaacggacgtggagtggagttgggtatatactattacgacgtgggacncgaccgactacgaccgcccctccctcacgtgacgtcgacgtccacctactttacaacgtacgacctaccgtaccaaacgtaacctacgtttcctacccgtaacggtaacctcggtacggttcgtcggtacgtaccgtcgtcggaccggaccgtaccggtccgttagttacttacgtgtcgtacggtattcgtttgttacgttttagggacgttcggttaccgtcgttcgttagtaccgtacggtcgggtaccgtacgggtacccgtcggtacccgtccgttccgtccgacgtaccgtccctacccgaccggtacccggg

SEQ ID NO: 123460 - DNA, 611 bp, Homo sapiens
  misc_feature: GYAE6OF01EW7IT.22.73.G07.1.454.CMB.1.raw
  modified_base (81)..(81): a, c, t, g, unknown or other
  misc_feature (81)..(81): n is a, c, g, or t
  modified_base (183)..(183): a, c, t, g, unknown or other
  misc_feature (183)..(183): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (456)..(456): a, c, t, g, unknown or other
  misc_feature (456)..(456): n is a, c, g, or t
tcagacatacgcgtcacgaccggtgctcgatttagctctacgctcagggtctccgaaggcttcaccagtcctggacctccngtgcaagaacatgaaacatctgtggttcttccttctcctggtgcagctcccagatgggtcctgtcccagctgcagctgcaggagtcgggacccaggactggngacgccttcgggactacccctgtcccctcacctgctattgctacgtgcgactccatcactagttctacgtggagcgtgcnccggcacgtcccgagggaaggcgtaggacgtggtagttcgggtatcgttactattacagtcgggnacacgacgtacaccgtcccctaccgtcagtcgtacgtcgagtacccacgtattaccgactaacgacctacgtaccaaacggaacctacgttcctaccgtacgtaactgtacggtcttagcgacgtcgngacgacgaccggtctcttaattccgtggcacgtagttacgtttcgtacgttttgggacttcggttacgtccgtgtttcaccggtagtccgggaccgtaacggtacccgtgtcccgcgttaccgtccgtacaccgccctacgaccccggtaccggg

SEQ ID NO: 123461 - DNA, 318 bp, Homo sapiens
  misc_feature: GYAE6OF01CBU3B.22.73.G07.1.454.CMB.1.raw
  modified_base (223)..(223): a, c, t, g, unknown or other
  misc_feature (223)..(223): n is a, c, g, or t
  modified_base (304)..(304): a, c, t, g, unknown or other
  misc_feature (304)..(304): n is a, c, g, or t
  modified_base (309)..(318): a, c, t, g, unknown or other
  misc_feature (309)..(318): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtcctccagtcccaccctgtcctgtgtcctaccggaaggggaaacacgccccaccctctccgngccgagggccagtcaggagttgtagactaaactaacgttgtcgtacggaccagcagacgactgacaggctccgagcctctnacttnnnnnnnnnn

SEQ ID NO: 123462 - DNA, 739 bp, Homo sapiens
  misc_feature: GYAE6OF01CNSQM.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggacgaccctgtccctcacctgcattgtctctggcactccatcacttagtactactggagctggctccggcacgtccccgaaggggaacgggacgtgggagtgggtagtttgggtatatcgttaattactacgtgggacgccaacccgacttaccacgtcccccttcctcagtgagtcggaagtccaacgtatttacaactagaacctacgtaccaaagtaaccagttacctacccgtagtaaactggtacggtactcggtacgtacccgcttacgggacccgggaccgtaccgggtacccgttacgtacgtttaacgttcggtacgtaacgggtagttaacgttttggtttaccgttttttaggggtacggtttacggggttaaccgttcccgggttccggttttacggtaccggtttaccggtcgggggtaccccgggtaacggggttaaacccccgttcggggtttaccccgtaccccggttttcccgttaccccgtaccgttaacccggccccttccccggtaaaccccgtaaaccccggggg

SEQ ID NO: 123463 - DNA, 695 bp, Homo sapiens
  misc_feature: GYAE6OF01BZAX3.22.73.G07.1.454.CMB.1.raw
  modified_base (483)..(483): a, c, t, g, unknown or other
  misc_feature (483)..(483): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatggtcctgtcccagctgcagcctgcaggcgtcgggcccaggactggtgaaacgccgttcggacgaccccgttgtccctcacccgtgcacgtttgtctcgtgggcacctccatacacgttagttacctagtggacgtccgtgccgttcggacacgtcccgaggggaacggtacgtggagtggtagttaggaatatctaagttacgagtcggacgacacggactaccgaccgtccctcctacgagtcgacgtcggacttaccaactctttaccaacgttaacgaccaacgttacccaaacgtaactacgtcctacctacgaacctgaacggtctacggtacgtacccgngtacggcgtaacggaccgtaccgttcgttaacttacgtaggtacgtcgttaacgttacgttttcggttacgtttttcgggaacggtttcggtaacccgtcgttcggttacgtaaccggtcgggaccgggtacccggaacgggtaccccgtcggttacccgacccgttccgtccctacgttaccgtccccgaacccgtaccggaaaccccggg

SEQ ID NO: 123464 - DNA, 684 bp, Homo sapiens
  misc_feature: GYAE6OF01CR493.22.73.G07.1.454.CMB.1.raw
  modified_base (164)..(164): a, c, t, g, unknown or other
  misc_feature (164)..(164): n is a, c, g, or t
  modified_base (352)..(352): a, c, t, g, unknown or other
  misc_feature (352)..(352): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatggtcctgtcccagctgcagctgcaggngtcgggcccaggactggtagaacgccgttcggacgaccctgtccctcacctgctacttgtctctcggcgacctccatctactagttactacgtggagtcgtcggccgtccggcgtaccgtacccggaagggaacgggacgtgggtacggtggtagttacggtattagttctaagttacacgtggtacnctaaccgactaccaccgccccctcctacatcgagtacgacgtccactacttcctaacacgacgtacgtaaccaacgaaccgtcgttaccgtccctaagaacctggtacgttcgtcgtacgaccgtgtcggaccgtaccgcggttccgtacttactacgtgcgtacggtagtttcgtttacggttgtttagggtacgttacgggttacgtccggttagtttccggaccgttcgggaccggggtaacccggtaccggtaacccggttccgggtacccgttcccgtttccctcccgtaccgaccgttacccccgttaccgaacccgggtaccccg

SEQ ID NO: 123465 - DNA, 722 bp, Homo sapiens
  misc_feature: GYAE6OF01B7X5G.22.73.G07.1.454.CMB.1.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
tcagacatacgcgtcacgaccggtgctcgatttagctctacgctcagggtctccgaaggcttcaccagtcctggacctcctgtgcaagaacatgaaacatctgtggttccttccttctcctggtggcagctcccagatgggtcctgtcccagctgcagctgcaggagtcgggcccaggactggtgaagccttcgganaccctgtccctcacctgctattgtctcgtggcacctccatccgacttagttactactggancgtggctccggacacgtacccgaagggaacggtctggagtggtagttagggtaatatctaattacgagttgggacaccaccgtaactaaccgaccgtccccctaccgtacacgtagtaccgtacgtaactaccgtaaccttaactttacgaactaacgaacccgtaaccgttaaccaaaccgtaaacccgttacgttacccttacccgtaagtaaaccgtacgggtaacggttcgttacgttacggacccggtctacgggaccggtaaccgaccggtacccgttactaacgtttaacgtgtacggacgtaagttacgtttaggttcgtttttaggaggtttacggttacgtaccggttcgtttacgacgttacggtcggggtaacccgtacgggtaacccggtcgtacccggtaccgtaccgttcccgtacgaccgtaccccgtcccggaaccgtaaccccggg

SEQ ID NO: 123466 - DNA, 711 bp, Homo sapiens
  misc_feature: GYAE6OF01BR6OE.22.73.G07.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccacgtggaagaaataggtgatggacgcagtcctaccagcccaccctgtcctgtcgtctacgaagggggaaacacgcccaccctctccgngaccgagggccagtcagagtntagcaacgattagcctggaaccagcagagaccgtggacaggcctaccgtacggtcctctacacttactagtaggtcgcgttaccctacggacggtcctaacgtggtaccctcccggaccgtaacggttcaaggttccgacgtagggtcggtgtacgggacacgtacgttcaaccgttctaccgacccctaagtccaacgacgtacgtacccgtcggtaccgtaacggttactaaaggttaacgttacgttttacaacgtttaacccgttttaattaccgttagtaccctaagtaactaaatttaagtaagttacgttaacccgtttaggttacctacgggtacctttacccgtaacgttacccggtaacggaaacggttaaccgtaccggtaagtaggtaaaccgtaaataacggtaacgttcggtaccgtacgttacgactaaccctacttccggttacttcc

SEQ ID NO: 123467 - DNA, 709 bp, Homo sapiens
  misc_feature: GYAE6OF01EIAKK.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcagggcggtccgggcccaggtacgttggtaggaacgtcccgtttacgggacgtaccccgttcgtcccctacaccgtgcctattcggtcctcgtggccgtacctccagtcctaacttagttacctacgtggagtcgtcggccgtcccggctaccggtacccggaaggggaacggtacgtagggtaggttggtaagtttgggtaattattaccgttaagtttaccgaacggtgggacaccgtaaccgtactaccgacccgtcccctacctctacgtagtacggtacgacgtccacgttacttacacgtacgactaccgtacaacgtacctacgtacctaccgtagtaacgtgtacgttcgtgacgtaccgcgtcgtacggaccgtaccggtcttactacgttctggtcgtaagtacgttcgtttgttggttttacggagtttccgggtaccgtccggttggttcgtaccgtcgggtaccgggtccgtacgggtacccgtcggtaccgtcccgttctccgtacacccggttccacccgggaccgtacccggg

SEQ ID NO: 123468 - DNA, 703 bp, Homo sapiens
  misc_feature: GYAE6OF01ENIX2.22.73.G07.1.454.CMB.1.raw
  modified_base (135)..(135): a, c, t, g, unknown or other
  misc_feature (135)..(135): n is a, c, g, or t
  modified_base (379)..(379): a, c, t, g, unknown or other
  misc_feature (379)..(379): n is a, c, g, or t
tcagacatacgcgtcacgaccggtgctcgatttagctctacgctcagggtctccgaaggcttcaccagtcctggacctcctgtgcaagaacatagaaacatctgtggttcttccttctcctggtgcagctccagntggtcctgtccagctgcagctgcgaggtacgtccgggccaggaccgttgggtagaacggtcccgttacggacgtaccccttgtacccctacaccgtgactacgttcgtcctcgtacggctaacctccatacctacgttaagtttacctagtggtacgcgttcggaccgtccggcgtaccgtacccggaagggtaacggcgtgggtagtagggtgtttaggtatactactattaccgagtggacnctaaccgtactaccgtaccgaccctctacgactcggactcggtactacacgttactactataacgacctacgactaacgtacctacgttctaccgtagtacgtgtacgtctacgtcgacgtcgacggtccgtaccgccggttcctaagtttacgttaccgtgttacccgtaagttacgttacgtttcgggttttagttccgggtatttaccgggtcttcgtttacgcgtaaccggttacgggtaccggtaccggtaaccggtcccgttacggacccgttcccaccgttccctacggtaccacccgttccccgaaaggtccccgg

SEQ ID NO: 123469 - DNA, 592 bp, Homo sapiens
  misc_feature: GYAE6OF01EVTD9.22.73.G07.1.454.CMB.1.raw
  modified_base (144)..(144): a, c, t, g, unknown or other
  misc_feature (144)..(144): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (546)..(546): a, c, t, g, unknown or other
  misc_feature (546)..(546): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccagtgganaaatgtgatgacgcagtcctcgacgccacctgtctgtgtcncgagggaancgccacctctctgcgacggcagtcaggtagtgtagacctaactactagtctacggaccagcaagacgaccgtggccgacggcctacccgagtcctcctcactcgtaggtgtcgtccttcgaccgcggtcctagtccgtcccgtccccgacgtaggttcacgtcgacgtaggggtggtcggtaggctaggtctacnctctaccactanacacgacgtctaggccacgtagtacttcgtcgctagttacgtttactacgttcgtcagacctgactaccgtactacggtacgtcccggttacgttcggttaccggttcggaccgggtacgacggtggtacggtaggacttacggngtaacggtatccggtgaccgtcgtacgcttattcgttgtccttacg

SEQ ID NO: 123470 - DNA, 789 bp, Homo sapiens
  misc_feature: GYAE6OF01E3ZF1.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctaccgaggggaaagcgcccaccctctcctgcaggggccagtcagtagtgttacgacaactaacgttagtcgtaggtaccagcaagacgtaccgtcggccgaggcctacccgacggtccctcctactacttcgttagtcggtcgttccttaccgtacccgacgggtccctacgttaccggtacccgtccccccggtacgtacgggtttccaacggttcggacccggtagggttcggggtaccgtaggggaactaacgggtacgttaccgtaccttccgtacccaacctactaccgtaacgtaccgtaccggtcccctagggtacctacggttaccgtaggttaaacgtttacgttttacggtaacctttacgtttttaaccgtttaccttacggtaacgtaaggtaactaaagttacgttaaagttcggttaacggtttcggtttaccgtacgttaacctaccccgtttaacccgggtaccggaacccggtaaacgggtaccgtaaccgggtaacggttaggtaaaccggttaaacgttaaacggtaaccgttgggttacggacttaccggtaaccctaaccgtcgtttaccgttcgtttacccg

SEQ ID NO: 123471 - DNA, 780 bp, Homo sapiens
  misc_feature: GYAE6OF01EVWID.22.73.G07.1.454.CMB.1.raw
  modified_base (158)..(158): a, c, t, g, unknown or other
  misc_feature (158)..(158): n is a, c, g, or t
  modified_base (161)..(161): a, c, t, g, unknown or other
  misc_feature (161)..(161): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagcctccagatgggtcctgtcccagctgcagntgngaggagtccgggcccagggtactgggtagaacgtcccgtttacgggactaccccttggtcccctcacccgttggaccttagttcgtcttaccgtggtccgtaccctccgtatccgtaacgtttaccgttaactacgttggacgtcggtcggtccgtacccggtccgaaccggttaccccggggaagggtaacggggtaccgtgggaacggttagggtacggtttaggggtactttaagttccgttaacgttaccgaacggttcggacacgaccgtacctacgaccgtcccctacgactcggtcgtacggacgtacgtacctaccttagttccaacgttacgaccctaccgtaacgaaaccgtaaccttcgttacgacccgttaagaactcggttacgtacgttcgtacgtccgagttcgaaccggtacgtccggtacctacgttacgtttacgtggtaacgcgttacggttatttcggtttaggtttaccggtaggttccggttacggttccgttaaaggtttccgggatttaccggggacggtaccgtacgggtaacccttccgtccgtacccgtcttcccgtaccgaccgtaccccggttccgaacccggtacccgg

SEQ ID NO: 123472 - DNA, 791 bp, Homo sapiens
  misc_feature: GYAE6OF01AUYC9.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtgttcttccttctcctggtggcagctcccagatgggtcctgtcccagctgcagctgcaggacgtccgggccaggactggtcgaacgtccgttacggactacccctgtccctacaccgtgcctagttcgtctcgtcggcctaccttccattcctaactttacgttacctacgtggacgtcgtcggtcctcccggctaccggtacccgaaggggaacggtccgtagggacgtgggtagttgggtaatcgttacttacttaacgcgtgggactcaccgtaactaccgccgtacccctcctacgagtcggaacgttcgacgtacccaaccttacttaccaacgtaacgtacctaaccggtaaccaaaacggtaccctacgtttaccctaccttaacgtaaccttgggtaaccgttcgttacggtacggtacccgtacggttacgggaccgggtaacccgtaccgggttaacccttacgtttaaccgttacgtcgggtaaccgttcggtaacggttttacgtttcgggttttacggttttggtacggttcgggttacccgtccgggttacgtttacggaccggttaccggggttaccgggacccggtaacgggttacccgttgggttacccctaccggtttccctacccgacccgtacccggttccctaaccccggtacgggtaacccccggg

SEQ ID NO: 123473 - DNA, 732 bp, Homo sapiens
  misc_feature: GYAE6OF01AJNKP.22.73.G07.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagacatacgcgtcacgaccggtgctcgatttagctctacgctcagggggaggaactgctcagttaggacccagacggaaccatggaagccccagcgcagcttctctcctcctgctactctggctcccagataccactggagaaatgtgatgacgcagtctccagccaccctgtctgtgtctccgaggggaacncgcccaccctntcctgcgaggccagtcagagtcgtacgccaactacttagtctacggtaccagcagacgaccgtggccgcggcctccgacggcctccgtactacgtctagtcggtctccgttccgaccgtacgggccctacggtcggttacccgtcccccggtacgtacgggttaccacggttaccgcccgtaggggttaccgggtccggtacgggaacctacggttaaccgtttcccgtaaccttacccgtaccgtaaccgtacgtaccgaacgtcccggtaacgtcccgttaggaccgttaaccggttacgttaacgttaaggttttactttaccggtaaccttttacgttttaaccgttacgttaccgtacgtaacgtaaccttaagttaacgttacgttccggttaacgtttcgttccgtaactaccgttaccggtacccgttacgaacggtaacgaccgtaacggtacgtagtacgttaaacgttacggtcgtcggttacgccgtacgtaccctatacttgttccgttaccg

SEQ ID NO: 123474 - DNA, 684 bp, Homo sapiens
  misc_feature: GYAE6OF01BSR18.22.73.G07.1.454.CMB.1.raw
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggacgtcgggcccaggactggtgaagtccttcggagtaccctgtccctcacctgctattcgtctcgtcggccgtacctccgattaccacgttacgttaccttacgtggacgccgtggtccgtccggcacggtacccgaggggaacggacgtgggagtggagtttgggtattacgtctacttacgacgtgggacnccgtaccgactacgccgcccctccnagtgagtcgacgtcacctattcactacgacacgtaccaacgtaacctcgttcctaccgtacgaacgtggtacgttctaggtaccgacgtcgtcggcgtaccgccggtaccgttacttacgttacgtgtacgacgtagttacgttttcgttacggtttttgggacggtttacgggttacggtccggttcggtttaccgtaccgttacgggttccgggacccggtaaccggggtacccgttcgggttaccctacccgttccgttcctaccgtacccgtcccctacccggaaccggtaaccccggg

SEQ ID NO: 123475 - DNA, 724 bp, Homo sapiens
  misc_feature: GYAE6OF01DLKJC.22.73.G07.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagacatacgcgtcacgaccggtgctcgatttagctctacgctcagggggaggaactgctcagttaggaccagacggaaccatggaagcccagcgcagtcttctcttcctcctcacctactctggctacccagactaccagtggaagaaatgtgacgtgacgcagtccacagtacctaccgtgtcctgtcgtctacggagggaaacaccgcctacccttcnccgtagacaacgggccngttacaggtagtntaggactaaactacgttgccgtggaaccgagcgaagtacgactacggactaacggccttaccggacgtcctacctcgtaacttcgttaaagttcggttgtaccgttttacgaacccggtacggtacccgttaacgtaccggtttaaccccgaccccgtaccgttaaaacgggttccttaaccggacgtaccggtaagggttcggggtacgttaccggggaactacggtacggttaaccttacctacggttacacctacgaacgtaagcctacggacctcgacgtactacggtacgtagtaactttaggtacctttattacgttactagtacgactaataacttaatacgtattacggttacggtttactacggttataccgaccgtttacggaccgaacgtaccgaacggtacgtaggtaaaccgtaaaggtacgtaaagttcgcgtacgtccgaactctactcgtattacc

SEQ ID NO: 123476 - DNA, 700 bp, Homo sapiens
  misc_feature: GYAE6OF01CHPFQ.22.73.G07.1.454.CMB.1.raw
  modified_base (202)..(202): a, c, t, g, unknown or other
  misc_feature (202)..(202): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggaagaaatagtgatgacgcagtctccagcccaccctgtctgtgtctaccgaaggggaaancgcccaccctctcctggcgagggccagtcagtagtgtacgacaaacgtaattgtcgtacggtacagcgaaggacgaccgtcggaccgtacggaccctccgacggtccctcctacacttcgtacggttcggtctacctttaccgaccgacgggtcctacggttcgtacccgtccccgtacgtacggttcgacggtcgaccggtggttgggtccgtacgggaactacggttaccgttcaccttccgtaactaccgtacgtaccgacgtaccgaccgtcccgtagaccgttacggttacgttaacggtaacgtttacttttacgacgttttaactttaacgtttacgtacgtactaacgtaactaattaacgttaagtacgttacgttacgttcgtacgtacttaccgtccggtacgaaccggtaggacctacggtagtacggtaacgtaacgttaacggcgttcggtaccgactaccgacctaatcgttcgttgttcccc

SEQ ID NO: 123477 - DNA, 853 bp, Homo sapiens
  misc_feature: GYAE6OF01CI66Y.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagattgggtcctgtcccagctgcagctgcgaggacggtccgggacccaggacgtgggtagaacgtccgttcggaccgtaccctcgtcccctcgaaccgtgaccttagttcgtcctcgtcgggacctacctccatccaacgttgttacctacgtcggacgtcgtcggtccgtaccggacgtaccggtaccggaaggggtaacggtacggtagggtaggtagggtagttacggttatacttacgttaacgtacgtacggtacggacgaccgtaaccgtaccgtaccgtaccccgtcccctaccgtacgtacgtacgtacgtaccgtaccgtaccgtaaccgttacttaaccgtaacgtaacgtacccgtaaccgtaacccgtaaacgtaaccgttaccgttacccgtaaccgtaacggtaaccggtcggttacggttaccgtacggtaccggtccgtacggtaccgggtaccggtaaccggtacccggttacgttaccgttacgttacggtacgttacggtacgtttaggtttcgttttacgggtttacggtttacggttacgggttaccggttaccgttccggtttacggttaccggtaccgggttaccgggtacccgggtaaccggtacccgggttacccggttacggttacccggtacccgttacccgtacccgtaacccgtaccccgttacccgtaaccccggtaaaccggtaccccg

SEQ ID NO: 123478 - DNA, 654 bp, Homo sapiens
  misc_feature: GYAE6OF01BXE34.22.73.G07.1.454.CMB.1.raw
  modified_base (152)..(152): a, c, t, g, unknown or other
  misc_feature (152)..(152): n is a, c, g, or t
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
  modified_base (433)..(433): a, c, t, g, unknown or other
  misc_feature (433)..(433): n is a, c, g, or t
  modified_base (474)..(474): a, c, t, g, unknown or other
  misc_feature (474)..(474): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtnatgacgcagtcnccagccacctgtctgtgtctacgaggggaaanagccaccctctcctgcacgggccagtcaaggtagtcgttacgactaacaacttagtcctagggtaccagcaagacgaaccgttggccaggcctacccgacggcctccgtcactactagtggtcgctttcctaacgacggcctactggtactccccgcgtacggttcaggttcgcgtaggtcgggtcgtcgggacgaggtagttaccactccgtactacaactcgagcaagtccgtanctagtctagtaagtaatttcgacttatttacttactgtacngtaacaaattaataagttacgtactttaggttaccgtacttaccttacgtacccgttacggaaccggtaaacgggtaccgacgtaacgggtacggaaacgttaaaccggtttaaaacccggaaacgttgttaccgggacttacggaacccaacccgtaacgtttccgttggtttaacccc

SEQ ID NO: 123479 - DNA, 882 bp, Homo sapiens
  misc_feature: GYAE6OF01DFDNF.22.73.G07.1.454.CMB.1.raw
  modified_base (123)..(123): a, c, t, g, unknown or other
  misc_feature (123)..(123): n is a, c, g, or t
  modified_base (251)..(251): a, c, t, g, unknown or other
  misc_feature (251)..(251): n is a, c, g, or t
tcagacatacgcgtcacgaccggtgctcgatttagctctacgctcgagggggaggaactgctcagtaggacccagacgaaccatggaacgccccagcgcagtcttctcttcctctgctactcncggcctaccagactaccaagtggaagtaaatggtagactgacgactggtcctaccgagcccctacccttgtcctggtacgttaccgaccggaaagggggaaactaccggacccctacccgttctccgnggaccggagggacccaggttagaaggtacgttagttaaacgaaccttaaaccggtaaacgtttcgggtactaacggtacccgaagaccgaaggtaccgaccgtacgaccgtaccggtaccgtcccgaacggtacctccgtactacttactagttcggtctaccgttaccgtaccggaccgtaccgtacggttaccgtacctacccccggtagtaccggtttacagtaccggtacggtgggttacgggtaacggttacggggacttaaagggtacccttacgacccgttacgcctaaaaccgtcgtaaccgacgaccgtacgtacccgtaacgtcgtacgtaccgtaaggttaaacggtttaacctttaggtttaaaccctttagttttaaaccggttaacctttacgaaaccgggttaattaaaacccttaaagttttaagtaaccgtttaccgtaacggttttacggttaccgtaacggttaacccgttaccccgggttaccggttaacccgggaaccggtaaacggtaaacccgtacgggtaaacgtttaaggggtaacccttaaaacggttaaaccggtaacgtcggtacgggtacctctaaacccggacttcgtttactcgttaacc

SEQ ID NO: 123480 - DNA, 714 bp, Homo sapiens
  misc_feature: GYAE6OF01EM1IW.22.73.G07.1.454.CMB.1.raw
  modified_base (704)..(704): a, c, t, g, unknown or other
  misc_feature (704)..(704): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccacctgtctgtgtctaccgagggaagcgccaccctctcctgcgacggccagtcagagtgttacgactaactaacttgtctggtaccagcagacgaccgtggccaggcctcccgaggtcctcctacactctagttcggtcgtccttacgtaccgacgggtcctacgttcggtacctccccgtcgtacggttcacggtcgaccgaggttcgggtccgtagggactaggtacgttaccacgttcctaccgtaacctacgtaccacggacctacgtcccgtaggcctaaggttccgtaaggtaagttacttttacgacctttaacgttttaacgtacgttcgtactacgtaaaccttaaagttaagttaacgtcggtttacgttaccgggtttcgtaaccgtaaccgttcccgttaaccccggtaccgaacccgggtaaaggtacccgtaaacccggtagttaaggggtaaaccttaaagggtttaaaccggagtttccgggaagtccgtaccgtaaccctaccctaattttccccggngttttaaccc

SEQ ID NO: 123481 - DNA, 806 bp, Homo sapiens
  misc_feature: GYAE6OF01A5O0U.22.73.G07.1.454.CMB.1.raw
  modified_base (147)..(147): a, c, t, g, unknown or other
  misc_feature (147)..(147): n is a, c, g, or t
  modified_base (160)..(160): a, c, t, g, unknown or other
  misc_feature (160)..(160): n is a, c, g, or t
  modified_base (198)..(198): a, c, t, g, unknown or other
  misc_feature (198)..(198): n is a, c, g, or t
  modified_base (299)..(299): a, c, t, g, unknown or other
  misc_feature (299)..(299): n is a, c, g, or t
tcagacatacgcgtcacgaccggtgctcgatttagctctacgctcagggggaggaactgctcagttaggacccagacggaaccatggaagcccccagcgcagcttctcttcctcctgctactctggcctcccagataccacgtgganaaatgtgatgacncagtcctccagccaccctgtctgtgtctccgagggaancgccacctctcctgcgaggccagtcagagtgtacgacaactaacgttgtcctaggtaaccagacgaagacgccgtggccaggccctaccgagtcctcctanactctagtcggtcgtccttacgaccgagggtccctacggttcgtacccgtcccccggtacttagggttaccacggtcggaccggtagggttcgggttccggaggggactaacgggttacgtttacccgaccttaccgtacctaacccgtacgtccgaacggtacccgtaccgtccgtacggtaccgtaggttcgttaaaggtaacgttttacgtttacgtaacctttaccgttttaacgttaccgttacgttaccgtaacgtaacctttaaagtaaacgtttacgttacggttaaccggttaccggtttacccgtaccggtttaaccgttaccccggttaaccgggttaaccccgggtaaccggtaaacccgggtaacggtaaccggttaaccggtaaacgggtaaaaccggttaaacgttaaacccgggttacgtttaaccgggttccggtaacccgttaacgggacccttaaccccggtttagttaccgttccggtttaaccccg

SEQ ID NO: 123482 - DNA, 790 bp, Homo sapiens
  misc_feature: GYAE6OF01AQ1B9.22.73.G07.1.454.CMB.1.raw
  modified_base (138)..(138): a, c, t, g, unknown or other
  misc_feature (138)..(138): n is a, c, g, or t
tcagacatacgcgtcacgaccggtgctcgatttagctctacgctcagggtctccgaaggcttcaccagtcctggacctcctgtgcaagaacatgaaacatctggtggttcttcctttctcctggtggcagctcccagntgggtcctgtcccagctgcagctgcaggacgtccgggcccaaggtctggtagaacgccgttacggacgtaccctcgtccctcactgctagttcgtctcgcggacgacctacactactacttagtttaccacgtaggacgtcgtacggccgttccggaccgtaccggttacccggaagggggtaacggtacggtggggtaaggtagggtacgtttgggtaactcgtacttaacgtttacgaggtcgggactaccgacccgtactaccgacccgtcccgtcctacgaagtcgtacgtacgaccgtaccgtaactttacttaacgtacgaaccgtactaaccggtaaccaaacggtaacccttcgtttaccctacgtaaagtaacgttcgggtaccgttcgtacggtaccgtacccgtacgaccgggtaccgacccggttaccggtaccttacggttacgttacggtcgggtacttacggtaactttgtttaccgttttggtttacgggttacgggtttaccggtttaccgcccgggttttagttaccgttaccgggtaccggggtacgggacccggtaaccgggttacccgttcggtaccccgtacgtcccttacggtaccctcccgttacccggaccctaccgggttacccgg

SEQ ID NO: 123483 - DNA, 684 bp, Homo sapiens
  misc_feature: GYAE6OF01CDWPA.22.73.G07.1.454.CMB.1.raw
  modified_base (158)..(158): a, c, t, g, unknown or other
  misc_feature (158)..(158): n is a, c, g, or t
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (340)..(340): a, c, t, g, unknown or other
  misc_feature (340)..(340): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
  modified_base (480)..(480): a, c, t, g, unknown or other
  misc_feature (480)..(480): n is a, c, g, or t
  modified_base (545)..(545): a, c, t, g, unknown or other
  misc_feature (545)..(545): n is a, c, g, or t
tcagacatacgcgtcacgaccggtgctcgatttagctctacgctcgaggggggagaactgctcagttacggacccagacggaaccatggaacgccccagcgcagccttctcttcctcctgctactctggcctccagactaccactggaagaaatagtnactgacgcagtcncacgccaccgtgtctgtgtcctacggaaggggaaacncgccctaccctcgtcctgacgacggacagtcgaagtagtgtacaccaaacgtacttacgcgttacggaccagacgaaggaaccggtaccgtacgggaccctacgggtacctcccgaggtcccttacccctanaatttccgtagttggtacctctttaacccgaccggacggtccttaacgtcgttaaccccncccggtaacgtacggttacncggtaccgccggtagggttggacggtcggaactacggtaccttacacttccgacacgtanacagccacgtcccaggtactacgtacgtaggtacttacgtttactactttacgtttacttacgtntacgtaatactaaatagttactacgtagtcgttactacgtataccgtaccgttacggaacgaacgtcgtacgtaacgtaggtaaacgaacgttaacgacgtggtacgtacgtacaaccgttataccgttgtcgttaacc

SEQ ID NO: 123484 - DNA, 737 bp, Homo sapiens
  misc_feature: GYAE6OF01DAJQW.22.73.G07.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (334)..(334): a, c, t, g, unknown or other
  misc_feature (334)..(334): n is a, c, g, or t
  modified_base (446)..(446): a, c, t, g, unknown or other
  misc_feature (446)..(446): n is a, c, g, or t
  modified_base (698)..(698): a, c, t, g, unknown or other
  misc_feature (698)..(698): n is a, c, g, or t
tcagacatacgcgtcacgaccggtgctcgatttagctctacgctcagggggaggaactgctcagttaggacccagacggaaccatggaagccccagcgcagcttctcttcctcctgctactcgtggcctcccagactaccacgtggaagtaaatggtgagtgaccgcacgtcctccacgcccacccttggtctgtcgtccgtaccggaaggggaaacnccgcccctaccctctcccgngaccgacgggccaagtcgagtagtgtacgaactaaacgtacgttacgtacgttacgaccgagacgaagtaccgtaccgtacggcccgacggtcccncccggtacggtcctaccgtctacgttctaggtcgtctccgtaccgtacgacggtcctacggtacgtacccgtcccgcgtacgtcgagtccggcgttaacgggtcgggtacgnggtacgtaacgttcgtctaccgtccacaacctgtacgacgacgacgtaccgtgccgttacggtagttaagttacgtttacgtttactaactttacgtttacttaccgttaggaccctaagaaactttaagaacttagggttactacggttccgttacgtaccgtaccgtttcgaacccggttaccggaaccggttaaacggccgtaacggttaagtaaaccgggtataaaaccccgttttaggcggttacgngttaccggaccttaactcccgttattcccggttactccc

SEQ ID NO: 123485 - DNA, 817 bp, Homo sapiens
  misc_feature: GYAE6OF01DJI3N.22.73.G07.1.454.CMB.1.raw
  modified_base (718)..(718): a, c, t, g, unknown or other
  misc_feature (718)..(718): n is a, c, g, or t
tcagacatacgcgtcacgaccggtgctcgatttagctctacgctcagggggaggaactgctcagttaggacccagacggaaccatggaagccccagctcagcttctcttcctcctgcttactctcggcctccagacgaccgaaccggagaagtttgtgttacgactactacgttttccacgccctacccttgttcttttcgtccttccgaggacgacggccgggccctaccccttctccgtgccgacgggaccaaagtggaagtaagttattaggaccgtaacttaaccgttaaggtcccgttacggaaacccaacgacggacgggtcccgttggacccgacgggacccttccccgacggtcccttccttctacgtgttaatcggtattcgtaccgttaaccggaaacggtccaacgtcggtaccaacgtttccccgagtacccgtaacgggtttccgaagggtcgggtacgtaacgggttcggggtaaccgttaaagggggtaaacgaacgttaaccgttttaccgaccttccgtaacctaccttaacgtaaccgaaacgtacccgtaccgtacgcggtaacccgtcgtaaccgttactttccgtacgttacgtttatttaacgttacgttcgtactaaggcctaacgtccgtaacgtactacggtccctacgtttacggttccggacggtccggtacgagtccggtggaacgtacncggtacgtaaccggtacgttgggtacgccggtttcaacccgttaactccgtttaacgtttaccgttacccttactttcccggttcccgttaacccccgg

SEQ ID NO: 123486 - DNA, 859 bp, Homo sapiens
  misc_feature: GYAE6OF01BFG8Y.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactcgtggcctcccagactaccacgtggaagaaattagtgagtcgacgcagtcctccacgccctaccgttgtctgtcgtccgtaccggaaggggaaacgccgcccctacccttcgtccgtgcggtacggacctagtacgaggtaggttagttaacgacctaaacgtaacgtttacgtcggtacggtaaccaggaccgaaggaccgtaccgtcggacccgtaccggtcccttacccgacggttccttacccctacgtacgttacgttacggttccggggttacttacccgtttaaccggtaacccgggtaccggttacccgttaaccgggtttcccgttaacccccgtcccccggttaaccggttacggtttacgacggtccggtaacggtacggggtttcggggtacggtacgggagttacggttaccgttacctaccgttacccgtaccaaccgttacgccgaacgtaccgtacgtcccgtagtacctaggttacgtacgttaatttccgtttaacgtacttttacgtttaacgttcgttacgtacaacgttaataacgtttaagtaacgttacgttacgttaccgttaccgtaccgttaacccgttccgtaaccgggtaccggtaacccggtaacggaccgttacggaacgggttaacgtaaacgttaaaccggtaacggtcgttaccgggtacgtaccgtaccgtacttaaccggtttcgtaccgtttcgttaccccg

SEQ ID NO: 123487 - DNA, 708 bp, Homo sapiens
  misc_feature: GYAE6OF01DHQ0O.22.73.G07.1.454.CMB.1.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (667)..(667): a, c, t, g, unknown or other
  misc_feature (667)..(667): n is a, c, g, or t
  modified_base (685)..(685): a, c, t, g, unknown or other
  misc_feature (685)..(685): n is a, c, g, or t
tcagacatacgcgtcacgaccggtgctcgatttagctctacgctcgagggggagaactgctcagttacggacccagacggaaccagtggaacgccccagcgcagtcttctcttcctctgctactcgtggcctccaagtactaccacgtggaaagtaaatgtgatacggacgctacgtccaccgaccgaccctaccgttgtccgtacgtccgttaccgaacgggaaacggggaaacncccgtccctaccctcgtccgacgacggacggtaccgtaagtacgaggtagttagtaccaacgttaactacgttacggtctaacggtancgaacgacggaacgccgtcggaccgtcgcctccgacgtcctactgtactcggtacgtgtcctactaccgacggtacggcctacggtcgaccctcggacgtgtcgcgtccgtacgtgggtcggtacacggaactgtacgtctactcctacgaactgtccgacgtacctccgatcggtaccgttataccggttagttaatttccggtttaactacgtttaacttcgttacgagttaactagtaactaatacgtcgtttacgtcgtttaacgacgtccttaaccggtccgtaacggtaccggaaacgtacgggaactcggtaaggaaacgttacgttaacacgggnttaacggtccaagtaccncgttaactcgttccgtgtaaccc

SEQ ID NO: 123488 - DNA, 671 bp, Homo sapiens
  misc_feature: GYAE6OF01B3G1I.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccaggactggtagaacgtccttcggacgtaccctggtccctcacctgctatttcgtctcgtggccactccatcacttagttactacgtggacgctggcctccggcaccggtcccgaaggggaaggtacgtggagtggtagtttgggtatatctattacgacgtgggacgacacgactacaccgcccctacacgtcagtgtacgtcgtactcctacctatttacacgtacgaccacgtacaacgacctacgttcctaccctagtaacgtcgtaacgtcgtgacgtacccgcgtacggaccgaccgtacccgggtcgttacttacgttacgtcggtacggacgttaagttcgttttcggttacgtttttcgggtacgttcgggttacccgttccggttcgtttacggtaccgtagggtcccggggaccgtaccgggttaccccgttgggtaacccgtcccgttacctccctaccgccggtcccctaccggtaaacccggg

SEQ ID NO: 123489 - DNA, 793 bp, Homo sapiens
  misc_feature: GYAE6OF01CGU4M.22.73.G07.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggaagaaatagtgatgacgcagtctccagccacctgtctgtcgtcncgaaggggaaanacgcccacctctcctgacgagggccagtcagagtgtacgacaaactacgttagtcgtaggtacaggacagacgacctggaccgacggcctcccgaggtcctccgtanactcgtagtcggtctcctttaccgaccgngggaccctacggttacggtaccctcccccggtacgacgggtttaccaggttccgaccgtaaggggttcgggtacggtacgggaacgtacggtacgttaccacgtttcccaccgttaaccagtccacggaccgtacgcccttacggaccgtacggtaccgttaaggtaacgtttacgtttaccgtactttaacgttttaacgtttaccgttacgtaacccgtaagtaaccgttaaatttaacgttaaacggtttcgttaaaccgggtttcggtttacccgttaccgtaacgtttacccgttaaccccggtttaccggaacccgggtaaacgggaacccgtaccgggtaaccggtaacgggttaaacggtaaacggttaaaacggttaaccggtagggtttaacccgggacgtaaccgggtaccccaaaccggtttaacttcccggttttactttacccgg

SEQ ID NO: 123490 - DNA, 696 bp, Homo sapiens
  misc_feature: GYAE6OF01E3D3K.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccaggactggtgaacgccttcgggacgaccccttgtcccctcacctgctattgtctcgtggccgactccatccaacttacgttacctacgtggagcgtcggcctccggcgacgtcccgaggggaacgggacgtggagtggagttggtatatctattacacgtggacgcaccgactacacgcccctccacatgacgtacgagtccactattacactacgactaccgtacaacgtaacctacgttcctacccgtacgtaacgtgtacggtcgtacggtccgtaccgtcgtacggacggtaccgaccggtaccgttacgttacttacgtcggtcggtacgtagttacgttttcggttacggttttttagggtaacggttacgggtttaccggtccggttacggtttacggtaccgtaccgggtccggggtacccggtaaaccgggtaccccgttcgggttacccgtaccccggttcccgttacccgttaccgacccgtccccgtacccgaacccgggtaccccggg

SEQ ID NO: 123491 - DNA, 745 bp, Homo sapiens
  misc_feature: GYAE6OF01BLABA.22.73.G07.1.454.CMB.1.raw
  modified_base (99)..(99): a, c, t, g, unknown or other
  misc_feature (99)..(99): n is a, c, g, or t
  modified_base (626)..(626): a, c, t, g, unknown or other
  misc_feature (626)..(626): n is a, c, g, or t
  modified_base (668)..(668): a, c, t, g, unknown or other
  misc_feature (668)..(668): n is a, c, g, or t
tcagacatacgcgtcacgaccggtgctcgatttagctctacgctcagggtctccgaaggcttcaccagtcctggacctcctgtgcaagaacatgaaacntctgtgttcttccttctctggtggcagctcccagagtcgggtcctcgtcccagctagccagctgcgaggacgtccgggacccaggtactgggtaagtaaccgtccgttacgggaacgtccccttcggtcccctaccgaaccgtgacgttacgtttcggtcctacggtacggaccgtaacctcctaactaccgtaacgttacggtttaacacgtaggacgtcggtcggtaccctccggaccgtaaccggtacccggaaggggtaacggtaccggtagggagtacggtagttagggtacttacgtactacgtacgtagtcggtacacgaacgtacgtccgaccgtccctaccgtatacgtcgtaacggtcctaacgtaacgtaccttacttacctaagtaccgaaccgtaaccgaaccgtaaacgtaaccgttcgtacctaaccgtaacgttaacgagttacgggtcgtaggtaccgacgtacgtacggaccgacggaccgttacctgttacttacgtggtctaacggntttacgtaggtttcggttaggtagtacgtcgtcgttaacgtntaccggttacgggcggtaaccgtccggtacggtcgtccgacttctcgtacccgacgtacccacgtacccgtaaccgg

SEQ ID NO: 123492 - DNA, 782 bp, Homo sapiens
  misc_feature: GYAE6OF01EM8W2.22.73.G07.1.454.CMB.1.raw
  modified_base (555)..(555): a, c, t, g, unknown or other
  misc_feature (555)..(555): n is a, c, g, or t
  modified_base (600)..(600): a, c, t, g, unknown or other
  misc_feature (600)..(600): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagtctcccagatcgggtcctgtcccagctgcagctgacagggacgtccgggacccaggactgggtgaacgtcccgttacgggacaccccttcgtaccctcacctgacctagttcgtccttcgtcgggcctaccttccattacctaacgtttaacgttaactacgtaggacgtcgtcggaccgtcccggactacccggtacccggaaggggtaacggtcggtacggtaggtacggtagtttagggttaacttacgtacctaatttacgacgtacgggactaccgtacccggtaactaaccgccgttcccccgtacctaggaacttggacggtacgtacgtaacctaccgtacttccgaactacgaacctaccgaccgtaaacgtactacgttccctaccgtaagtaacgtcggtaccgtactcgggtacnccgtcgtactacgaacgtacccgccgtacgttacttacgttacgnggttcgacgttagttcgttttacgttcggttttaaggcggttacggttaccgtcggtttaacggtttacgaacggttacccgggtcgggtaacccgtaaccgggttcccgttacgggtaaccccttcccggttaccttaccccggacccggttaacctcccccgggtaacccgtaacccggg

SEQ ID NO: 123493 - DNA, 846 bp, Homo sapiens
  misc_feature: GYAE6OF01AN4JL.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctccagatgggtcctgtcccagctgcagctgcgaggcgtcgggcccaggactggtagaacgtccgttcggacgaccctcgtccctcgacctgctagttcgtctcgtggccactcctatctacgttagttacctacgtggtacgcgtcggtccgtccggctacggtacccggaagggggaaggtaccggtgggtaacggtgggtaggtttacggggttaactagttaccttaagttaccgtacggttacggggtaaccggtaccgtaacccggtaaccgttaccgaaccccggtccccccttacccgtaccgtaacgtacggtaccggtaccgtacgttaccctaacccttaacgtttaccgaaccgttaaccgaaccgttaacccgtaacccgaaacggtaacccttacgtttaccctaccccgttaacgggtaaactgggtaaccgggttccgtaacggtacggtaacccgtccgtaccgggtaccggaacccggtccggtaccggtttactacgtttacgtcggtacgtaacggttaagttcggttttacggtttagggttttcgggtaggtttcccgggttaaccgggttcccgtttacgttttacggtaccgttaccggggtcggggtaaccggtacccgggttaacccgttcggtaccccgtacccgttaccgtcccgttacgacccgtccctacccggacggtaaccccggg

SEQ ID NO: 123494 - DNA, 811 bp, Homo sapiens
  misc_feature: GYAE6OF01EA8JV.22.73.G07.1.454.CMB.1.raw
  modified_base (770)..(770): a, c, t, g, unknown or other
  misc_feature (770)..(770): n is a, c, g, or t
tcagacatacgcgtcacgaccggtgctcgatttagctctacgctcgagggggaggaactgctcagttaggacccagacggaaccatggaagccccagcgcagcttctcttccgtcctgctactctggcctcccagactaccacgtaggaacgtaaatagtagatacgacggcgtaagtccaccgacgccctaccgtgtcgtcggtacgtcgtaccggaaggggaaactccgaccctaacccgtcgtccgtacggaccgacgggacctacggttaccgaaggtacggttacgttaacgacctaaaccgttaaacgtttcggtaccgttaacggtaacccgaacggtaccgtaacggaccgtaacccggtggtacccgaacggtaccctacccggaacggtccctaccgtactacgttaccgtggttacgggtcctcgtaccgtaccggtacggtcccgtacgtcggtacccgtccccggagttacggtacctcggacggtccggtaagggttcggggtacgtacggtactaacgtcggttaccctacgtaccgtccaactaccgtacgacgtttacccggaactccgtacggacgttactaacggttaacgacgttttacgtcgtacgttttaacgtacttacgtacggattttaaccgacgttaaacgtaactagttaccgtaacgtcggtttaccgacttacggtccgtaaccgtaccggtaaggaccgtacggaccgttaaacggaccgtaaaggtacccggttaaanacggttcggacacggttcactaccggtaattccgtacgtcc

SEQ ID NO: 123495 - DNA, 775 bp, Homo sapiens
  misc_feature: GYAE6OF01AZY2R.22.73.G07.1.454.CMB.1.raw
  modified_base (451)..(451): a, c, t, g, unknown or other
  misc_feature (451)..(451): n is a, c, g, or t
  modified_base (748)..(748): a, c, t, g, unknown or other
  misc_feature (748)..(748): n is a, c, g, or t
tcagacatacgcgtcacgaccggtgctcgattttagctctacgctcagggtctccgaaggcttcaccagtcctggacctcctgtgcaagaacatgaaacatctgtgttcttccttctctggtgcagctccagatgggtcctgtccagctgcagcgtgcgaggtacgtccgggacccaggtctggtacgacgtccgttcggactaccctcgtccctcactgctagttcgtctcgtaggcctacctcctattcctaacgtttaccgttaaccgtacgtggtacgcggttcgccgtaacccggcgtaaccggtacccgggaagggtaacggtacggtaggggttacgtaacgggttaggtttaaggggtttattaccgttacgttaacgttaaccggacggtagggaacctaccgaacccgtaaccttacccgaaccccgtcccttacctacgngttacgtacgcgtaactccaacccgttatttacgaactaccgacgtaaccggtaaccaacgtaaccgttccttacccgtacccaagtacgtacggtacgtaccgtaggtccgactccgtacgggaccggtaccgtacccgtacgtttaactacggtttagtccgtacgtaggttactttcggtttgttttcgggtttggtaccgttttcgggttaccgcggtttggtttacccgaggtttacccgggacgggtacggtaacccgggtccgttcggtacccgtcccttccgtctaccncccgttaccgcgttaacccggacccgg

SEQ ID NO: 123496 - DNA, 763 bp, Homo sapiens
  misc_feature: GYAE6OF01BOTO8.22.73.G07.1.454.CMB.1.raw
  modified_base (200)..(200): a, c, t, g, unknown or other
  misc_feature (200)..(200): n is a, c, g, or t
tcagacatacgcgtcacgaccggtgctcgatttagctctacgctcagggggaggaactgctcagttaggacccagacggaaccatgggaagccccagcgcagcttctcttcctcctgcctactctggctcccagataccatggagaaatagtgatgacgcagtctccagcccaccctgtctgtgtctacgaggggaaacncgcctaccctctcctgcgacgggccagtcagtaggtgtagacctaactacttagtcgtacggtaccagtcgagtacgaccgtcgggcctacgggcctccgacggtccctcctcagttctaggttcggtcgtccttccgaccgacgggtcctaccgtacgggtaccctcccccggtaccgtacgggtttaccgacgggtccgtccggtaacggggttggggttccggtacggggtaccgtaagggttaccgttccgtaccccttacccgttaccgacctaacgttaccgacccgttacgacggtccctacgggtaccgtacggttaccgtaacgttaaagtttcgtttttaccggaacttttaaccgtttttaactttaccgtcggtttaaccataccttaagtttaacttaacggttacggttcgtttacggttacccgttacgttaccgttacccgtacccgggtaccgtaaccggaacggtacgtacgtaacgtaaggtactaaacggttaacgtacggtaggtcgtaccgtacgtaccaaccttcgtccgttgttacccg

SEQ ID NO: 123497 - DNA, 851 bp, Homo sapiens
  misc_feature: GYAE6OF01B6O8V.22.73.G07.1.454.CMB.1.raw
  modified_base (809)..(809): a, c, t, g, unknown or other
  misc_feature (809)..(809): n is a, c, g, or t
tcagacatacgcgtcacgaccggtgctcgatttagctctacgctcagggggaggaactgctcagttaggacccagacggaaccatggaacgccccagcgcagcttctccttcctcctgctactctggcctcccagactaccacgtaggaagaaattaggtgtatcgaccgactaggttcctccgacgcccctacccgtggtcttggttcgtcctaccggaaggggtaacacgccctacccttctccgtggaccgagggtcctagtcaggtagttagttacacctaaacgttaacttgtcgtacggaccgagtcgaacgacgaccgtcggaccgacggtccgtccgacggtccttaccgactacttcgtacggtcggttcctaccgttacccgtaccggaccggtaccgtacgtttaccggtaaccccgtcccccggtacggtacggttaccggtacgaccgggtacggttacggggttcggggttacccggtaaggtaacgtaacggtacccggtttacctaaccgttacccgactaacccgtactaccggtacgcccgtaaccggtccgtaccgtaacgttacggttaccgtaagtttaaacggttttctttaacgttaacccttttaacgttttaacggttacgttacgttaacgtacggttaaaaccttaagtttaacgttaacgttcggtttaaccgttcgtttccgtaccgttaaccgtttacccgtaccgggttaccgaaaccgtacgggtaaccgtaccgtacgttaagggtaaccttaaacgtaaccggttggccggttanccccggtaaacgtcccgtaacttacgttcgtaacccttaccg

SEQ ID NO: 123498 - DNA, 147 bp, Homo sapiens
  misc_feature: GYAE6OF02HVQRK.22.73.G07.1.454.CMB.1.raw
  modified_base (147)..(147): a, c, t, g, unknown or other
  misc_feature (147)..(147): n is a, c, g, or t
tcagacatacgcgtcacgaccggtgctcgatttagctctacgctcagggacacgactggagattaaacgaactgtggctgcaccatctgtcttcatcttcccgccatctgaacgcgtatgtctgagcgggctggcaaggcgcatagn

SEQ ID NO: 123499 - DNA, 494 bp, Homo sapiens
  misc_feature: GYAE6OF02H93MK.22.73.G07.1.454.CMB.1.raw
  modified_base (384)..(384): a, c, t, g, unknown or other
  misc_feature (384)..(384): n is a, c, g, or t
tcagacatacgcgtcacgaccggtgctcgatttagctctacgctcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacctctcctgcagggccagtcagagtgttagcaacaacttagtctggtaccagcagagacctggccaggctcccaggctcctcatctatggtgcttctacagggccactggtatccccgcaggttcagtgccagtgggtctgggacagagttcactctcaccatcagcagcctgcagtctgaagntttgctactttattactgtcagcaatataatgacttgtctcgatcaccttcggaccaagggaccacgactggagtaattaaacgacttgtggctggcaccattcctgtcc

SEQ ID NO: 123500 - DNA, 489 bp, Homo sapiens
  misc_feature: GYAE6OF02F6JIB.22.73.G07.1.454.CMB.1.raw
  modified_base (196)..(196): a, c, t, g, unknown or other
  misc_feature (196)..(196): n is a, c, g, or t
  modified_base (461)..(461): a, c, t, g, unknown or other
  misc_feature (461)..(461): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagatttgctactttattactgtcagcaatataatgactgttctcgattcaccttcggaccaaggacacgactgganattaaacgactgtgctgccacatctgtc

SEQ ID NO: 123501 - DNA, 536 bp, Homo sapiens
  misc_feature: GYAE6OF02G3N8C.22.73.G07.1.454.CMB.1.raw
  modified_base (397)..(397): a, c, t, g, unknown or other
  misc_feature (397)..(397): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgcagggccagtcagagtgttagcaacaacttagtctggtaccagcagagacctggccaggctcccaggcctcctcatctatggtgcttcaccagggccactggtactccccgcaggttcagtcgccaggtcgggtctgggacaggacgttcactctcaccatcagcacgcctgcagtctagaagtntttgctactttattactgtcagctaatataatgtacttggttctcgtacttctaccgttcggaccgaagggaccacgtacgtggaacgtaacttaaaccggacttggtaggtcgtacgaccgacctagttcctgttacc

SEQ ID NO: 123502 - DNA, 631 bp, Homo sapiens
  misc_feature: GYAE6OF02IA4V0.22.73.G07.1.454.CMB.1.raw
  modified_base (197)..(197): a, c, t, g, unknown or other
  misc_feature (197)..(197): n is a, c, g, or t
  modified_base (403)..(403): a, c, t, g, unknown or other
  misc_feature (403)..(403): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggctcccgaggcctcctcatctatggtcgcttcaccaggccatggtactccccgctaggttcagtgccaggtgggtctgggacaggtagttccactctacacctatcagcagcctgcctagtctaggtaaacgtnttttcgacttaacttttattaaccttgttacaagtactaaataaattaagttcgtaactttcgggtttaccttacgatttacccacccgtttacgggaacccgtaaaggggtacctaaccgggtaccgttagggaaacgttaaaccgttttaaaaccggaaccgtttagggtacgggtaccgttacggaccccgtaaacccgtaacgttttccgtacggttttaaccc

SEQ ID NO: 123503 - DNA, 564 bp, Homo sapiens
  misc_feature: GYAE6OF02I0PQC.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtcccccagggaaggactggagtggattggggtatatctattacactgggagcaccgactacagcccctccctcatgagtcgagtcaccatttcactagacacgtaccaagaaccagttctaccctagaaactgaggtctgtcgaccgctgcggacacggccgtctacttactgtgcgagtatttgtcgtttttggagttggttacgtcgtcgtttgacttacgtcggggtccctagggaacccgtggttaccaccggttccgtcccttccgaccgtcccgttcccgacccgtaaccggg

SEQ ID NO: 123504 - DNA, 519 bp, Homo sapiens
  misc_feature: GYAE6OF02H5956.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagcctggtaccaacagaggcctggccaggctcccaggctcctcatgtatgatgcttccaaaagggccactggcatcccagccaggttcagtggcagtgggtctggaagagacttcactctcaccatcaaacagcctagacgcctcgacgtattctgctagttttattactgtcagcagtcgtacgagtggacctccgtactttcggaccgagggggccaaggccgtggagtcgtacgagaccgtaacgtggtcggctggacacctactcttgtcttccg

SEQ ID NO: 123505 - DNA, 515 bp, Homo sapiens
  misc_feature: GYAE6OF02HYMY9.22.73.G07.1.454.CMB.1.raw
  modified_base (294)..(294): a, c, t, g, unknown or other
  misc_feature (294)..(294): n is a, c, g, or t
  modified_base (345)..(345): a, c, t, g, unknown or other
  misc_feature (345)..(345): n is a, c, g, or t
  modified_base (386)..(386): a, c, t, g, unknown or other
  misc_feature (386)..(386): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtncttcaccgaggccactggtactccccgcaggttcagtcgccaggtgggtcnggggacagtagttcactctcaccatcagcagcctgcagtcngaatatttgcttactttattactgtcagacaatataatgacttgttctcgatctaccgttcggaccaagggacacgacgtaggaagtaacttaacgattggtggcgttcgaccacctattccgttgtac

SEQ ID NO: 123506 - DNA, 564 bp, Homo sapiens
  misc_feature: GYAE6OF02H38MS.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggcctcccgaggctcctcatctatggtgtcttctaccgaggccacgtggtactccccgctaggttcagtcgcctaggtcgggtctgggacagtacgttcactctacaccatcagcagcctgcagtctagaagtatttgacttacttttatacttgtacagactaaatataatgtacttggttctacgattcctaccgttcggaaccgaagggacctacgacgttagggaagttaaacgttaaaaccggaagttggtacgggtaccttaggaccctaaccgtattccgttgtttacc

SEQ ID NO: 123507 - DNA, 497 bp, Homo sapiens
  misc_feature: GYAE6OF02IULJW.22.73.G07.1.454.CMB.1.raw
  modified_base (353)..(353): a, c, t, g, unknown or other
  misc_feature (353)..(353): n is a, c, g, or t
  modified_base (491)..(491): a, c, t, g, unknown or other
  misc_feature (491)..(491): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgcaggttcagtcgccagtgggtctgggacagngttcactctcaccatcagcagccctgcagtctagaagtatttgctactttattactgtcagcaatataatgtacttgttctgatcctacgttcgacgaagggacacgactaggagaattaacgaactgtgctcgcacntctgtc

SEQ ID NO: 123508 - DNA, 540 bp, Homo sapiens
  misc_feature: GYAE6OF02I37FB.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaaggactggagtggattgggtatatctattacactgggagcaccgactacagcccctcctcatgagtcgagtcaccatttcactagacacgtccaagaaccagttctccctagaaactgagtctgtgaccgctgcggacacggccgtctacttactgtgcgagtatttgtctttttggagttggttacgccgtcgtttgacttacgtggggccacgggtaccctggtccaccgttctccgtcgacgtccctccgaccgtaaccggg

SEQ ID NO: 123509 - DNA, 525 bp, Homo sapiens
  misc_feature: GYAE6OF02IMTBS.22.73.G07.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggcctcctcatctatggtgcttctaccagggccatggtactccccgcagacttcagtcgccaggtgggtctggggacaggagttcactctcaccatcagcagcctgcagtctagaagtnttttgcttactttattactgtcagctaattataatgacttggttctcgtatccacgttcggaccaagggacacggtcgtaggaataacgttaaacgacgttggtacggactggacctaacgtacttcttcg

SEQ ID NO: 123510 - DNA, 518 bp, Homo sapiens
  misc_feature: GYAE6OF02IPSVT.22.73.G07.1.454.CMB.1.raw
  modified_base (196)..(196): a, c, t, g, unknown or other
  misc_feature (196)..(196): n is a, c, g, or t
  modified_base (353)..(353): a, c, t, g, unknown or other
  misc_feature (353)..(353): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgccaggttcagtgccagtgggtctgggacagngttcactctcaccatcagcagcctgcagtctgaagtatttgctactttattactgtcagacaatataatgtacttggttctcgtacttccgtaccttcggaccaagggaccacgtacgtggaagtaacttaaacgaactgtcggctgaccacctattcgtgttcc

SEQ ID NO: 123511 - DNA, 492 bp, Homo sapiens
  misc_feature: GYAE6OF02I4JX2.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgctaggttcagtgccagtgggtctgggacagagttcactctcacatcagcagcctgcagtctgagtatttgctactttattactgtcagcaatataatgacttgtctgatctaccttcggacaagggcacgactggaataattaacgaactgtagctcgacacatctgttc

SEQ ID NO: 123512 - DNA, 147 bp, Homo sapiens; identical to SEQ ID NO: 123498
  misc_feature: GYAE6OF02ID1RS.22.73.G07.1.454.CMB.1.raw
  modified_base (147)..(147): a, c, t, g, unknown or other
  misc_feature (147)..(147): n is a, c, g, or t

SEQ ID NO: 123513 - DNA, 507 bp, Homo sapiens
  misc_feature: GYAE6OF02GUL0K.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgttagcaacaacttagtctggtaccagcagagacctggccaggctcccaggctcctcatctatggtgcttctaccagggccactggtactccccgcaggttcagtgccagtgggtctgggacagagttcactctcaccatcagcagcctgcagtctgaagtatttgctactttattactgtcagcaatataatgactggttctcgattcaccttcggaccaagggacacgactgggaagtaacttaaacgaacttgtggctggaccaccattcctgttcc

SEQ ID NO: 123514 - DNA, 533 bp, Homo sapiens
  misc_feature: GYAE6OF02GPZV8.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctcccaggctcctcatctatggtgccttctaccgagggccacgtggtactccccgccaggttcagtcgcctaggtgggtctggggacagagttcactctcaccatcagcagcctgcagtctgaagtatttgctactttattactgtcagactaatataatgtacttggttctcgtatcctaccgttcggaccgaagggaccacgacgtaggaagtaattaaacgaacgttggtaggactcgaccacctattccgtagttacc

SEQ ID NO: 123515 - DNA, 502 bp, Homo sapiens
  misc_feature: GYAE6OF02HHJMO.22.73.G07.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagctggtaccagcagagacctggccaggctcccaggctcctcatctatggtgcttctaccagggccacgtggtactcccccgcaggttcagtgccagtgggctgggacagtagttcactctcaccatcagcagcctgcagtctagaagtntttgactactttattactgtacagcaatataatgactggttctcgatcaccttcggacctaagggctacgactggaagtattaaacgactgtacgctgaccaccatctgtc

SEQ ID NO: 123516 - DNA, 537 bp, Homo sapiens
  misc_feature: GYAE6OF02GVS4K.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgcaggttcagtgccagtgggtctgggacaggagttcactcctcaccatcagcagcctgcagtctagaagtatttgacttactttattactgtacagtcaattataatgtacttggttactcgtattcctaccgttcggaccgtaagggaccacggtactaggaagtaacttaaacggacttggtaggcttggacccaccgtattccgttgttaccg

SEQ ID NO: 123517 - DNA, 728 bp, Homo sapiens
  misc_feature: GYAE6OF02GG34A.22.73.G07.1.454.CMB.1.raw
tcagacatacgcgtcacgaccggtgctcgatttagctctacgctctagggggaggaacgtgcgtcacgttaggacccagacggaaaccagtggaagtccccagtcggcagcttctcttcctcctagctacgtcgtggctccccagagtacctacgtggagaaaattaggtttcgattgacgtcttaagtcgtccacgccacccgttgtacgtgtcgtaccttccgagggggaaaagtacgccggaacccgtcgtccgtcgcgacgggtccgaggtcaagagtgttacgctaactaacgttagtctaggtacccagtcgtacgacgtaccgtaggaccctaagggcctacccgagggcctcccgtcgactcctaagtcggtcgcgttccgtaaccggaggtccgacgtgggtactccccgacgttaggtttcaggttcgaccgtagggtcggtcgtgggtaacaggtagttcacgtctacgacctagtcgaaggccaagtccctacgactacggttcctaaggaaacgttacttttacgacctaaacgttttaaacgttaacctaggtttaccaagttaccgaaattacgttaaagtacgtaacgtttcggttaacctcgtaacgtaccgtaaccgttacggaccgtaaagggtacctacgtacgtaagggaaggtaaacggttaaaccgagtcggtagacctaggacctaccgtagtacgttgtaccg

SEQ ID NO: 123518 - DNA, 622 bp, Homo sapiens
  misc_feature: GYAE6OF02J1OIX.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcacgtcccccgagggaacgggactgggagtggagtggggtatatcgtattacaccgttgggacgcaccgactacacgcccctcctcactgagtcgacgtcacctatttcacttagacaccgtaccaaacgaacctagttcctaccctagtaaacctggacggtctaggtcgacccgtacgtcggccggacgaccggccgttctaacgttctagttacgcgtaagtcttttagtcgtttttacggagtttcggttacgccggttgtttccgacgttacggtcggggccgtaacgggacccttggttaccgacccggttcgttacccgtccgtaccggtcccttacccgaccgtaacccggg

SEQ ID NO: 123519 - DNA, 527 bp, Homo sapiens
  misc_feature: GYAE6OF02GB1CO.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatggtgcttctaccagggccactggtactccccgcaggttcagtgccagtgggtctgggacagagttcactctcaccatcagcagcctgcagtctagaagtatttgactactttattactgttacagtacaatataatgtacttggttctcgtacttcctaccgttcggaccgtaagggaccacgtacgtaggaagtaacttaaacggaactggtaggctggaccacctattcctgttcc

SEQ ID NO: 123520 - DNA, 557 bp, Homo sapiens
  misc_feature: GYAE6OF02GXQM4.22.73.G07.1.454.CMB.1.raw
  modified_base (408)..(408): a, c, t, g, unknown or other
  misc_feature (408)..(408): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagctggtaccagcagagacctggccaggcctcccgaggcctcctcatctagtggtgtccttctaccgagggccacgtggtactccccgctaggttcagtcgcctaggtcgggtctggggactaggtacgttcacgtctcaccatcagcagcctgcagtctagaagtntttgctactttattactgtcagtctaattatactgtacttggttactcgtacttacctaccgttaccggaccgaacgggacacggtacgtaggaagtaacttaaaaccggaacttggtacggtcgttacgcctaacctacttctgttcc

SEQ ID NO: 123521 - DNA, 571 bp, Homo sapiens
  misc_feature: GYAE6OF02IKMRP.22.73.G07.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (400)..(400): a, c, t, g, unknown or other
  misc_feature (400)..(400): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacaacttagtctggtaccagcagagacctggccaggcctcccaggctccncatctatggtncttcaccgaggccagtggtactccccgcaggttcagtcgccaggtgggtctgggacaggtacgttcactctacaccatcagcacgctgctagtctagtaagtntttgacttagtttattactgtacagtactactaataataacgtgtaccttaccgtacttacggttttcgaccgtacgggaacctaaggtcgtagggacgtacgtaaccgaaaaccggtacgttggtacggtacgtacgaccgtaacccgtagttccttcgttaccttaccg

SEQ ID NO: 123522 - DNA, 569 bp, Homo sapiens
  misc_feature: GYAE6OF02JGVZ4.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtcccccagggaggactggagtggattgggtatatctattacactgggagcaccgactacacgcccctcctcatgagtcgagtcacctatttcactacgacacgtaccaagaacctgttcctccctagaaactggagtctgtcgaccgctcgcggacaccgggcctactactttactgtcgacgagtactttgtcgtttttgggacgttggttaccgccgtcgtttgacgttacgtcggggacccgtaacgggtaccctggtccgaccgttccttcctccgacgtcccgtccacccgtaaccggg

SEQ ID NO: 123523 - DNA, 785 bp, Homo sapiens
  misc_feature: GYAE6OF02IY9LP.22.73.G07.1.454.CMB.1.raw
  modified_base (197)..(197): a, c, t, g, unknown or other
  misc_feature (197)..(197): n is a, c, g, or t
  modified_base (317)..(317): a, c, t, g, unknown or other
  misc_feature (317)..(317): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcgagggccagtcaggagtgttagacaactaacttaggtctaggtaccagccagacgaccgtggaccaggcctacccgaggcctcctactattccgtatcgggtncctttccgaaccgagggccctaacgtggtaccctccccggaccgtaggtttcaggttcgcccgtagggttcggggtcgtacggggaactaggtacgtttaccaacgttcctaccaacccgtagttaccgaacggtacccgtaacggtacccgttaaagggaccgtacccgttaacggtaaagtttaacgtttttcggtaaccttaaggttttttactttaaccgttggttaccgaacggtccgaagggttaccgtaacggtacccaaacccgttccccgttaccgtaccgggttccggggtaaccgggtaacgggaaacccggtaaagggttaccgggaagttaaccgtaaccgtaaaaccggtaccggttcgggttacgggtaccgtaccggtaacccgtaacccgtaacggttttccgttacggtttacccttttacccgtacgttttcccccgtttaacccccgg

SEQ ID NO: 123524 - DNA, 576 bp, Homo sapiens
  misc_feature: GYAE6OF02HAHQF.22.73.G07.1.454.CMB.1.raw
  modified_base (197)..(197): a, c, t, g, unknown or other
  misc_feature (197)..(197): n is a, c, g, or t
  modified_base (413)..(413): a, c, t, g, unknown or other
  misc_feature (413)..(413): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcaacaacttagtctggtaccagcagagacctggccaggcctcccgaggcctcctcatctatggtgtcttccgtaccgagggcccacgtggtactcccccggctaggttcagtcgccgtaggtcgggtctggggacaggtagttcactctcaccatcagcacgcctgctagtctagaagtntttcgactactttattactgtcagtactaatataatcgtacttggttctacgtattccgtaccgttcggaccgtaagggtacctacggtacgtagggaacgtaacgtttaaaaccggaacgttggtacggaccttaggaccctaaccgtacgttcgtgttacc

SEQ ID NO: 123525 - DNA, 529 bp, Homo sapiens
  misc_feature: GYAE6OF02FJT8V.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctcctcatgagtcgagtcaccatttcactagacacgtaccaagaaccagttctccctagaaactgaggtctgtgaccgctgcggacacggccgtctattactgtgcgagtatttgtctttttggagttggttacgtccgtcgtttgactacgtgggccaggaacccgtggtcaccgtctcctcacgcctccaccaacgg

SEQ ID NO: 123526 - DNA, 591 bp, Homo sapiens
  misc_feature: GYAE6OF02HJV5J.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcacgtccccgagggaaggactggagtggagttgggtatatctattacacgtgggagcaccgactacacgcccctcctcatgagtcgagtcacctatttcactagactacgtaccaaagacctagttcctccctagaaaccgtgacggttctggtcgacccgtcgtggaccggacgtaccgggccgttacttattaccgtggtcgacgtagttatttgttcgttttgggagtttggttaccgccgttcgtttagaccgttacgtcggggccgacgggtaaccctggtaccaccgttcctacctccgtacgcccttaccgacccgtaacgg

SEQ ID NO: 123527 - DNA, 535 bp, Homo sapiens
  misc_feature: GYAE6OF02FTYMI.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccgagggccactggtactccccgcaggttcagtgccagtgggtctgggacagagttcactctcaccatcagcagcctgcagtctgaagtatttgctactttattactgtcagctaatataatgacttggttctcgattcctaccttcggacccgtaagggaccacggtacgtagggaacgtaacgttaaaccggaacgttaggtaggacgttcgacctaccctattccgtgttcc

SEQ ID NO: 123528 - DNA, 588 bp, Homo sapiens
  misc_feature: GYAE6OF02I6CD5.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaggactggagtggagttgggtatatctattacgactgggagcaccgactacacgcccctcctcatgagtcgagtcactatttcactagacacgtaccaagaaccagttcctacccgtgaaacctgacggtctgtcggaccgtctcggccggacacgggccgttcgtacttacgtgtacgcgtagtatttgtcgttttgggagttcgggtttacgccggtacgtttggacttacggtgggggtccctaaggggtaacccctgggtcgtacccggttcttcccgtacgacggtcccctaccgacccgtaacccggg

SEQ ID NO: 123529 - DNA, 511 bp, Homo sapiens
  misc_feature: GYAE6OF02I8BWT.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtactccccgcaggttcagtgccagtgggtctgggacagagttcactctcaccatcagcagcctgcagtctagaagtatttgctactttattactgtcagctaatataatgacttggttctcgatctaccgttcggaccaagggaccacgactaggagtaattaaacggaacttggtcggctggaccacctatctgtcc

SEQ ID NO: 123530 - DNA, 563 bp, Homo sapiens
  misc_feature: GYAE6OF02JL6TD.22.73.G07.1.454.CMB.1.raw
tcagacatacgcgtcacgaccggtgctcgatttagctctacgctcagggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgcaggttcagtcgccagtcgggtctgggacctagacgttcactcgtcaacccatcaagctacgcctcgctacgtcgtagaagtattttgactactttattacttgtcagtacattataactgtactaggttcttcggtatacctaccgttaccggaccgtaacgggaccacgtacgtacggtaacgaatttaaacggaaccttaggtggtacctacgtaccgaaccacttacgtcgttacc

SEQ ID NO: 123531 - DNA, 498 bp, Homo sapiens
  misc_feature: GYAE6OF02FK7TJ.22.73.G07.1.454.CMB.1.raw
  modified_base (196)..(196): a, c, t, g, unknown or other
  misc_feature (196)..(196): n is a, c, g, or t
  modified_base (469)..(469): a, c, t, g, unknown or other
  misc_feature (469)..(469): n is a, c, g, or t
  modified_base (496)..(496): a, c, t, g, unknown or other
  misc_feature (496)..(496): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccgagggccacgtggtactcccccgcaggtttcagtcgccaggtgggtctggggacagagttcactctcaccatcagcagcctgcagtctgaatatttgctactttattactgtcagctaatataatgacttggtctcgatcaccttcggacaaggacacgacgtgganaattaaacgactgtggctgcacatctntc

SEQ ID NO: 123532 - DNA, 552 bp, Homo sapiens
  misc_feature: GYAE6OF02JTKK6.22.73.G07.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagcaacacttagtctggtaccagcagagacctggccaggctcccaggctcctcatctatggtcgcttcaccagggccacgtggtactccccgctaggttccagtcgaccaggtgggtctggggactaggacgtttcacttcgtaccaaccngtcagcagcctgcagtctagagtatttgactactttattactgtcagactaatntaatgacttgttacncgacttctaccgttcggacctaagggaccacgtacttgggaacgttaacttaacgaacgtttaggtacggacttcggacctaaccgtagttaccgttgttacc

SEQ ID NO: 123533 - DNA, 532 bp, Homo sapiens
  misc_feature: GYAE6OF02GLPYI.22.73.G07.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctntcctgcagggccagtccagagtgttagcaacacttagtctggtaccagcagagacctggccaggctcccaggctcctcatctatggtncttctaccagggccacgtggtactccccgcaggttcagtcgccaggtgggtctgggacagacgttcactctcaccatcagcagcctgcagtctagaagtatttgactactttattactgtcagcaatataatgacttggtctacgtattcctaccgttcggaccgtaagggacctacgacgtaggtaacgtaagttaaacgaacgttggtaggcgtacgacctacctagttcctagttcc

SEQ ID NO: 123534 - DNA, 536 bp, Homo sapiens
  misc_feature: GYAE6OF02IT5GF.22.73.G07.1.454.CMB.1.raw
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (463)..(463): a, c, t, g, unknown or other
  misc_feature (463)..(463): n is a, c, g, or t
  modified_base (519)..(519): a, c, t, g, unknown or other
  misc_feature (519)..(519): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttacactggagctggctccggcacgtccccaggggaaggactggagtggagttggggtatatctaattacacgtgggancgaccgactacncgccccctccncatgacgtcgagtcactatttcactagacacgtcaagaaccagttctccctagaactgacgtctgtgaccgctgccggacacggtccgtctattacgtgtgcgagtgtttgtcgttttggngttggttacgcgtgttgactacggtgggccagggaccctggtccacgtcctcctcncgcctaccgacgaccgg

SEQ ID NO: 123535 - DNA, 572 bp, Homo sapiens
  misc_feature: GYAE6OF02F4GO9.22.73.G07.1.454.CMB.1.raw
  modified_base (196)..(196): a, c, t, g, unknown or other
  misc_feature (196)..(196): n is a, c, g, or t
  modified_base (404)..(404): a, c, t, g, unknown or other
  misc_feature (404)..(404): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagtctggtaccagcagagacctggccaggctcccaggcctcctcatctatggtgcttctaccagggccactggtactccccgctaggttcaggtcgccgtaggtcggggttctggggacaggacgtttcactctccaccatcagcacgcctgcagtctagaatntttgctacttttatactgtcagtctaatataatgactttggtactcgtacttcctaccgttcggaccgtaagggtacctacggtacgtagggtaacgtaaccgtttaaaaccggacgttacggtacggtaccttcggaccctaaccgtacgtttaccgttgtttaccc

SEQ ID NO: 123536 - DNA, 532 bp, Homo sapiens
  misc_feature: GYAE6OF02GPP5R.22.73.G07.1.454.CMB.1.raw
  modified_base (196)..(196): a, c, t, g, unknown or other
  misc_feature (196)..(196): n is a, c, g, or t
  modified_base (388)..(388): a, c, t, g, unknown or other
  misc_feature (388)..(388): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctcccaggctcctcatctagtggtgcttctaccgagggccactggtactccccgcaggttccagtcgccagtcgggtctggggacagagttcactctcaccatccagcacgcctgcngtctgtaagtatttgctactttattactgtcagactaatataatgacttggtctacgtactctaccgttcggaccgaagggaccacgacgtaggagtaacttaaacggacgtggtacggactcgaccgtacctattcctgttcc

SEQ ID NO: 123537 - DNA, 517 bp, Homo sapiens
  misc_feature: GYAE6OF02F7909.22.73.G07.1.454.CMB.1.raw
  modified_base (196)..(196): a, c, t, g, unknown or other
  misc_feature (196)..(196): n is a, c, g, or t
  modified_base (384)..(384): a, c, t, g, unknown or other
  misc_feature (384)..(384): n is a, c, g, or t
  modified_base (515)..(515): a, c, t, g, unknown or other
  misc_feature (515)..(515): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctcccaggctcctcatctagtggtgcttctaccgagggccacgtggtactcccccgctaggttcagtcgccaggtcgggtctggaagagtacttcacttctcaccatcaaacngcctagacgcctgacgtattctgctagtttattacttgtcagcagcgtaccgagtcggtcctcgtacgtttcggccgaggggccagtcgtggagagtcgagacgaacgtggtgctgcaccatctcgtcttntc

SEQ ID NO: 123538 - DNA, 583 bp, Homo sapiens
  misc_feature: GYAE6OF02G8XV9.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcacgtccccagggaacggactggagtggattgggtatatctattacacgtggagcacgactacgacgcccctacctcactgacgtcgacgtcaaccatttccactacgactacgtaccaaagaacccacgttacctaccctagtaaactgtacggtctacgtcgaccgtctggtaccggacgacggccgttactacttcgtcgtgcgtagtacgtttgtcgtttttggagtttcggttaccgtccgttcgtttacgacgttacgtgggcctacgggtaaccctggtcctaccgtccgtcctcgacgcctccgacgtaccgg

SEQ ID NO: 123539 - DNA, 526 bp, Homo sapiens
  misc_feature: GYAE6OF02GALM4.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctcctcatgagtcgagtcaccatttcactagacacgtccaagaaccagttctccctgaaactgaggtctgtgaccgctgcggacacggccgtctattactgtgcgagatttgtctttttggagttggttacgccgtcgtttgactacgtggggccagggaaccctggtcaccgtctcctcagcctccaccaacggg

SEQ ID NO: 123540 - DNA, 494 bp, Homo sapiens
  misc_feature: GYAE6OF02FH71C.22.73.G07.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggctcccaggctcctcatctatgtncttcaccagggccactggtactcccccgcaggttcaggtnccagtgggtctgggacagagttcactctcaccatcagcagcctgcagtctgaagtntttgctactttattactgtacagcaatataatgacttggttctcgatcaccttcggccaagggcacgactggaanattaaacgactgngctgccaccatctgttcc

SEQ ID NO: 123541 - DNA, 504 bp, Homo sapiens
  misc_feature: GYAE6OF02FZJCA.22.73.G07.1.454.CMB.1.raw
  modified_base (196)..(196): a, c, t, g, unknown or other
  misc_feature (196)..(196): n is a, c, g, or t
  modified_base (501)..(501): a, c, t, g, unknown or other
  misc_feature (501)..(501): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccagggccactggtatcccccgcaggttcagtgccagtgggtctgggacagagttcactctcaccatcagcagcctgcagtctgaagtatttgctactttattactgtcagcaatataatgacttggttctcgattctaccttcggccgaagggacacgactggaagtacttaaacgaactgtaggctcggaccacatctntcc

SEQ ID NO: 123542 - DNA, 543 bp, Homo sapiens
  misc_feature: GYAE6OF02FWY66.22.73.G07.1.454.CMB.1.raw
  modified_base (313)..(313): a, c, t, g, unknown or other
  misc_feature (313)..(313): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaaggctggagtggattgggtatatctattacactgggancaccgactacagcccctcctcatgagtcgagtcaccatttcactagacacgtccaagaaccagttctcctgaaactgaagtctgtcgaccgctcgcggtacacggccgtctattactgtgcgagtatttgctttttggagttggttacgtccgtcgtttgacttacgtggggccagggtaaccctggtaccaccgttcctccgtaccgacgccctaccaccgtaaccggg

SEQ ID NO: 123543 - DNA, 653 bp, Homo sapiens
  misc_feature: GYAE6OF02HV99T.22.73.G07.1.454.CMB.1.raw
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctccagatgggtcctgtcccagctgcagctgcaggagtcgggccagggactggngaagccttcggagaccctgtcccncacctgcattgctctggacgactccatccgatagttacatggagntggctccggnagtccccagggaacggtatggaggtggattgggtataatctattacactgggagcgaaccgtactaacacgccctcctacatcgagtcggagtcctaacactttacactaagccaacggtaccaaagaacccgtagttacctacccttacgtaaaaaccgtggtaacgggtcctgggttacgaaccggtcgtcggacgaacccggtacggaccggtacttaacttacgtcggttcgacggtaccgtaagttttgttccgttttttagggtattacggggttacgcggtccgtttagacttacggttacggggcccttaaggggaccccggttaggtaccgtacccggttcctcccgtaccgttaccgacctttacccgacgaaaccccgggg

SEQ ID NO: 123544 - DNA, 553 bp, Homo sapiens
  misc_feature: GYAE6OF02H3JMR.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggctcccaggctcctcatctatggtgcttctaccgagggccacgtggtactccccgctaggttcagtcgccagtgggtctgggacagagttcactctcacatcagcagcctgcagtctagaagatggtggtactagtttatttagttgtcagctacttaattaataactcggtaccttaccgtacttacggttttcggaccgtaacggggacctaagcgtagggagtaacgtaccgaaacggtaacgtggtaggtacgtcggacctaacctacttcgtcgttacc

SEQ ID NO: 123545 - DNA, 691 bp, Homo sapiens
  misc_feature: GYAE6OF02F2Y0M.22.73.G07.1.454.CMB.1.raw
  modified_base (196)..(196): a, c, t, g, unknown or other
  misc_feature (196)..(196): n is a, c, g, or t
  modified_base (284)..(285): a, c, t, g, unknown or other
  misc_feature (284)..(285): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacacttagtctggtaccagcagagacctggccaggccctacgagcctccnnctctagtgtcgtcttaccacgacggcctaggttcgtaccctccccggacgtaggttaccaggtccgaccgtaggggtcgggttcgagggaaccgtggttacgttaccacgttctaccgaacctactccgaagtccgtaccgtccgtacgtacgtaacggttcgtaacggtaaacgttttacgtttaccgtaccttttaactttttaaagtttaccgttacgttaactacggttaaacttaaacttaagttaagtacgttacgtttcgtttaccgtaccgttacgttaccgttaacccgttccggaaccgtaaacggtacccgtacggtaacggtacggtaacgttaaacgttaaaaccgtcgttaggtacgacgtccgtaaccgactacgttcgtaccgtttaccg

SEQ ID NO: 123546 - DNA, 540 bp, Homo sapiens
  misc_feature: GYAE6OF02JE50D.22.73.G07.1.454.CMB.1.raw
  modified_base (256)..(256): a, c, t, g, unknown or other
  misc_feature (256)..(256): n is a, c, g, or t
  modified_base (353)..(353): a, c, t, g, unknown or other
  misc_feature (353)..(353): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
tcagacatacgcgtcacgaccggtgctcgatttagctctacgctcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatcgagagtattagcgactacttagcctggtaccaanagaggcctggccaggctcccaggctcctcatgatgatgcttaccaaaagggccaactggcatcccagccaggttcagtggcagtcggtctaggaagngacttcacgtctacgactatacaacgacgcctagacgcctgaacgtattctagacgtagtttattactgtacacgactagaccgtacgaacgtcggtcctaccgtacgttttcggaccgacggggtccaacgcgtaggacgatccgagtacgaacgtgtgcgtgcacntctgtcttacnctcgtccg

SEQ ID NO: 123547 - DNA, 550 bp, Homo sapiens
  misc_feature: GYAE6OF02G44ZS.22.73.G07.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (411)..(411): a, c, t, g, unknown or other
  misc_feature (411)..(411): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagtagtgttagcaacaacttagtctggtaccagcagagacctggccaggctcccaggctcctnatctatggtntcttctaccgagggccacgttcggtactccccgctaggttccagtcgcctaggtcgggtctggggacagtacgttcacgtcacaccatcagtccacgcctgctagtcgtgaagtntttgactactttattctgtcagactaatatatgtacttggttctacgacttcctaccgttcggaccgtaagggactacgacgtaggaagtaacgttaaacgaacgtggttaggctcgacctaccgtacttcgtagttcc

SEQ ID NO: 123548 - DNA, 826 bp, Homo sapiens
  misc_feature: GYAE6OF02H942O.22.73.G07.1.454.CMB.1.raw
tcagacatacgcgtcacgaccggtgctcgatttagctctacgctcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatcgtccttaccgaaaaaggggtcccaacgttcgggaccactccccgacgcccgtaacgggtttccgaaggttcgggaccgtaaggttcggggttaccgttacggggaaaggtacggtaaccgtttacccgtaccgttacccttaccaaaccccgtaaacttacccgaaaacctaacggtaccccgttaacgggaaccggtaccccgttacgggtaaccggtaactttccggttacggtaccttaagttttaactttacgttacggttaccgaacggtcctaacggtacccgttaacccgtaaggtccgggttacccgttaccccggttaaccggttttttccggggacccgggtaccgggggggtacccgtaaacgggtacccggttacgggtaacgggtaacgttaccgtaacgggtaacccggtaaacggtttacgggttaccgggaccgttaccggtacccgtaacccgttacgttacccggtttaccggtttcccgttttacccgttaccgttccccgtttaccccccgg

SEQ ID NO: 123549 - DNA, 516 bp, Homo sapiens
  misc_feature: GYAE6OF02HBALS.22.73.G07.1.454.CMB.1.raw
  modified_base (196)..(196): a, c, t, g, unknown or other
  misc_feature (196)..(196): n is a, c, g, or t
  modified_base (514)..(514): a, c, t, g, unknown or other
  misc_feature (514)..(514): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctcccgaggcctcctcatctatggtgcttctaccgagggccacgtggtactccccgctaggttcaggtcgccgtaggtcgggtctggggacaggtacgttcactctcacctatcagcagcctgcagtctagaagtatttgctactttattactgtcagactaatatatgtacttgttctcgatcctacgttcggaccgtagggaccacgtacgtggaagtataaacgatgtgctgcacatctntc

SEQ ID NO: 123550 - DNA, 570 bp, Homo sapiens
  misc_feature: GYAE6OF02JNUTR.22.73.G07.1.454.CMB.1.raw
  modified_base (195)..(195): a, c, t, g, unknown or other
  misc_feature (195)..(195): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccacctctcctgcagggccagtcagagtgttacgcaacacttagtctggtaccagcagagacctggccaggctcccaggtcctcctcatctatggtctcttcgaccagggccagtcggtactccccgcaggttcagtcgcctaggtcgggtctagggacaggtacgttcacgtctaccactatcagcacgcctgctacgtctagaagtatttcgacttactttattactgtacagtactaattataacgttgacgttagttctcgtacttaccgtaccgtacgaccgaagggtaccacgtacggttacggaagtaacttaaacggacgttacggtcggtacgtacgaccgttaacctcgttacgtccgttacc

SEQ ID NO: 123551 - DNA, 604 bp, Homo sapiens
  misc_feature: GYAE6OF02GN6MK.22.73.G07.1.454.CMB.1.raw
  modified_base (446)..(446): a, c, t, g, unknown or other
  misc_feature (446)..(446): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgccaccctctcctgcgacgggccagtcagagtgttagcaactaacttagtctggtaccagcagacgacctggccaggcctccccgaggcctcctcattctagtggtcgcttccgtaccgaggggccctacgtcggtacctcccccgcgtacggttcaggtcgccgtagggttcggggtcgtcggggaacaggtacgttccacttcctaccaccctatccgagcacgcctgctacgtcgtagtaagttntttcgccgttaacttttagttacttgtactagactaaattataatgtacgttgttctacgtactaccgtaccgtcggaaccgaagggaccacggtacgtaggtaactaacgttaaaccggaagttggtagtctacggaccaccgtattcgtcttaccg

SEQ ID NO: 123552 - DNA, 584 bp, Homo sapiens
  misc_feature: GYAE6OF02HHM2K.22.73.G07.1.454.CMB.1.raw
  modified_base (198)..(198): a, c, t, g, unknown or other
  misc_feature (198)..(198): n is a, c, g, or t
  modified_base (396)..(396): a, c, t, g, unknown or other
  misc_feature (396)..(396): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtgttagcaacaacttagtctggtaccagcagagacctggccaggctcccaggcctcctcatctatggtgcttctaccgaggccacgtggtactccccgcaggttcagtgccagtggtctgggacagagttcactctcaccatcagcagccctgcagtctgtaaagtnttttcgtacttttagttacttgttacagtctaaattataagtgtaacttgggtttacctacgtaattccgtaacccgtttacgggaccctaaaggggtacccaacggtaccttagggaacgttaacgttaaaaccggaacgttggtacgggtctcggacctacccagtttcccgttaggttccttacg

SEQ ID NO: 123553 - DNA, 589 bp, Homo sapiens
  misc_feature: GYAE6OF02JBHHQ.22.73.G07.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcgganaccctgtccctcacctgcattgtctctggcgactccatcactagttactactggagctggctccggcacgtccccagggaacggactgggagtcggattggggtatatctagttacactgggancgaccgactacagcccctcctcatgagtcgagtaccacgtatttcactagacctacgtaccaagaacctgttacctccctagaaacgtgacggtctgtcgaccgtctggccgaacgaccggccgttactacgtttacctggtacgcggtagtatttcgtacgtttttggacgttcggttacgccgtcgtttgacgttacggtcgggtcgaacgggtacccgtcggtacctaccggttctccgtcgaccgtccctaccgaccgtaaccgg

SEQ ID NO: 123554 - DNA, 653 bp, Homo sapiens
  misc_feature: GYAE6OF02HY2HB.22.73.G07.1.454.CMB.1.raw
  modified_base (196)..(196): a, c, t, g, unknown or other
  misc_feature (196)..(196): n is a, c, g, or t
  modified_base (457)..(457): a, c, t, g, unknown or other
  misc_feature (457)..(457): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaancgccacctctcctgcagggccagtcagagtgttacgaccaaactaacgttagtctacggtaccagcaggacgaccgtgggccaggcctccccgaggtcctccgtcacttctagtggtcgtcctttcgaccgacgggccacgttcggtacctccccgcgtaggttccaggtcgccgtagggttcgggtctggggacaggtacgttccacttcctaccacctatccgagtcacgtccgtagccgtagttcgtagtaaagtttntttcgacctttaacttttaacgttacgttgtaccgtaagtactaaattaattaagttcgttaacgttcggtttaccgtacgtacttcccgttaccggttaccgaaccggaacgggacctacggtacgtaggaaacgttaacgttaaaccggcgttacggtgtacgtacgaccctacgtagttccgttcgttacccg

SEQ ID NO: 123555 - DNA, 660 bp, Homo sapiens
  misc_feature: GYAE6OF02JQ9R1.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaanagccacctctcctgcagggccagtcagagtgttagcaacacttagtctggtaccagcagacgacctggccaggcctcccgaggcctcctcatcgtatggtctccttcgtaccgacgggtcctacgtcggtacctcccccggactacggttccaggtcgacccgtagggtcggggtctcggggaactaggtacttcgaacttcgtacaccgtatccgaagcctacggcctgacgtacggttcctaaggtaagtttacgttttcaaccgtttaactttttacgttacgtttacggtactaacggtaacttaaattaggtaaacttcggtacgtttcggttacttcgaacctttccgtacccggtttacggaacgtaacgggcctacgggtacgttaagggaacgttaaaccgtaaacgtacgttaggtacgtaccgttggacctacgttcgttccgttcgttaacc

SEQ ID NO: 123556 - DNA, 559 bp, Homo sapiens
  misc_feature: GYAE6OF02G9UJO.22.73.G07.1.454.CMB.1.raw
  modified_base (319)..(319): a, c, t, g, unknown or other
  misc_feature (319)..(319): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttacccctatggagctggctccggcacgtccccagggaaggactggagtggagttgggtatatctattacacgtgggancaccgactacacgcccctcctcatgacgtcgagtcacctatttcactagacacgtccaagaacctagttcctcctagaaactgagtctgtcgaccgtctgcggacacggccgttctattactgtgcgtagtatttgtcgttttggagttggttacgccgtcgtttcgtacgttacggtcggggccacgggtacccgtggtcctaccgttcctccgtcgacgtccctaccaccgtaaccgg

SEQ ID NO: 123557 - DNA, 525 bp, Homo sapiens
  misc_feature: GYAE6OF02IFRE3.22.73.G07.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
tcagacatacgcgtcacgaccggtgctcgatttagctctacgctcagggggaggaactgctcagttaggacccagacggaaccatggaagcccccagcgcagcttctcttcctcctgctactctggctcccagataccactggagaaatagtgatgacgcagtctccagccaccctgtctgtgtctccaggggaangcccaccctntcctgcagggccagtcagagtgttagcaactaacttagtctggtaccagcagagacctggccaggctcccaggctcncatctatggtgcttctaccgagggccactggtactccccgctaggttcagtgccaggtggtctgggacaggtacgttcacgtcctcaccactcgagcagcctgcagtctagaagtatttgctactttattactgtacagactaatataatgacttgttactcgtatctaccgtcggaaccgagggacacgacgtggaagtaacgttaacgacgttgtcggtctcgactacctatactgttcc

SEQ ID NO: 123558 - DNA, 826 bp, Homo sapiens
  misc_feature: GYAE6OF02JT9P3.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattcgtctctggcgactccatcacttagttactactggagcctgggtcctccggctacggttcccccgaaggggtaacgggtaccttgggaacggttggtaacgtttggggtaacttacgttccgttaacgttaaccgacgttacggggacgtaccgtaaccgtaacgttaaccgacgtccccgttacccgtacgtaacgtcgtacggtccgtaacgtccgtaaccgtacgtttaccgacgtaacgtacctacggtaacccgtaacgtaaacccgtacggtttacctacccgttagtaaaaccgtcgggtaacgttaccgttacgtaccggtacccgtacgttaccggaccggtaaccgtacccggttaccgttacttaaccgttacgtacggtaccggtaccggttacgttaccgttttacggtaccgtttttacgggacggttttacgggttaaccggtccggtttaacgttttaccggtaccgtttaccgggttcggggtaaccccgtaacggggtttaaccccgtacggtttaccccgtaacccggtttccgttacccggtaacccgttaccggttaccccggtacccgttaaccgggtaaccccggg

SEQ ID NO: 123559 - DNA, 532 bp, Homo sapiens
  misc_feature: GYAE6OF02FODKW.22.73.G07.1.454.CMB.1.raw
  modified_base (446)..(446): a, c, t, g, unknown or other
  misc_feature (446)..(446): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtcccccagggaagggactggagtggattggggtatatctattacacgtgggagcaccgactacacgcccctcctcatgagtcgagtcacctatttcactagacacgtccaagaccagttctccctagaaactgaggtctgtcgaccgctgcggacaccggccgtctattactgtgcgagtntttgtcttttggagttggttacgccgtcgtttgactacgtgggccaggtaccctggtcaccgtctcctcacgcctccacgtaccgg

SEQ ID NO: 123560 - DNA, 630 bp, Homo sapiens
  misc_feature: GYAE6OF02G4YDB.22.73.G07.1.454.CMB.1.raw
  modified_base (318)..(318): a, c, t, g, unknown or other
  misc_feature (318)..(318): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagacccctgtccctcacctgcattgtctctggcgactccatcactagttactactggagctggctccggcacgtccccgagggaaggactggagtggattgggtatatctattacacgtgggancaccgactacacgcccctcctcagtgacgtcgagtcacctatttcactagacacgtaccaaagaaccctagttcctaccctagaaactgacgtctgtcgaccgcgtggccggacgaccgggtcctattacgttactgtcgacgagttagttttcgtcgtttttgggacgtttggttaccggtccgttcggttttacggaccgttacggttcgggggtacccgtaacggggtaaccccgttgggttacccgtaacccggttcccgttacccgttaccgaccggtcccccttacccggaacccgtaacccgggg

SEQ ID NO: 123561 - DNA, 943 bp, Homo sapiens
  misc_feature: GYAE6OF02HS73N.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctctgctactctggctcccagataccactggagaaatagtgatgacgcagtctccagcccacctgtctgtgtctccgaggggaacncgcccaccctctcctgccgacgggccaggtcagtagtgttacgacaaactaactttgtcctaggtaaccagccaggacgaccgtggacccagggtccctacccgagggtccctcccttacacttaccgttagttcggggttccgttccctttaccggtaacccgaacgggggtcccctaaccggtttacgggttaacccgttacccccccgggaccgttaacgggggttttcccaacggggtttccggtaccccggttaggggtttcgggggtttaccggtaggggggttaaccaagggtaccggtttttacccgaaccttttcccggaccctaaaaccccgttacgtaccggaaccgtacccgtaacgggtcccgtttacgggaacccgttaacgggttcccggttaagggttaaacggttttaacggttttttccgtaaccgttttaacccttttttttaaacgttaaccggttttacggttaaccgttaaaccggtaactttaaaaagttaaaccgttttaaaggtttaccgggttaaaccggttttccgggttttaacccgtttaaccggttaacccttttaccccgttaaccccgggttttaaccgggaacccgggttaaaaccggggaacctaaccggtaaccggttaggggtaaacgtaaaccggtttaaaaccggtacggtttacgggtaccggttaccgtaccggtacctaacccgtagtttacccgttacgtttacc

SEQ ID NO: 123562 - DNA, 650 bp, Homo sapiens
  misc_feature: GYAE6OF02GVPD7.22.73.G07.1.454.CMB.1.raw
  modified_base (314)..(314): a, c, t, g, unknown or other
  misc_feature (314)..(314): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcactagttactactggagctggctccggcagtccccagggaagggactggagtggattgggcatatctatacacgtggganacaccgactacaccgtcccctcctacacgtgacgtcgatccgactacttacactacacacctaccgaacgaacctcgttacctcccgtaacgtaaacgtggtacgttcgtagtacggaccgtcgtcggacgaccgacccggtaccggtacttaacttacgtgtacgtacgacgttacgtttttcgttcgttttttagggaggtttacggttaaccggtcccgtttgtttacgaaccgtttacgggtcggggtaccggaaccggggtaacccgtttcgggtaccctaccggtttccctccccgtaccgtaccggtaccccgtacccgtaaccccggg

SEQ ID NO: 123563 - DNA, 607 bp, Homo sapiens
  misc_feature: GYAE6OF02HBD05.22.73.G07.1.454.CMB.1.raw
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
tcagacatacgcgtcacgaccggtgctcgatttagctctacgctcagggggaggaactgctcagttaggacccagacggaaccatggaagcccagcgcagcttctcttcctcctgctactctggctcccagataccactggagaaatagtgatgacgcagtctccagccaccctgtcctgtgtcctccgaaggggaaaacgacggcccaacccttctcccgtgccaggggccaggtccagagtgttagctaaacaacgttagtctaggtaccaggcagagacctggccaggcctccaggctccnatctatggtncctttcaccaggccagtggtacnccccgcaggttcagtcnccaggtcgggtctggggacaggtacgttcacgtctccacgatcagcagcctgctagtctaggaaactagttttcgacttacttttattaacgtgttacagactaaataacttaatggtaacttggtttactacgtacttaccgtaacccgttggaaccctaaaggggtacctacggacgttgggaaacgtaagtttaaaaacgaccgttaggttacggacttacggaccaaccttacttaccgtaggtttacc

SEQ ID NO: 123564 - DNA, 588 bp, Homo sapiens
  misc_feature: GYAE6OF02IU0MC.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaactaacttagtctggtaccagcagagacctggccaggcctccccgaggcctcctcatctatggtcgtcttctaccgagggccacgtggtacctccccgcgaggttcagtcgccgtaggtcgggtctggggacaggtacgttcactctcaccatcgaagctacgcctgctagtctagtaagtactttcgacttacgtttattacgttgtacagtctaaattataagtgtacgttcgttactacgtactccgtaccgttaccggaccgtaaggacctacggtacgtagggtaagtaaacgttaaacggtaacgttggtaggaccgtcggacctaccgtacttccgtcgtttaccg

SEQ ID NO: 123565 - DNA, 505 bp, Homo sapiens
  misc_feature: GYAE6OF02HO8DY.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcatctacggacgggccacgtggtactcccagcctaggttcagtggcaggtgggtctgggacagtagttcactctcacatcagcagcctgcagtctagtagtatttgcttagtttattacttgtcagctactataatactcgcctacgtactgtttcgcgtaggacagcgtaggagatacgaaacgacgtgtacggcgtcgcactagtctcg

SEQ ID NO: 123566 - DNA, 583 bp, Homo sapiens
  misc_feature: GYAE6OF02JHBEO.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattcgtctctggcgactccatcactagttacactggagctggctccggcagtccccagggaagggactggagtggattggggtatagtctattacacgtgggagcaccgatacacgcccctcctcatgacgtcgacgtcactatttcactagacacgtcaagaaccagttctccctagaaactggacgttctcgtcgaccgtcgtgacgacgaccggcgtcctattactgtcgcgagtactttgtcgtttttaggacgttggttacgccgttcgtttcgacgttaccggggaccctacgggggtaaccccttgggtccacccggttcttccctcgtacccgtccgtacccgtaccgaacgggtaccccc

SEQ ID NO: 123567 - DNA, 646 bp, Homo sapiens
  misc_feature: GYAE6OF02I772T.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtacgcaacattagtctggtaccagcagagacctggccaggcctacccgaggcctacctcactcctagtggtcgacttccgaccgtacggcctacgtggtaccctccccgacgtaggttacacggtcgacctagggtcgggtcgtggaactagtacgttcacgttcgacccactacgtaccgagtaccacgccctaggacgacgttacgtacggtaagttacgttttacgacttaacgttttacttacgttagtacctaagtactaaattaacgttaagtacgttacgttcggttactcgtaacttaccgtacccgttacgggaccgtaaggacctacgtacgtaggtaacgtaaacgttaaccggaacttcgggtaccgttacgtacgtacctaaccgtcgttcttacgttaccg

SEQ ID NO: 123568 - DNA, 562 bp, Homo sapiens
  misc_feature: GYAE6OF02H7T2Y.22.73.G07.1.454.CMB.1.raw
  modified_base (314)..(314): a, c, t, g, unknown or other
  misc_feature (314)..(314): n is a, c, g, or t
  modified_base (384)..(384): a, c, t, g, unknown or other
  misc_feature (384)..(384): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggctggagtggattgggtatatctattacactgggancaccgactacacgcccctcctcatgagtcgagtcaccatttcactagacacgtaccaagaacctagttcnccctagaaactgacgtctgtcgaccgctgcggacacggccgtctacttactgtgcgagtatttgtcgtttttggagttggttacgccgttcgtttgtaccgtacgtggggccgtacgggtaccctggttcccaccgttcgtaccgtccgtacggtcccttcccgaaccgtaacccggg

SEQ ID NO: 123569 - DNA, 709 bp, Homo sapiens
  misc_feature: GYAE6OF02IA4LO.22.73.G07.1.454.CMB.1.raw
  modified_base (143)..(143): a, c, t, g, unknown or other
  misc_feature (143)..(143): n is a, c, g, or t
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
tcagacatacgcgtcacgaccggtgctcgatttagctctacgctcagggggaggaactgctcagttaggacccagacggaaccatggaagccccagcgcagcttctcttcctctgctactctggctcccagataccactgganaaatagtgatgacgcagtctccagccaccctgtctgtgtctccgaggggaaancgccacctctctgcagggccagtcagagtgttagcaacaacttagctggtaccngacagacgactggccaggctcccaggcctctcagtctatgatnctatctacgacgggccacgtgaccgtatcccgaagtcccgtaaggttaccaggtcgggaccaggggtttgggtcccgtaggggaactagtaaccttcctaccgttacctaccgaaccgtactacccgagacccgtacgtacccgtacgaccggtaccgtaggtaaacgttagttttacggacctttaagttttactttaacccgttgtactacggttacgtacgtacggttacgaccgtaacccgttccccgtttaccgtacccgggttacgggtaacccgggaacggggtaacccggtaacgggttaacggggtacgaaaccggttaaccgtaaaccgggtaaaccggttcgggtacggtttaccgtaccgggtaaccgtaaccccggttagttaccccgtttagtttaaccccg

SEQ ID NO: 123570 - DNA, 147 bp, Homo sapiens; identical to SEQ ID NO: 123307
  misc_feature: GYAE6OF02I4RXZ.22.73.G07.1.454.CMB.1.raw
  modified_base (147)..(147): a, c, t, g, unknown or other
  misc_feature (147)..(147): n is a, c, g, or t

SEQ ID NO: 123571 - DNA, 552 bp, Homo sapiens
  misc_feature: GYAE6OF02FSJCN.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaaggactggagtggattgggtatagtctattacacgtgggagcaccgactacacgcccctcctcatgagtcgagtcactatttcactagacacgtccaagaaccagttcctccctagaaactgacgttctgtcgaccgctgcggacacggccgtctacttactgtcgcgagtagttttcgtcgtttttggagttggttacgcgtcgtttgacttcgtgggccgacgggtaccctggtcctaccgtcttccgtcgcgtccctaccgaccgtaacccggg

SEQ ID NO: 123572 - DNA, 614 bp, Homo sapiens
  misc_feature: GYAE6OF02H9WYV.22.73.G07.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
tcagacatacgcgtcacgaccggtgctcgatttagctctacgctcagggggaggaactgctcagttaggacccagacggaaccatggaagcccagcgcagcttctcttcctcctgctactctggctcccagataccactggagaaatagtgatgacgcagtctccagccaccctgtctgtcgtctccgaaggggaaanacgcccaccctctcctgcagggccagtcagagtgttagcaaactacttagtctaggtaccagacagacgacctgggccaggcctcccgaggcctcctcatctatggtntccttcgaccgaggccctacgttcgggtactcccccggacgtaggtttccaacggtcgacccgtaggttcggggtactaggggacaggtacgtccnctctcaccntcgagcagcctgacagtctagtaagttatttcgacttaactttacttacgttgttacacgtactaaattataattagtacgttgttctacgtacttaccgtaccgttacggaccgtaacgggacgtaccgtacgtaggaacgtaacgttaaaccggtacgttaggtacggtacgtacgtacctacctagttccgttattcccg

SEQ ID NO: 123573 - DNA, 532 bp, Homo sapiens
  misc_feature: GYAE6OF02GOVFW.22.73.G07.1.454.CMB.1.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
  modified_base (398)..(398): a, c, t, g, unknown or other
  misc_feature (398)..(398): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcaacacttagctggtaccagcagagacctggccaggctcccaggctcctcactctatggtncttctaccagggccactggtactccccgcaggttcagtcgccaggtcgggtctggggacaggtacgttcactctcacctatccagccagcctgcagtctagaagtntttgctactttattactgtcagactaatataatgacttgttctcgtattcaccttcggaccaagggacacgtacgtaggaacgaacgttaaacgaacttaggtaggtctcgtacaacccgtattcctggttacc

SEQ ID NO: 123574 - DNA, 543 bp, Homo sapiens
  misc_feature: GYAE6OF02ID3IA.22.73.G07.1.454.CMB.1.raw
  modified_base (297)..(297): a, c, t, g, unknown or other
  misc_feature (297)..(297): n is a, c, g, or t
  modified_base (396)..(396): a, c, t, g, unknown or other
  misc_feature (396)..(396): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgcagggccagtcagagtgttagcaacacttagtctggtaccagcagagacctggccaggcctcccaggctcctcatctatggtncttcaccagggccactggtactccccgctaggtcagtcgccaggtcgggtctggggacagagttcactcacaccatcagcagcctgcagtctgtaagtntttgcttactttattactgtcagctaatataatgtacgttgtttacctcgtacttccgtacccgttcggaaccgaagggacctacgacgttagggaactaacgttaaacgacgttggtaggtactcggaccaccgtattctgttccg

SEQ ID NO: 123575 - DNA, 642 bp, Homo sapiens
  misc_feature: GYAE6OF02F3P3Q.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttacgcaacaacttagtctaggtaccagcagagacctggccaggcctcccgaggtcctccctcattcctagttggtcgtcctttcgacccgaggggtccaacgttggtaccttcccccggctacggggtttccacggttcgacccgagggttcggggtcgtggggactaggtacgtttcacttcgtaccaccatcgacgtcacgtccctgcctaaggtctaaggtaagttatttcgacttacttttagttactgtccaagtactaaatattaactgtaacgttcggtttacctacggtacttccgtaaccgttccggaaccgaacgggtacccacgtacgtacgggtaagtaaacgtttaaaccggaacgttggtacggccgttacgacctaccgtacttccgttgttaccc

SEQ ID NO: 123576 - DNA, 689 bp, Homo sapiens
  misc_feature: GYAE6OF02JJKWJ.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttacgcaactaacttagtctaggtaccagcagacgacctggccaggcctcccgaggcctcctcattcgtatcgggtcgtcctttccgtaacccgacgggggcccctaacgttcgggtaacccttccccccggaccgtaaggggttttccaacgggttcgaccccggtagggttcggggttaccgtgggggaacctaaggtacgtttctaacccttcctaccaaccgtgtacccgaaggcccacgtcccgtggacctacggttcgtaaggtaaagttcttttcggaccttaactttttacgttacgttagttacacgtaactaaattagttaatcgtaacgttgttctacgtacttacctaccggttacgaccggtaagtaccacggtacgtaagggtaacgtaacgttaaacggtacgttaggtagtaccgtcgaccgtaaccctagttcgttcgttacc

SEQ ID NO: 123577 - DNA, 723 bp, Homo sapiens
  misc_feature: GYAE6OF02HLUI1.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcgagggccagtcagtagtgtacgacaaactaacttagtctaggtaaccagcaaggacgaccgtggccacggcctacccgacggtcctcctactatcttagtggtctctttaccaccgacgggcctacgttcgggtacctcccccggacgtacggtttcacggtcgccgtaggtcggggtcgtagggggactaggtacgttaccacgttcctaccacctactacgacgcctacggtccctagtcgaacgttcgtaagtaaagtttacgtttcggtactttaacgttttacttacgttagtaccaagtactaaaataacttaagtacggttaacgttcggttaccttacggtaaccttaccgttaacccgggttacggaaaccgggtaacgggtaacctaccggggtacggttaacggggtaaacgttaaaacggtttaaaccgggagtttacgggtacggtacccggttaaccggaaccgttaaccctagtttaccgttacggtttaaccc

SEQ ID NO: 123578 - DNA, 556 bp, Homo sapiens
  misc_feature: GYAE6OF02F24XG.22.73.G07.1.454.CMB.1.raw
  modified_base (195)..(195): a, c, t, g, unknown or other
  misc_feature (195)..(195): n is a, c, g, or t
  modified_base (442)..(442): a, c, t, g, unknown or other
  misc_feature (442)..(442): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagaaaccaccggagaagttgtgttgacacagtctccagccaccctgtctttgctccaggggaaanagccaccctctcctgcagggccagtcagagtgttaactactacttagcctggtaaccaacagaaacctggccaggcctcccaggctcctcatctatgatgcatcttacagggccacgtggcatcccagcctaggttcaggtggcaggtgggtctggggacagcttcactctcaccatcagcagcctagacgcctgaagtattttgactagttttacttactgtacagcagacgtagccaactccctnacggttcggcggaggaccgaagggttggaagtactacgaaaccgtaacgtgtacggtctacgacctacctacgttctagttcttactaccgttcccgtacctactacgtaccgg

SEQ ID NO: 123579 - DNA, 548 bp, Homo sapiens
  misc_feature: GYAE6OF02IXBBV.22.73.G07.1.454.CMB.1.raw
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagcccttcggagacccctgtcccctcacctgcattgtctctggccactccatcactagtactactggagctggctccggcagtccccagggaggactgggagtggattggggtatatctattacacgtgggagcaccgactacacgcccctcctcatgagtcgatcactatttcatagacacgtcaacgaacctcgttctaccctgaaactgacgtntgnacgcngcgacncggtctntcttactgtgctagtatttgtcgtttttggagttggtaccgtcgtcgtttcgacttacgtcggggtccaacgggtacccgtggtcctccggttctcctccgacgcccttaccgaccgtaaccggg

SEQ ID NO: 123580 - DNA, 646 bp, Homo sapiens
  misc_feature: GYAE6OF02GWZUL.22.73.G07.1.454.CMB.1.raw
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagacatacgcgtcacgaccggtgctcgatttagctctacgctcagggggaggaactgcgtcagttaggacccagacggaaccatggaagcccagcgcagcttctcttccgtcctgctactctcggctcccagataccactggagaataggtgatgacgcagtctccagccaccctgtctgtgtcctccgaggggaaatgccctaccctcttcctggccgagggccaaggtcaggagttgttagctaacacgttagctagggtaccagtcagacgccgtaggccctagggcctcccaagggcctaccgtacgaactcctaacgtggtcgtctttcaccgagggcctacgtcggtacttccccncggtaggttcaggtcgcctaggtcgggttacngggaacngtagttcacttcacgacctagtcaacgcncgaccctgtcngtctaggaacttgtttcaccttagttttacgtactttggttacctagtacctaaagtttataacgttacgtagttacgggtttccttacggacttaccgaccctttacgggaaccgtagggaacctacgtacggtacggaagttaacggttaaaccaaaggtttcggacgtgttaccgtccgaacctacgttctagtttaccg

SEQ ID NO: 123581 - DNA, 573 bp, Homo sapiens
  misc_feature: GYAE6OF02G0QUL.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggacgaccctgtccctcacctgcattgtctctggcactccatcactagttactactggagctggctccggcacgtccccgagggaagggactggagtggagttgggtatatctattacacgtgggagcaccgactacacgcccctcctcatgacgtcgagtcacctatttcactagacacgtccaaagaacctagttcctaccctagaaactgtacgtctgtacgaccgtctcggacggaccgtacggccgttactacttacgtgtcgcgtagtatttgtcgtttttggagttcggttacgtcgtcgtttgactacggtcggggccgtaacgggtacccgtggtccgaccgttctcctcgaccgcctaccaccgtaaccgg

SEQ ID NO: 123582 - DNA, 585 bp, Homo sapiens
  misc_feature: GYAE6OF02IWLJM.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggaccccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaactacttagtctggtaccagcagacgacctggccaggcctccccgaggtcctcctcattctagtggtcgcttctaccgagggcccagttggtacctccccgcgtaggttccaggtcgccgtaggtcgggtctggggacaggtacgttccactctacacctatcagcacgcctgctagtcgtagtaagtatttcgacttactttattacgttgtactagtactaaataataattagtacgttcgttactacgtacttccgtaaccgttccggaaccgtaagggaccacgacgtagggaactaacgttaaacggtagttcggtaggtctcgacctacctattcgtcttccg

SEQ ID NO: 123583 - DNA, 769 bp, Homo sapiens
  misc_feature: GYAE6OF02J2COT.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactgggtgaacgccttcggagtacccctgtcccctcaccctggcctattcggtcctcgtgggccgtaacttcccaattccaacttaggtttaccaacgttcgggaacgcttcgggccttccgggactacggtcccccgaaggggaacgggacttgggagtggagttggggtatagtctagttacacgttggggatccaccgtactacgacgccctcctcatgacgtcgacgtcaccaactttcaactacgactaccgtacctaacgaacctacgttactcccgtagaaaacctggtaacgtctacggtacgtaccggctacggtaccggaaaccgtcccgggtccgttaccgttaacgtttaacctcgggttacgccgggtaaagttacgttttacgggttaccggttttttagggtaacggttaccgggtttaaccggcccggttaccggtttttaccggacgtttaccgggtttaccgggggaacccggtaaccggggttaacccggttaccgggtacccgttaacccggttccgtttaccccgtacggtaaccccggtcccttacccggaaccccggttaacccggggg

SEQ ID NO: 123584 - DNA, 566 bp, Homo sapiens
  misc_feature: GYAE6OF02GI6HC.22.73.G07.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcaacaacttagtctggtaccagcagagacctggccaggcctccccaggcctcctcatctatggtntcttctaccagggccactggtactccccgcaggttccagtcgccagtgggtctgggacagagttcactctacaccatccagcacgcctgcagtctagatatttagctactttattactgtcagtacaattataatgtacttcggttactcgtacttccaacccgtttccggaaccgtaacgggaccacgtaccgtacgggaaagtaacgttaaaaccggtaacgttcgtacggtcctacgtacctaaccgtacttccgttacgttaccg

SEQ ID NO: 123585 - DNA, 546 bp, Homo sapiens
  misc_feature: GYAE6OF02GP03M.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcactagttactactggagctggctccggcagtccccagggagggactggagtggattgggtatagtctattacacgtgggagcaccgactacgacgcccctcctcatgagtcgagtcaccatttcactagacacgtccaagaaccagttcctccctagaaactgacgtctgtcgaccgctgccggacacggccgtctattactgtgcgtagtagtttgtcgtttttggagttcggttacgtccgtcgtttgactacgtcgggccacgggtaccctggtcctacgtctccgtcacgccctaccaccgtaaccgg

SEQ ID NO: 123586 - DNA, 547 bp, Homo sapiens
  misc_feature: GYAE6OF02IGUH6.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaangccaccctctcctgcagggccagtcagagtgttagcaacaactttagctggtaccagcagagacctggccaggctcccaggctcctcatctatggtgcttctaccgagggccacgtggtactccccgctaggttcagtgccagtcgggtctgggacagtagttcactctcaccatcagcagctgcagtctagagtatttgactacttttaattacttgtactagtactaaattattaatgtacttggttactacgtacttctaccgttcggaccgtaagggaccacgtactagggaagtaacttaaacggacttggtacggtcctggacccacgtaattccgtagttacc

SEQ ID NO: 123587 - DNA, 632 bp, Homo sapiens
  misc_feature: GYAE6OF02HKPUA.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtattagcaacaacttacgcctaggtaaccagcagagacctggccaggcctccaggctcctcattctatgttgcatccagcgaggccacgtcggtaccccagccaggttcagtggcgagtcgggtcgtaggacgaggtagttcactcgtacacctatacaacgccaacggtccttcgacgtagtactaggtaaacgttattttcggaacctttaagttttacttacgttgtactagtactaagttaaattaaacgttacgtacggtcccgttaccggtaacggtttcccgggaaccggtaaacgggtaaccgtaagggtagggttaaacgtaccgaaaacggtaacgttagggtcggacgtaccgtaccgaaccgttacgtacggttaccgttcttaccgtaaccg

SEQ ID NO: 123588 - DNA, 556 bp, Homo sapiens
  misc_feature: GYAE6OF02GNQAK.22.73.G07.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtagcaacacttagtctggtaccagcagagacctaggccaggctcccaggctcctcatctatggtncttctaccacgggccacgtggtactccccgcaggtttcagtcgccagtgggtctgggacagtagtcactctcaccntcagcacgctgcngtctagaatntttagactactttattactgttcagtactaattattaagtcgtacttggtttctacggtataccgtaccgttccggaccgtaacgggtaccacgacgtaggaacgtaacgttaaacggtaaccgtcgttacggcgtacgaccctacctagttccgtagttacccg

SEQ ID NO: 123589 - DNA, 635 bp, Homo sapiens
  misc_feature: GYAE6OF02GR6NM.22.73.G07.1.454.CMB.1.raw
  modified_base (329)..(329): a, c, t, g, unknown or other
  misc_feature (329)..(329): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagtactactgagctggctccggcacgtccccagggaggcgtggagtggattgggtatagtctattacacgtgggacgcaccgactacgacncccctcctcactgacgtcgagtccactatttccactacgacacgtaccaacgaacctacgttcctaccctagaaactggtacgtctgtcgaccgtctcgccggacaccggtccgtacttacttacgtgtagtccgtagttacgttttcggttcgtttttagggacgtttcgggttaccggtccggttcggttttacgtaccgttacggtcgggggtaacccgtaaccgggtaacccgttcgggttacccgtacccggttctaccccgttcgacccgtaccccgtacccgtaacccggtaacccggg

SEQ ID NO: 123590 - DNA, 620 bp, Homo sapiens
  misc_feature: GYAE6OF02JVGWC.22.73.G07.1.454.CMB.1.raw
  modified_base (164)..(164): a, c, t, g, unknown or other
  misc_feature (164)..(164): n is a, c, g, or t
  modified_base (313)..(313): a, c, t, g, unknown or other
  misc_feature (313)..(313): n is a, c, g, or t
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (565)..(565): a, c, t, g, unknown or other
  misc_feature (565)..(565): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtcnccagccaccctgtctcgtgtctccgaggggaaacacgcccaaccctctccgtgccgagggcccagtccgagtacgtgttacggactaaaccgaatttacgtcctgggtaccaggtcaggagacctggccacggcctcccgaggcctccncacgtctagtcgtgtccttacgtaccgacgggcctacgtcgtactccccgcgtacggttcngtacgccgtaggtgggtctcgggacagtacgttcacctcnccaccgacgtacacggtcacgtccgtcgaccgtagtccgtaaggtacttagttttacgaaacctttttagtaccttgttacagtactaatataacgtgtaacgttgttctacgtctaccgtactcggacgtaaggacacgtacgcggtaanaacgtttaaccgagttacgtcggacttacgccaaccgttgtacttcgtacttccg

SEQ ID NO: 123591 - DNA, 556 bp, Homo sapiens
  misc_feature: GYAE6OF02FM7SK.22.73.G07.1.454.CMB.1.raw
  modified_base (196)..(196): a, c, t, g, unknown or other
  misc_feature (196)..(196): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaaacaacttgtctggtaccagcagagacctggccaggctcccgaggcctcctcatctatggtgcttctaccagggccactggtactccccgcaggttcagtcgcctaggtggtctgggacaggagttcactctcacctatcagcagcctgcagtcngaagtntttgctatttattactgttacagctaaatattaatgtacttgggtttacctgaacttcctaccgttaccggaccgtaacgggaccacggtacgtggaaacgtaaacgtttaaaccgaacgttaggtaggtccttaggcctaaccgtagttccgttcgttacc

SEQ ID NO: 123592 - DNA, 582 bp, Homo sapiens
  misc_feature: GYAE6OF02G3BR9.22.73.G07.1.454.CMB.1.raw
  modified_base (423)..(423): a, c, t, g, unknown or other
  misc_feature (423)..(423): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccaaggaagggactggagtggattgggtatatctattacactgggagcacgctacagcccctcctcatgagtcgagtcacgatttcactagacacgtccaagaaccagttctccctagaaactgacggtctgtgaccgctgcggacacggccgtntattactgtgcgagtactttgtcgtttttggagtttcgggttaacgtccggttcgtttgacgttacggtcggggtccctaacggggtaacccgttcggtaccgtaacccggttcttacccgtccgtaacgtccccgttacccgaacccgtaacccgggg

SEQ ID NO: 123593 - DNA, 551 bp, Homo sapiens
  misc_feature: GYAE6OF02FHKO0.22.73.G07.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacacttagctggtaccagcagagacctggccaggcctcccgaggctcctcatctatggtncttcaccgagggccacgtggtactcccccgctaggttcagtgccaggtcgggtctgggacaggcgttcactctcaccntccgagcacgcctgcagtctagaatatttgctacttttatactgtacagactaattataatgaacttggtcctagtacttccgtaccttcggaccgtaagggaccacggacgtagggaactaacgttaaaccgtacgtggtacggactacggaccctaccgtattaccgttggttaccc

SEQ ID NO: 123594 - DNA, 932 bp, Homo sapiens
  misc_feature: GYAE6OF02JC1UT.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactgggtgaagcccgttcgggacgacccttgtccctcacctgcattcgtctcgtcggcgacctccatcaacttacgttactacgtggacgtcgtcggtacgtcccggcgtaaccggtccccggaaggggaacgggtaccgtggggtacggtgggtaagtttggggttaactagttaccgttaacgttacgaacggttaggggacgtaccgtaaccggtaacttaaccgaccggtacccccttaccccgtacgtaacgttacggaaccggttacgtaaccggttaccctaacccgtttaactttacccgtaaacgttaacgtaacccgtaaacccgttacccgaaaaacgtaacccgttaaccggttttaccccacccggtttaaacgaaaaaccggtttcggtaaaccgggtttcttaccgggtaccgggtaacccgtccggttacggaccgggtaacccggtaccccgggttcccgttaacgtttaacgtttaacccgtcggggtttacggaacggttacggttttacgttttaccgggttttacgttttttaacggggcggggtttttaccgttaaaccgggttcccgggtttaccgggttttacggtaccgggtttaaccgggttcccgggggtaacccggtaaccggggttacccgggtttacggtaccccggttaacccggtttccccggttacccgttacccggtacccggtaccccccggttaccggtaaaccccgggtaaccccggg

SEQ ID NO: 123595 - DNA, 622 bp, Homo sapiens
  misc_feature: GYAE6OF02H1064.22.73.G07.1.454.CMB.1.raw
  modified_base (199)..(199): a, c, t, g, unknown or other
  misc_feature (199)..(199): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaancgcccaccctctcctgcagggccagtcagagtgttagcaactaacttagtctggtaccagcagacgaccgtggccaggcctcccgaggcctcctcactcgtatgggtcgtcttccgtaccgagggccctaacgttcggtacctcccccggcgtacgggtttccacggtcgccgtagggttcggggtacgtggggactaggtacgtttcacttctaccacctatccacgccacgcctgaccgtagttcgtagtaagttatttcgactttacttttacttacgttgtcaagtactaataacttaagtcgtacgttcggttactacgtacttaccgtacccgttacggaaccgaagggaccacggtacgtaggtaacgtaacgttaaacgagttggagtcgtacgacctaacgtcttcgtagttcc

SEQ ID NO: 123596 - DNA, 561 bp, Homo sapiens
  misc_feature: GYAE6OF02GSN8L.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagtactactggagctggctccggcagtccccagggaagggactggagtggattgggtatatcgtattacactgggagcaccggactacacgcccctcctccatgagtcgagtcaccatttcactagacacgtccaagaccagttcctaccctagaaactcggaaggtctggtgacccgtcgtgccggacaccgggtccgtcttacttacgtgtcgacgtagtattttgtcgtttttggagttcggttacgccgtcgtttcgacttacgtcggggccagggtaccctggtccaccgtctccgtcacgccctccgacgtaaccgg

SEQ ID NO: 123597 - DNA, 627 bp, Homo sapiens
  misc_feature: GYAE6OF02FG5TG.22.73.G07.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (423)..(423): a, c, t, g, unknown or other
  misc_feature (423)..(423): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccagggggaaancgccaccctctcctgcagggccagtcagngtgttagcaacacttagtctggtaccagcagngacctggccaggcctcccgaggcctcctcatctagtggtcgtcttcctaccgagggcctacgtggtactcccccgctacggttcagtcgccctaggtcggggtctagggggacaggtacgttccacgttcctcacctatcagctacgcctgcagtctagaagttntttcgacttacttttatactgtacagtctaaattactaatcgtaacttggttacctacggtaacttccgtaacccgtttacgggaacccaacgggggtacctacgggtaacgttacgggtaaacgttaaacgtttaaaacccggaacgtttcgggtacggtaccttacggtaaccctaccctaggtttcccttacggtttaccc

SEQ ID NO: 123598 - DNA, 648 bp, Homo sapiens
  misc_feature: GYAE6OF02IJWG0.22.73.G07.1.454.CMB.1.raw
  modified_base (198)..(198): a, c, t, g, unknown or other
  misc_feature (198)..(198): n is a, c, g, or t
  modified_base (458)..(458): a, c, t, g, unknown or other
  misc_feature (458)..(458): n is a, c, g, or t
  modified_base (482)..(482): a, c, t, g, unknown or other
  misc_feature (482)..(482): n is a, c, g, or t
tcagacatacgcgtcacgaccggtgctcgatttagctctacgctcagggggaggaactgctcagttaggacccagacggaaccatggaagccccagcgcagcttctcttcctctgctactctggctcccagataccactggagaaatagtgatgacgcagtctccagccaccctgtctgtcgtctccgaaggggaaancgcccaccctctcctgccgagggccagtcagagtgttagcaactacttagtctaggtaccagcaagacgacctggccaggcctccgaggtcctaccgtcattcagtcggtcaccttctaccgagggccagttcggtacctccccgatacggttcaagttcgaccgtaggtcgggtccgtagggacctaggtacgtttaccaccgttctccgaacctaggtccaaggccacggtccctagaactgtactaggtaaacgttntttcgacttaacgttttatacgtntacgtacgaactaaatagtaacgttcgagtttccgttacgtaaccgtacgttaaccttacccggtaggtacccgtaaagggtaccctacgggaagttacggggtaaattaaacctaaacggacgttggtaacgggtactacgacctactacgtttcgttacgttcc

SEQ ID NO: 123599 - DNA, 575 bp, Homo sapiens
  misc_feature: GYAE6OF02G7SBQ.22.73.G07.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcaacaacttagtctggtaccagcagagacctggccaggcctcccgaggctccctcattctagtggtncttctaccgagggccatcggtactccccgctaggttcagtcgcctaggttcgggtctggggacaggtagttcaacttctccaaccatccagccagccctgcagtctagaagtatttgctactttattactgtcagctaattataatcgtacgttgttctagtacttcctaacctttccggaccgtaacgggtaccacggacgttaggaacgtaacgttaaaccggaacgttacggtaggtccgtacggacctaaccgtacttacgtgtttacccg

SEQ ID NO: 123600 - DNA, 791 bp, Homo sapiens
  misc_feature: GYAE6OF02JM10B.22.73.G07.1.454.CMB.1.raw
  modified_base (235)..(235): a, c, t, g, unknown or other
  misc_feature (235)..(235): n is a, c, g, or t
  modified_base (630)..(630): a, c, t, g, unknown or other
  misc_feature (630)..(630): n is a, c, g, or t
tcagacatacgcgtcacgaccggtgctcgatttagctctacgctcagggtctccgaaggcttcaccagtcctggacctcctgtgcaagaacatgaaacatctgtgttcttccttctcctggtggcagctcccagagtcggtcctcgtcccagctgcagctgcaggagtcggccaggacgtggtagaacgccgttcggacgacccgtcgtccctaccaccgtgactattcgtcctntacggccgtacctacctaactaccgtaacgttacgttaaccgtaacgcgacgtacgtcggtccgtccggtcctaccggaccggtaacccgggaagggtaacggtacggtaaggtaacggttaagggtaacggttagtaacgttacgttaaccgtaacgtaacggtacggtacggaaccgtaacctaacgtaccgtaccgtacccgtacccctacgtaacgtacgtacggtacgtaccgtaacgtacctaacgtactaaccgtaaccgtacgtaaccgtaaacgtaaccgaacgtaccgtaccgtaccgtaacgtaaaggtaacgtcgtacgtacgtacgtaccggacgtacgacggtaccgtaaccgtacgttacgttaacgtacgtacgggtanaacggttacgttacgtttacgtttacggttacgttacggtccgttaacgtccgttacgttaccgtacgtaccggtacggtaccggttaaccgacggttacccgtaacgttcccgtaaccttccgaccgttaaccggacccgttacccgaacccgtaaccgg

SEQ ID NO: 123601 - DNA, 619 bp, Homo sapiens
  misc_feature: GYAE6OF02FVVSL.22.73.G07.1.454.CMB.1.raw
  modified_base (197)..(197): a, c, t, g, unknown or other
  misc_feature (197)..(197): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcaactaacttagtctggtaccagcagagaccgtggaccaggcctccccgaggcctcctcatctagtggtcgccttcgtaccgagggcctacgtggtactccccgctaggttcagtcgcgtaggtgggtcgtgggactagtacgttcacgtctcaccntcgancgagtccngctagttctaggtaagttactttcgacttacttttacttacgtcgttcaagtactaattaagttaagtcgtactttggtttctaccgttacttacccgtaccgttccgggaccgtaaacggggactaacgtaccgttaggggtaacttaaacggttaaaaccggacgttacggttggtaccttacggaaccctaccgtacttccgttcgttaccc

SEQ ID NO: 123602 - DNA, 542 bp, Homo sapiens
  misc_feature: GYAE6OF02IJLRR.22.73.G07.1.454.CMB.1.raw
  modified_base (315)..(315): a, c, t, g, unknown or other
  misc_feature (315)..(315): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcactagttactactggagctggctccggcagtccccagggaaggactggagtggattggggtatagtctattacactgggancacgatacatcccctcctcatgagtcgagtcactattcactagacacgtccaagaaccagttctccctagaaactgaggtctgtgaccgctgcggacacggccgtctattactgtgcgagatttgcgtttttggagttggttacgccgtcgtttgactacgtcggggccgtacgggaacccgtggtcaaccgttccgtccttccgacgccctcccaccgtaaccggg

SEQ ID NO: 123603 - DNA, 596 bp, Homo sapiens
  misc_feature: GYAE6OF02GU82N.22.73.G07.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcaacaacttagctggtaccagcagagacctggccaggctcccgaggcctcctcatctatggtncttcaccgaggccacgtggtactccccgctaggttcaggtggcaggttcgggtcngggaagacgtactttccacttcctacaaccatccaaactcgacctagacgccgtacgacgtattcgtgtactagtttacttactcgtacagtcacgtcgtaaccgagtcggtaccgttccggtacgttttcgggacccggtacgggggacccgtaaacggtcgtagggacgtacgtaccgaacggtaaccggtaacgtaggtcggtacgtcggaccaccgtacgttcgttacgttccttacttaccg

SEQ ID NO: 123604 - DNA, 740 bp, Homo sapiens
  misc_feature: GYAE6OF02IZPAQ.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccacctgtctgtcgtctaccgagggaaagcgccacctctcctgcgacgggccagtcgagtagtgttagcaaactaacttagtctggaccagcagacgaccgtggccaaggcctaccgaggtcctccgtacactctagtgtcgtccttaccgtaccgacgggtccaacgttcgggtaccctccccgtaccgtaggggtttccaaggttccgaccgtagggttcgggtccgtagggacctaggtacgttccacgtcgttaccaacccgtagtaccgaacgcgaacgtccccgttaggccctaacggtttcctaaagggtaaacgttttaggttttaccggaccttttaaactttttaacgtttaaccgttacgttaccggttaaacgtacttaaaatttaacgtttaaagttcggttaacgttttccggtttactaccgttacttacccgttaacccgttacggaacccggtaaggaacccgttacgaacggttacgggaaacgttaaccttaaacggtacggttacggtacggttacgtaccggaacctacgttaacgttcgttacgttaccg

SEQ ID NO: 123605 - DNA, 589 bp, Homo sapiens
  misc_feature: GYAE6OF02JHARH.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggcctcccgaggcctcctcatctatggtgcttctaccgagggccacgtggtactccccgcgtaggtttcaggtcgccgtaggtcgggtctggggacaggtacgttcactctacaccatcacgcacgcctgcacgtcgtagaagtactttgacttactttaattctgttacagtactaattattaagtcgtacgttggtttcctacgtacttccgtaccgttcggaccgtaagggacctacggtacgtagggtaacgtaacgttaaacggtaacgttggtacggtccgttacgacccgtaacctacgttaccttcggttacc

SEQ ID NO: 123606 - DNA, 727 bp, Homo sapiens
  misc_feature: GYAE6OF02JUMJN.22.73.G07.1.454.CMB.1.raw
tcagacatacgcgtcacgaccggtgctcgatttagctctacgctcagggtcgtccgaaggcttcgaccagtcctggacctccgtgtgcaagaacatgaaacagtctgtggtcttcttctcctggtggcagctcccaggatgggtcctgtcccgagctgcacgctgcaggacgtcgggcccaggactggtgaagtcccttcggagaccctgtccctcacctgtcctattcgtcctcgtggacgactacctagtcctacttagtttactacgtggtacgtctacggcctccggctacggtccccgaagggaccggactcggagtggtagttcgggtattacgtactaagttccgaacgttgggacgacgtacccgtaactaccgaccgtcccctacctcgagttacgtacgtcgacgtaccaccgtacttccgactacgacctaccgtacaacgtacctaggtccctaccgtagaaacgtggaacgtctaagtccgtaaccgctcggaccggacctcggaccttacgtaatacgtcgtcgacgtacttacgtttgttacgttttcgggaacggtttcggtaaccggtccgttcggttacggaccggttccgggttacggggaacccgttaacccgggtaacccgttcgggtacccgttaaccccggttccgtaccccgggtaccgttaacccggtcccccgttaacccggtaccccgtaacccccgggg

SEQ ID NO: 123607 - DNA, 590 bp, Homo sapiens
  misc_feature: GYAE6OF02IA9K7.22.73.G07.1.454.CMB.1.raw
  modified_base (194)..(194): a, c, t, g, unknown or other
  misc_feature (194)..(194): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccacctgtctgtgtctcgaggggaangcccaccctctcctgcagggccagtcagagtgttagcaactaacttgtctggtaccagcagacgacctggccaggcctcccgaggccttcctcattcctagttcgggtctctttccgtaccgaggggccctagttacgggtacctcccccggctagggtttccaggttcgacccgtagggttcggggtctaggggaccaggtcgttaccacttctacaccatccgaagtccacgtcctggactacgttctaggtaattcgttttacgactttactttattacgttgtacagtactaatatatgtattgtctagacttccaccgttcggaccgtaacggctacgcgtaggaagtaacgttaaacgcgttggtgcttcgacctactacttcttgtacc

SEQ ID NO: 123608 - DNA, 645 bp, Homo sapiens
  misc_feature: GYAE6OF02III5S.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccacctgtctgtgtctccgaggggaancgccaccctctcctgcagggccagtcaggacgtgttagcaaactaactttagctaggtacagcagacgacctggccaggctcccgagctcctcatcgtatggtctcttcaccgacggcctacgtcggtacctccccgtcgtacggttcagtcgcgtaggttcgggtcgtaggggactaggtacgttcacgtctacgaccatacgacgctacgtcctagctagtctagaagtgtttcgcttaatttattactgtactagtactaaataagtaatcgtaacgttcggttactacgacgttaccgtaccggttacggaacccgtaaacgggtacctaccgggtaacgttcggggtaaaacgttaaacggtttaaaaacccggtaacggttcgggtaacggttacccgtacggttaaccccaaccgttacggtttccgtttaaccgttacccg

SEQ ID NO: 123609 - DNA, 587 bp, Homo sapiens
  misc_feature: GYAE6OF02HAK2A.22.73.G07.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (418)..(418): a, c, t, g, unknown or other
  misc_feature (418)..(418): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccagtcagagtgttagcaacacttagtctggtaccagcagagacctggccaggcctcccgaggctcctcatctagtggtncttcctaccgagggcctacgtcggtactccccgctaggtttcagtcgccgtaggtggggtctggggactaggtagttcactcctaccaccatcagccacgccctgcctagtctagtaagttntttcggaccttacttttattactgtaccagtactaaattataattgtacgttggttctcgtacttccgtaaccgtttcggaccgaacgggtaccacggtacgtagggtaactaacgttaaacgacgttaggtcggtacgtacggacctaccgtacgttccgttagttcc

SEQ ID NO: 123610 - DNA, 643 bp, Homo sapiens
  misc_feature: GYAE6OF02GYGRV.22.73.G07.1.454.CMB.1.raw
  modified_base (325)..(325): a, c, t, g, unknown or other
  misc_feature (325)..(325): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagtccgttcggagaccctgtccctcacctgcattgtctctggcactcatcactagttactactggagctggctccggcacgtccccgaggggaacggacgtggagtggtaagttgggtatatctaattacacgtgggacncgacccgactaccgacgtcccctcctcagtcgacgtcgacgtacctactatttcaacgtacgacaccgtaccaaacgtaaccctagtcctacccagtaaactgtaacggttctgtacgtaccgcgtcggtccggaacgccggtccgtacttacgttactggtcgtacgtagtcgttttcgttacgttttgggtacgttcgggttccgtccgttcgtttcggtaccgttacggtcgggggtaccgtaaccgggttacccgttacggtacccgtaccgttcccgtaccgtcgacccgtcccgtacccgacggtacccggg

SEQ ID NO: 123611 - DNA, 792 bp, Homo sapiens
  misc_feature: GYAE6OF02JT0JM.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccacctcgtcctgccagggccagtcaggtagtaggttacgactaacgaaactttcggtcttacggtaaccagacgtaaggacgtacccgttacggccgtaacggtcccgtcccgacggtccttacccgtctaacgttagtaagtcggtatcggaccgtttaaccgaaaacggggtccctacggtacggccaacgtaccccgacgtcccggtacggttacgcggtacgggacgtgggttacgggaccggtaggaaacggcgtacgttaaccgccttaccgtaccaaccacgttaccgaactacgtacctaggaccgtaccgttacgaccgttagttccgtacgtactttaacgtttaccgttagtcggttacgacgtaccgtacggttaaccggtaccgtaacgggtcccggtaccccgttacggttacccggttttaccggcccggggttaaacggggtaccgaaccgggtccggttacggggaccgttaaccgggtacggttaaccggtaaccggggtaacgttacggggttcccggtaacgttccgggaaaccttaacccgggtttaactacccgggtttacgtttacccg

SEQ ID NO: 123612 - DNA, 616 bp, Homo sapiens
  misc_feature: GYAE6OF02IXEB9.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcaacaacttagtctgtaccagcagagacctggccaggcctcccgaggcctcctcattcctagtcggtgccttcgtaccgagggcccagtcggtacctccccgctaggttccaggtcgaccgtaggttcggggtctcggggactaggtacgtttccaaccgtcctaccaaccctattccgaacgccacgccctggcctagttctaggaacgtttgtttcgacttacgttttattacgtgttacagtactaataataagtcgtacgttgttactacgtactccgttaccgttcggaaccgtaacgggtccgtacgtacggtacggtaattaaacggttaaacgtacgtaggtacggtcgtcgtaccaccgtattccgtcgttacc

SEQ ID NO: 123613 - DNA, 620 bp, Homo sapiens
  misc_feature: GYAE6OF02HQVYF.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtcctccacgccaccctgtctgtgtctcgaggggaanacgccaccctctcctgcgagggccagtcagagtgttacgacaacaacttagtcttaggtaccagacagacgacctcggccacggcctaccccgaggcctcctcattcgtagttcggtacgtcctttaccgtaccgaggggccctacgttcggtacctcccccggcgtacggttcagtcggaccgaggtcgggtctggggactagtacgttccactcctacaccataccacgtacagccgtgccgtagtctagtaagttactttgacttacttattacgtgtactagctaaattatagtgtacttggttcctagacttaccgtccgttcggaaccgtaagggactacgtagtacggaacgtaacgttaaacgtaccgttagtccgggtactaccggtaccaccggtactttacgtacgtttacc

SEQ ID NO: 123614 - DNA, 729 bp, Homo sapiens
  misc_feature: GYAE6OF02I3KOX.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtcctgtgtctaccaggggaacacgcccaccctcgtcctgcaagggccagtcgagagtgttacgcaactaagttgtcgttacggtaccagccaggagtaccgtggaccaggcctcccgaggctccgtacatccgtagtcggtcgtccttaccgtaccgaggaccctacgtacggttaccctcccccggcgtacggtttacagttccggacctagggttcggtcgtcggggaactacggttaacggttcctaacgttccgtaccacccgtagtcctaacggccgtaacgccttcggaccgtacggtacgttacggtaacggttacttttcgggaactttactttttacgtaacgttttcgaccgttaacgtacgttaaattaagtttaaactcggttaacttccggtttaactccggttaacttaccggttacccgttacgggacccgttaaagggaaccctacgggtaaccgttacgggaaacgtttaacgtaaaaccggtacttaggggtaccgtcggttaccaccggtaacttacgttgtacccgtttacgg

SEQ ID NO: 123615 - DNA, 781 bp, Homo sapiens
  misc_feature: GYAE6OF02JXX3L.22.73.G07.1.454.CMB.1.raw
tcagacatacgcgtcacgaccggtgctcgatttagctctacgctcagggtctccgaaggcttcaccagtcctggaccctcctgtgacaagaacatagaaacatctgtggttcttccttctcctggtgcagctcccagatgggtcctcgtcccagctgcagctgcaggagtccgggcccaggacgtggtagaacgtccgttcggacgtaccctcgtcccctcacctgctattcgtctcgtggccgactccatcctacttagttactacgtggacgcgtcggccgtccggcaccggtccccgaaggggaacggtacgtgggtacggtggtaggttgggtaatactacttaacgttacgacgtgggacgccgaaccgtacgtaccgacccgtcccctaccctactacgtacgtacggtccgtacgtaccaaccgttacgtttccaaacgtaacgtaccctaacccggtaaccaaaaccgtaacccgttaccgtttcccttaacccgtaacggtaaaccgtcggtaacggttccgttacgggtaccggtaccggtccgtcggaccggaccgtacccggtccgttaacctttacgttaccgttcggtacggtacgtaacggtttgttttacgggtttacggttttagggtacgtttcggttaccggttccgttcgtttacggtaccggttaccgggttaccgggtcccggtaaaccgggttccggttacgttacccgtaccgttcccgtaccgtcggtaccgtccccgtaccgaccccggtaccgg

SEQ ID NO: 123616 - DNA, 626 bp, Homo sapiens
  misc_feature: GYAE6OF02GBENE.22.73.G07.1.454.CMB.1.raw
  modified_base (252)..(252): a, c, t, g, unknown or other
  misc_feature (252)..(252): n is a, c, g, or t
  modified_base (431)..(431): a, c, t, g, unknown or other
  misc_feature (431)..(431): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgccattgtctctggcgactccatcactagtactactgganctggctccggcagtccccgagggaaggcgtggacgtggtaattggggtactagttcgtaattacacgtgggagcaccgactacacgccctcctcactgacgtcgacgtcaacctattcactacactaccgtacaacgaacctagttcctacctacgaaactgacgtctgtacgaccgcngacggaccgacggtccgttactacttacgtggtcgtacggtaagttacgttttacggtcgttttttcgggacgtttacgggtttaccgtccggttacgttttcggtaccgttacggtcggggtaccgaccgggttaacccgtcggttaccgaccggttcctccgttccgacgtccctacccgacccgtaaccggg

SEQ ID NO: 123617 - DNA, 863 bp, Homo sapiens
  misc_feature: GYAE6OF02H3TLE.22.73.G07.1.454.CMB.1.raw
  modified_base (195)..(195): a, c, t, g, unknown or other
  misc_feature (195)..(195): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctcagccacctgtctgtgtctccgaggggaaancgccaccctctcctgcagggccagtcagagtgttacgacaaacgtacttacgtctacggtaccaggcagacggtaccgtcgggaccacggcctccccgagggtccctacccgttctaacttcgttaacgtttcgggtaccgttccgtttacccgtaacccggtaccggggtaccccttaccggttacgggttaaccccgttcccccccggacggttaacgggttcgtaacggtccggtacccgtagggttcgggggttaccgtcgggggaactacgggtaacgtttccaaccttccgtaacctaccctaagtccgaacggtcccgaaccggtccccgttcgggaacccgttacgggtttacccgttaaacgggttaaacgtttaccggttttttacggaccccgtttttaaacgtttttttaaacgttacccgttttagtaacccgggtaattaaccgttaaattaaacgtttaacttaggttaacccgttttagggtttaccttacggttaaccgttacccgtttaacccggtccgggtaacccgaaacggggttaaccgacccgggttaacgtaacggggtaaacttaaacgggtttaaacccggttaaccgtgggttaaccgggcttacgacccccgttaactacggtttccgtcccgtttaacc

SEQ ID NO: 123618 - DNA, 650 bp, Homo sapiens
  misc_feature: GYAE6OF02H4DSF.22.73.G07.1.454.CMB.1.raw
  modified_base (199)..(199): a, c, t, g, unknown or other
  misc_feature (199)..(199): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtgtctccgagggggaaanacgcccaccctctcctgcgacgggccagtcagagtgttagacaactaacttagtcgtaggtaccagacagacgacctggccaggcctccgaggcctcctcatctagtggtcgtcttacctaccgacgggcccacgttcggtacctcccccggcgtacggttcacggtcgcccgtagggttcggggtcgtaggggactaggtacgtttaccacttcctaccacctatccgacgcctacgtccctggacacggtttcgtaaggtacgttagttttcgactttacttttacttaccttgtacaatactaataattaagtgtacgtttcggttactacgtacttccgtaccggttacggaccgtaaggtaccacggtacggttaggaacgttaacgttaaaccggacgttacggacggtctaccggaccttaccgtagtttccgtacgtttaccc

SEQ ID NO: 123619 - DNA, 631 bp, Homo sapiens
  misc_feature: GYAE6OF02GY82L.22.73.G07.1.454.CMB.1.raw
  modified_base (318)..(318): a, c, t, g, unknown or other
  misc_feature (318)..(318): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactgggtgaagccttcggagacccctgtccctcacctgctattgtctctggcactccatcactagttacctagtggagctggctccggcacgtccccagggaggactggagtggagttgggatatctattacacgtgggancaccgactacacgcccctcctcatgacgtcgagtccactatttcactagacacgtaccaacgaacctagttcctaccgtacgaaactgtacgtctggtacgaccgtcgtcggcggaccgaccggcccgttattacgttacgtggtcgcgtacgttacgttttgttcgttttttgggacgtttacgggttaccggtccggttcgtttacggaccgtttacgggtccgggggaccgttaaccgggggtaaccctgggtacccgttaccggttccttcccgtaccgaccggtccctacccgacccgtaacccgggg

SEQ ID NO: 123620 - DNA, 670 bp, Homo sapiens
  misc_feature: GYAE6OF02JPHJS.22.73.G07.1.454.CMB.1.raw
  modified_base (380)..(380): a, c, t, g, unknown or other
  misc_feature (380)..(380): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccaggactggtgaagccttcggagacccctgtcccctcaccgtgccatttgtccttcgtgggaccacctccatcactagttactacgtggagctggcctccggctacgtcccccgaggggaacggtactgggacgtgggaacgtttgggtaattatcttattacctacgtgggactccaaccggtactacgacgtccccctaccgtnagtcgaggtccgagtccgacctactttcaccgttacgacaccgtaccaaaggtaacccagtttccctaccctagaaactcgaggtcgtagtcgaccgcgtacggtccggaccgacccggtccgtacgttattaccgtggcgtaccggagttgtttcgttcgtttttggacggttcggttaccggccgttagttccgtacgttacggtcggggtcccgtacgggttaacccgtcggtaccctaccggttcctaccgttcccgaacggtcccctaccgacccggtaacccgg

SEQ ID NO: 123621 - DNA, 921 bp, Homo sapiens
  misc_feature: GYAE6OF02IYFW8.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggccaggactgggtgaagtcccttcgggacgacccctgtcccctcaccgtgcctatttcgtctcctaggcgtacctccattccaacttagtttaacctacgtggacgtcgtcggtcctcccggtccacggttcccccgaagggggaaccgggtacgtacgggaaggttcgggtaaggtttacgggggttacttaacgttaccttaaacgtttaccggtaacggttacggggtaccgacccgtaacccgggtaaaccttaccgaacccggtccccccttacccgtacctaacgttcggaacggttaccggtaacgttacctaaccgttaactttttaccgaaaccgtaacgtaaccctaaaccggttaacccgtaaaaccggtaaaccctacgggtttttacccctaaccccgtttaacggtaaaaccggttacggtaaaccggggtttccttaacgggttacccggaacccggtttcccggacgggtacccgggaacccggtacccggggttacccgttaccgttaacccgttttacgtacgggtttcggaacggtaaggttttacgttttcggtttacggtttttttacgggggacgttttacggggtttaacccggttccggtttacggttttaccggtaccgttccgggttacgggggtacccggttaacgggtaaccccgttcggttaccgttacccggttccttacccgtacgacccgtcccttacccggtacccgtaacccgggg

SEQ ID NO: 123622 - DNA, 729 bp, Homo sapiens
  misc_feature: GYAE6OF02GOOQL.22.73.G07.1.454.CMB.1.raw
  modified_base (199)..(199): a, c, t, g, unknown or other
  misc_feature (199)..(199): n is a, c, g, or t
  modified_base (709)..(709): a, c, t, g, unknown or other
  misc_feature (709)..(709): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggagaaatagtgtatgacgcagtctccagccaccctgtctgtgtctccgaaggggaancgcccaccctctcctgcgagggccagtcagtgtgttacgactaacaacttggtcctacggtaaccagacgtagacgccgtggaccaggcctcccgaggcctccgtacattctaacgtggttaccgtccttaccgtaaccggagggtacccctagttaccggtaacctccccggacgtaggttccacggtcgccgtaggtcgggttacgtgggacctagtacgttcaccgttaccgaccacctatccgacgaccacggtcctcggtactacggttacgtaggttaaacgttcgtttacggtacctttaacgttttacttaccttagttaaccgtaagtactaaaacgtttacgttaaacgttacgttaccgttaggttttacccaccggtttaacttacccgtcccgtttaaaccgggaacccgtaaacgggtacctaaccggtgtaaacggttaacggtaaaccgttaaaccggtaagtaccggttcgtaacgtcgtacccaacccgttnttacccgtccgtttaacccg

SEQ ID NO: 123623 - DNA, 626 bp, Homo sapiens
  misc_feature: GYAE6OF02FWE9K.22.73.G07.1.454.CMB.1.raw
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagtcttcggagaccctgtccctcacctgcattgtctctggcactccatcactagttactactgganctggctccggcacgtccccgagggaagggactgggagtggagttgggtatatctattacacgtgggacncaccgactacncgtcccctcctcatgacgtcgagtccactatttcactagaccaacgtaccaaacgaacctacgttcctacctacgaaacgtggacggttctggtacgaccgctcggccggaccgtaccgggtaccgttctaactttacgtggtacgcgtagttacgttttgttcgtttttgggtagttcgggttaccgtccggttacgtttacgtacgttaccggtgggggtacccgtaaggggtaccttcccggttaggtacccgtaccggttctcccgtcgtaccgtcccctaccgaacccgg

SEQ ID NO: 123624 - DNA, 659 bp, Homo sapiens
  misc_feature: GYAE6OF02H7W6H.22.73.G07.1.454.CMB.1.raw
  modified_base (198)..(198): a, c, t, g, unknown or other
  misc_feature (198)..(198): n is a, c, g, or t
  modified_base (448)..(448): a, c, t, g, unknown or other
  misc_feature (448)..(448): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtcgtctccgaggggaaanacgcccaccctctcctgcagggccagtcagagtgttagacaactaacttagtctggtaccagcaagacgactggccaggcctccaggcctcctcatctagtggtcgtcttctaccgcggtcctaacgtcggtacctcccccgtccgtacggttctaggtcgccgttagggtgggttcgtaggggtaacagttacgtcctacttctacacctatccgacgcacgtcctaggcctaggtcctagttaacgtntttcgctttaatttacgttacgttgttacagtaactaaattaactacgttacgtacggtttcgtactacgtaccttaccgttacccgtacgggaacgtaacgggaccgtaaccgtacggtaacgggtaacgtaaaccgttaaaccgggtaagtttccggtacggtaccgttacgtaaccccgtacttacgttttccgtaccgttttacccg

SEQ ID NO: 123625 - DNA, 784 bp, Homo sapiens
  misc_feature: GYAE6OF02GPZC0.22.73.G07.1.454.CMB.1.raw
  modified_base (201)..(201): a, c, t, g, unknown or other
  misc_feature (201)..(201): n is a, c, g, or t
tcagacatacgcgtcacgaccggtgctcgatttagctctacgctcagggggaggaactgctcagttaggacccagacggaaccatgggaacgccccagcgcagcttctcttcctcctgctactctggctcccagataccactggagaaatagtgatgacgcagtctccagcccaccctgtctgtgtcctcgaaggggaaancgccctaccctctcctgcgacgggccagtcagtagtgttagacaactaacttagtctggtaccagcgagacgaccgtggccaggcctccgaggtcctacctcattctagtggtctaccttcaccgacggtcctagttcggtacctccccgacgtacggttccaaggtccgtacccgtagggttcgggtacgtacggggaactaggtacgttccaaccgttcctaccgaacctactccgaacggcctacggtcccgtaggtaccctaaggttaccgtaaggtaaacgtttacgttttaccggaacctttaacgttttttaacgttaccgtttagttacctaaggttaaccttaaaattaagtttaaacgttacggtaaccgttttacgggtttacctaccgggtaactttaccccgggtaacccgttaccgggaaacccggtaaaggggtacccgtaacgggttaccggttaacggggtaaaaccgttaaacggtttaaaaccggtaacggtttcggttaacgggttaccgttacccggaaacccgttaaccccgttaaggttttacccctacggttttacccc

SEQ ID NO: 123626 - DNA, 779 bp, Homo sapiens
  misc_feature: GYAE6OF02JYODL.22.73.G07.1.454.CMB.1.raw
  modified_base (331)..(331): a, c, t, g, unknown or other
  misc_feature (331)..(331): n is a, c, g, or t
tcagacatacgcgtcacgaccggtgctcgatttagctctacgctcagggggaggaactgctcagttaggacccagacggaaccatggaagccccagcgcagcttctcttcctcctgctactcctggcctcccagataccactggagaaatagtgatgacgcagtctccagccaccctgtctgtcgtctccgagggaactacgcccaccctctccgtcgcgacgggtcacgtcgagtagtgttacgactaaacgattcgtacgtagtaccagacagacgtacctcggccagggtcctccgagggtccctccgtcacgttctagtcggttacnctttacccgcgtaacgggtccccgaacgtttccggtaacctcccccggtaccgtacgggtttccgacggttaccgggacccgtaggggttccgggggttaccgtgggggtaaccgtacgggtaccgtttaaccggtaacccgtttccgttcccaaccggtaccttacgtacggaccgtaaccgtccgtacgtaccgtagtaccggtaggtaaacgtttcggtttactaccgtttaaacgttttactttaccggttacgttacgtacgttacttacgttaagtttaacgttacgtttaccgtacgggtttaccttagttaccttaccgttaccccggttacgtacccggtaagtaacccgtaccggtaggtaacgtaacggttaaacgttaaccgtaacgttacggtagtaccgttaacgtaccgtaaccgtcgttactccggttaacc

SEQ ID NO: 123627 - DNA, 868 bp, Homo sapiens
  misc_feature: GYAE6OF02FUHUL.22.73.G07.1.454.CMB.1.raw
  modified_base (196)..(196): a, c, t, g, unknown or other
  misc_feature (196)..(196): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaancgccaccctctcctgcagggccagtcagagtgttagcaactacttagtctggaccagcagagacctggccaggcctcccgaggcctcctcattcctagttcgggtcgtcctttccgtaacccggacggggtccctaacggttcgggttaccttcccccccgggacgtacgggtttaccaacgggtttcggacccgttaggggttcgggggttaccgtacgggggtaaccaggttaccgtttcccaacctttcccgtacccaacccgtagttcccgaacggtcccgtaaccggtcccgttacggtacccgtaacggtttccgtaacgggttaaacgtttacgtttttaccggaaccgtttaaacccttttttaacgttttaaccgtttcggttacccgtaaacgttaaccgttaaaactttaaacgttaaacgtttaaccgggttaaccgttttaccgggttttaccctttacccgggttaactttaccccggttaaccccggtttacccggggaacccgtaaaccggggggtaaccctacccggggttaaccggttacggggttaaacgttaaaccggttttaaaaacccggtaacggtttacgggttaccggttaccggttaccggaacccgttaacccgttaccgtttaccggtttccggttttaacccc

SEQ ID NO: 123628 - DNA, 673 bp, Homo sapiens
  misc_feature: GYAE6OF02I9ECT.22.73.G07.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
  modified_base (417)..(417): a, c, t, g, unknown or other
  misc_feature (417)..(417): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaanacgcccaccctctccctgcagggccagtcagagtgtagcaactaacttagtctggtaccagcagacgacctggccaggcctcccgaggcctccctnacttctagtggtctccgttctaccgacggcctacgtcggttaccncccccggctaggttcagtcgccgtaggtgggtcgtagggacaggtacggttccaccttcgaccacctactcgacgacnccgtcctgctaacgtctaagtaagttctttacgaccttaaacttttacgttacgtcgttacaagtacttaaagtaattaacgtaggtaccgtttggtttacctacggttaacttacccttacccggttaccgggaaccgaacggggtaacctacgggtaacgtacggggtaaaacttaaaccggttaaaaccggtaaccgttgggttaccgtccgttaacgtacccaacctttacggttccgtacgttttacccgg

SEQ ID NO: 123629 - DNA, 836 bp, Homo sapiens
  misc_feature: GYAE6OF02JCC83.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggganaccccttgtccctcacctgcattcgtctctggccgtactccatccacgttagttactactggagctggcctccggcacgtaccccgagggaaggtctaggagtcggtagttgggtattagtctagttaccacgtagggtacgacctaaccgtaacgtacgaacccgtcccccgttccctacgtactcgggtaacgttaccggaacgttacctacccgttaacgttttaccaaaccgttaacggtaaccctaaccggttaacccaaaacggtaacccgttacggtttccctaacccgttaaacgaaaccggttcggtaaacggttccgttaagtaccgggtacccgtcgtacgggaccggtacccggtaacccggttcccggttaacgttaacgtttaccgtgggtccgtaacggtaacggttttacgttttacgggtttccggttttttacgggaacggggttttacggttaccccggttaccggttcgtttttacccggaaccggtttacggggtaccgggttaacccggtaaccggggttaaccccgttgggttaaaccccgttaccccggggtttacccttacccggtacccggttaccgacccccggttaacccctaacccgggttaaccccggg

SEQ ID NO: 123630 - DNA, 1022 bp, Homo sapiens
  misc_feature: GYAE6OF02G3KT0.22.73.G07.1.454.CMB.1.raw
  modified_base (165)..(165): a, c, t, g, unknown or other
  misc_feature (165)..(165): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggngtccgggcccaggacgtggtagaacgtcccttcgggacgaccctggtcccctcacccgtgcctattcggtcctcgtcggccgtactcctaatccgtaacgttacggtttaactaccgttagggacgtccgttcgggccttccgggcctaccggttcccccgaagggggaacgggtacgttcggggtaaggttcgggttaaggtttaggggtaacttaacgttccgtttaagttaaccgtacggttacggggacgttacccgaacccggttaaaccgtaacccgtacccggtaccccccttacccgttaccgtaacgtacggggtaaccggttaccggtaaccggttaacccgtaaccctttaaccgttttacccggtaaccggttaaaacgaccccgtaaacccggtttaacccgaaaaacccggtaaacccgtttacccgggtttaacccttaaccccggttaaaggttaaacccgttacggggtaacggttccgttacggttacccggtacccggtaccggttcgggaacccggaaaccgggttccccgggttaacccgttaccgtttaaacggtttacggttaccgggtaccgggtaaccgggttaaacgttttaaccggtttttcgggtttttaccgggttttttaacggggttaacgggtttcccgggttttaaaccggccccgggttttggttttacccgggtaaccgtttaccgggggtccggggtaaacccgggttaacccgggttaacccgggtttccgggtaaccccgtttacccggtttccccgttaccggtaaccccggttaccccggccccctttaacccgggaccccggttaaacccccgggg

SEQ ID NO: 123631 - DNA, 718 bp, Homo sapiens
  misc_feature: GYAE6OF02F6AX5.22.73.G07.1.454.CMB.1.raw
  modified_base (166)..(166): a, c, t, g, unknown or other
  misc_feature (166)..(166): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagagtgggtcctgtcccagctgcagctgcaggngtcgggcccaggactgggtgaagccttcggaacgtccctgtcccctcaccttgcctattgtctcgtcggaccgacttccagtccaacttacgtttactacgtggacgtcgtcggctcccggacaccggttaccccgaaggggtaacgggactgggtacggtggtagtttaggggtaacttacgttcttaacgtttaaccgaacggttggggaactccgaaccgtactaccgacgtcccctacctcgtacgagtacggttacgacgtttaccgaacctagtttaccgaaccgtagacctaaccggttaacccaaacggtaaaccttcggtttacctcccgtaagtaaaccgtacgtacggttcgtacgtcgaccgtcgacggtcggacgaccggtcgttaccgtagttaccgtcggacgtcgtaaggtttcgtttcgtttcggttttacgggtagttccggttacgtccggttgttcgtaccgttacggcgggtaaccgtaccggtacggtcgtacctccggtctccttccgacgtcccttcgaccgtaccgg

SEQ ID NO: 123632 - DNA, 601 bp, Homo sapiens
  misc_feature: GYAE6OF02JD1YP.22.73.G07.1.454.CMB.1.raw
  modified_base (355)..(355): a, c, t, g, unknown or other
  misc_feature (355)..(355): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagcctttcggagaccctgtccctcacctgcattgctctggcgactccatcactagttactactggagctggctccggcacgtccccgagggaacggactggagtggagttgggatagtcttattacacgttgggagccaaccgactacacgcccctcctcatgacgtcgnacactatttcaactagaccacgtaccaagaaccacgttcctaccctagaaactgtaggtcgtgtacgaccgctcgaccggtacgaccggtccgttctaactttacgngtcgagacgtnttttgtacgttttgggacgttcggtaccgtccggttacgtttcgtaccgtacgttacgggggacctacgggtaaccctggacccttaccggtcctcctccgtcgaccccgttcaacccggtaacccgg

SEQ ID NO: 123633 - DNA, 823 bp, Homo sapiens
  misc_feature: GYAE6OF02GV5IH.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctccagatgggtcctgtccagctgcagctgcaggagtcgggcccaggactggtagaacgccttcggacgaccctggtaccctcgacctgcctattggtctcgtggccgtactccatcaacttagttactactggagctggcttcggcacgtccccgaagggacggactggagtggattgggtatatctaattacacgtggagaccacgactacgacgccccttccgctacgtacgtacggtcgaacgtcctaacgtacgttttccaaacgtaacggtacctaaccggttacccaaacggtaaacccgttacgtttacccttacccgttaacgtaaaaccgttcggtaacggttaccgttacggtaaccgtacccggtaccgtacggtacccggggaaaccgtacccggggttaccgttaccgttaaacgttaccggtttcggtaacggtacccgggttaaaggttaccgtttttccgggtttaccggttttttttaccggggaacgggttttaccgggtttaaccggttccccggtttacgggttttaccggtaccgtttaccggggttcccgggggtaacccggtaaaccggggttaaaccccgttccgggttacccttacccgggttaccccgtttaaccgttccccggtaaccggttaccccttacccgggtaacccgggttaaaccccggg

SEQ ID NO: 123634 - DNA, 655 bp, Homo sapiens
  misc_feature: GYAE6OF02G1UM5.22.73.G07.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (440)..(440): a, c, t, g, unknown or other
  misc_feature (440)..(440): n is a, c, g, or t
  modified_base (483)..(483): a, c, t, g, unknown or other
  misc_feature (483)..(483): n is a, c, g, or t
  modified_base (643)..(643): a, c, t, g, unknown or other
  misc_feature (643)..(643): n is a, c, g, or t
tcagacatacgcgtcacgaccggtgctcgatttagctctacgctcgagggggaggaactgctcagttaggacccagacggaaccatggaagccccagcgcagcttctcttcctcctgctactctggctcccagataccactggagaaatagtgatgacgcagtcctccagcccaccctgtctgtgtctccgaggggaaangccaccctntcctgcgagggccagtcagtagtgttacgcaaactacttagtcgtaggtaccagcaagcgaccgtggccaggcctcccgaggcctcctcgactccgtatcgggttcgtaccttaccgtaaccggcgggtacccctaaggttcggtaacccgttcccccggcgtaacggttcgacgtcgacccgtagggtcgggtcgtagggaacaggtacgttcaccgtccgtacaacctntaccgacgtcgacgaccgtcgacgtagtaccgtagtaacgttntttacgactttaactttagttcgtagtaccgtagtactaaattagtaacgtagttaaccgttgttactaccgtattcccgtaccgttccggaaccgaaggtacctacggtactacggtaagtaaacgttaaacgaggtcgtgacgtcggacctaccggtnttcgtcgttacc

SEQ ID NO: 123635 - DNA, 939 bp, Homo sapiens
  misc_feature: GYAE6OF02IUGZB.22.73.G07.1.454.CMB.1.raw
  modified_base (165)..(165): a, c, t, g, unknown or other
  misc_feature (165)..(165): n is a, c, g, or t
  modified_base (257)..(257): a, c, t, g, unknown or other
  misc_feature (257)..(257): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggngtcgggcccaggactggtgaagtccttcggagaccctgtccctcacctgcatttgtctcgtggcgactccatcactacgttactacgtggancgtcggctccggctacggtaccccgaaggggaacgggactgggagttggtacgttaggggtattacgttacttaattacgtacggttagggacgaccgtaccggtaactaccgtaaccggcccccttaccctacgtacgttacggaacggttaccggtacgttaacctaacccttaacgttttaccctaaaccgtaacggtaaccctaaacccgggttaaaccccgaaaaccggttaaaaccccgttacggttttaaccccctttaaccccggttaaacggtaaaaacccctttcgggtaaaccggggtttccgttacgggttaaccggtaacccggtccgttaccgggaaccccggggtaaccggtaaccccggggttaacccggtttaaccgtttaaacgttttaccgtacgggttcggtaaccgggttaacggttttaacggttttttccggtttacgggttttttttacggggtaaacgggtttttaccgggtttaaccggtcccggggttttacgtttacgggttacccgtttaaccgggttcggggggtaacccggttaaaccgggggtaaccccggtttccgggtacccccgttacccggtttacccggttacccggtttaccccgtaacccggtttacccccgttacccgggtaaaccccgttaaccccggggg

SEQ ID NO: 123636 - DNA, 606 bp, Homo sapiens
  misc_feature: GYAE6OF02HV92P.22.73.G07.1.454.CMB.1.raw
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (440)..(440): a, c, t, g, unknown or other
  misc_feature (440)..(440): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccgttcggagaccctgtcccctcaccttgcatttcgtctcgtggcgactccatcactagttacacgtggacgcgtggctccggcacgtccccgaggggaacggctgggagtggagttgggtatacgtctattacacgtgggacncgaccgactacgacgtcccctcnctatcgagtcgacgtcacctntttaccactagaccgtacgtaccaaacgacctagttcctaccctagaactggagtctgcgaccgntcggacgacgacggtccgtattagttcgagtcgagtagttatttcgtcgttttggacgtttcggtacgccgttgtttagaccgttcggtacgggccgtaacgggtacccgttcgtacccgccgttccgtacccgtcgaccggtcccttaccgacccgtaacccggg

SEQ ID NO: 123637 - DNA, 557 bp, Homo sapiens
  misc_feature: GYAE6OF02GPQHE.22.73.G07.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctcagggggaaangccaccctctcctgcagggccagtcagagtgtagcaacaacttagtctggtaccagcagacgacctggccaggctcccaggctcctnatctatggtncttcaacgagggccacgtggtactccccgctaggttcagtcgcctaggtcgggtctagggaacaggtacgttcaactccgtacaacctatccaagcgacgtcctagactagtctagtaagtatttgacttactttagttactgtacagactaataataatgtacgttgttctcgtattccgaccgttcggaacgtaaggacacgacgtaggaacgtaacttaaacggacttggtacgacttacgacctaccgagttctgttacc

SEQ ID NO: 123638 - DNA, 593 bp, Homo sapiens
  misc_feature: GYAE6OF02FH7PE.22.73.G07.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtcgtctccgaggggaaanagccaccctctcctgcagggccagtcagagtgtacgcaacacttagtctggtaccagcagagacctggcctaggcctcccgaggtcctccnatctatggtncttctacgagggccacgtggtactcccccgctaggttcagtcgccgaggtcgggtctgggacaggtacgttcacgttcaccaccatccagcagtccngcagtctagtaagtattttgacttactttattacgtgttacacgtactaatataactgacttggttactcgtacttccgtacccgttcggaccgtaacgggacctacggacgtacgggtaacgtaacggttaaaccgtaacgttacggtacggttacgttacgacccgttaaccgacgttccgttacggtttaccc

SEQ ID NO: 123639 - DNA, 611 bp, Homo sapiens
  misc_feature: GYAE6OF02GWRCX.22.73.G07.1.454.CMB.1.raw
  modified_base (318)..(318): a, c, t, g, unknown or other
  misc_feature (318)..(318): n is a, c, g, or t
  modified_base (339)..(339): a, c, t, g, unknown or other
  misc_feature (339)..(339): n is a, c, g, or t
tcagacatacgcgtcacgaccggtgctcgatttagctctacgctcagggtctccgaaggcttcaccagtcctggacctcctgtgcaagaacatgaaacatctgtggttcttcctttctcctggtggcagctcccagatgggtcctgtcccagctgcagctgcaggagtcgggcccaggactggtgaagccttcggagaccctgtccctcacctgcattgtctctggcactccatcactagttactactggagctggctccggcacgtcccccgagggaaggactggagtggagttgggtatatctattacacgtggancaccgactacacgcccctccncatgacgtcgacgtcactatttcactagactaacgtaccaaagaaccagtttcctacccgtagaaaaccgtgtaggtctgtacgaccgctcggaccggaacgaccggccgttactacttactgtcgacgtagtacttttgttcgtttttaggagttggttaccgccgttggtttacgaccgttacggtcggggtacccgtaagggtaaccccgttgggtacccgaaccgttccttcccgtacgaccgtcccgttacccaccggtaacccggg

SEQ ID NO: 123640 - DNA, 735 bp, Homo sapiens
  misc_feature: GYAE6OF02GJKX8.22.73.G07.1.454.CMB.1.raw
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgccgagggccagtcagagtagttagacaaacctaacgttagctacgggtaccagacaagacgaccgtggccctaggcctcccgaggtcctccctnacttctagtcggtgtaccttcgtaccgagggccctagtcggtaccnccccgtcgtacggttcacggtcgccgtagggtcgggtctggggactaggtcgttccacttcccgtacacctaatccgaagtccgtacggtccccgtaggtaccgtacgttccgttagtaaaggtttcttttacgggacctttaaacgttttacgttaccttggttaaccgtaagtaccgttaaatttaacgttaaacgttacgggtaacccttttcggggtttaacccttacggttaacccgtttccgtaaaccccggtttaccggggaaacccgtaaaggggtaccctaacgggtaccggttaagggaaaccgttaacgttaaacggtacgtttcgggacgttaccgtacgacccgttactaacgtttcccgttgttaccc

SEQ ID NO: 123641 - DNA, 694 bp, Homo sapiens
  misc_feature: GYAE6OF02GHNBA.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcaggggggaggaactgcctcagttaggacccagacggaaccatggaagccccagcgcagcttctcttcctcctgctactctggctcccagataccactggagaatagtgatgacgcagtctccagccaccctgtctgtgtctccgaggggaancgccaccctctcctgcgacgggccagtcagagtgttacgcaactaacttagtctggtaccagcagacgaccgtggccaggcctacccgaggtccttcccgtactacttacgttacgttgggtctccgtttaccgtaacccggacggggtaccctacggttcggttaaccctccccccggaccgtagggtttccacggtcgacccgtagggtcgggttccgaggggaacctaggtacgtttaccacgtcctacctaccaacttccgagcctacgtcctcggacctagtccgtaggtaacgttacgtttacgacctttacttttagttaccgtcgttacaacgtactaaattaattaacgtgtaacgttcgtttactacgtaacttcccgtaacgttccggaaccgtaacgggacctacggacggttacggaaacgtaacgttaaaaccgtacggttacgtcggaccgttccgacccgtactacgttccgttacttccg

SEQ ID NO: 123642 - DNA, 821 bp, Homo sapiens
  misc_feature: GYAE6OF02IL1G1.22.73.G07.1.454.CMB.1.raw
  modified_base (280)..(280): a, c, t, g, unknown or other
  misc_feature (280)..(280): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggacgaccccttgtcccctcaacctgactatttcgtctcgtggaccgactccatcacttagttactacgtggagctcggcctccggcncgtacccccgaggggaacgggtacgttacgggacggttagggtaggttttacggggggttaattaacgtttaccgttaaacgttttaaccgaaccggttagggggtaacgacccgtaaacccgggtaaccttaaacgaacccggtccccccttcccttacgacgttacggaacgttacgaacggttccaaacccttaactttttaccgaacgttaacgtaaccgaaccgttacccgaaaaggtaacccgtaacgttttaccccgtacccgttaacggtaaaaccgtttcggaacgggtttcttacgggtaccggaacccggttgttaccgggaccggtaaacccgtaccgggtcccgtttaacgttactttaccgtaggttcggacggtaacgtttaagttttcgttggtttttacgggacgtttcgggttaccgtccgttcgttttacgacgttaccggtcggggacccgttaacggggtaccctgggtacccgtaccgttccgtaccgttacgaccgtcccttaccgaccgtaacccgg

SEQ ID NO: 123643 - DNA, 638 bp, Homo sapiens
  misc_feature: GYAE6OF02HHBIN.22.73.G07.1.454.CMB.1.raw
  modified_base (198)..(198): a, c, t, g, unknown or other
  misc_feature (198)..(198): n is a, c, g, or t
  modified_base (632)..(632): a, c, t, g, unknown or other
  misc_feature (632)..(632): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtcctccgagggggaanacgccaccctctcctgccagggccagtcagagtgttagcaacaacttagtctggtaccagcagagtacctggccaggctccccgaggcctcctcacttctagttcggtgtcctttccgtaccgacggggtccacgtcggtacctcccccggactaggggtttccaggttcgacccgtagggttcgggtacgtggggacacggtacgttcaccgttctacccgactactcgacgccgtacgtcctacgcctaaggtcgtagaagttactttgacttactttacttactgtacagactaattactaagtcgtacttcggttactcgtacttcctaccggttaccggaccgaagggaccctacggtacgtacgggtaacgtaacgtttaaaccggaacgttcggtacggtacctacggacctaccgtacttccgttnttaccg

SEQ ID NO: 123644 - DNA, 669 bp, Homo sapiens
  misc_feature: GYAE6OF02JNBJQ.22.73.G07.1.454.CMB.1.raw
  modified_base (201)..(201): a, c, t, g, unknown or other
  misc_feature (201)..(201): n is a, c, g, or t
  modified_base (503)..(503): a, c, t, g, unknown or other
  misc_feature (503)..(503): n is a, c, g, or t
  modified_base (596)..(596): a, c, t, g, unknown or other
  misc_feature (596)..(596): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccactggaagaaatagtgatgacgcagtctccagccaccctgtctgtgtcctcggaaggggaaancgcccacactctccgtgcgacggccagtcgagtagttgtcgcacgacgtagtacgtcgcctaggaccagaccaacgtaacccgtggaccgacggtcctacccgcggtccctacctcgtacttctagtcggtacactacgtcgtaacggacgccgtacgttcgtcctaccgacgtcgtagtcgaggtcgacgtagggtcggtacgtcgggactagtacgtcacttccgacaacgtcgtacaacgtccacgtctcgaactcggtacgtattacggttacttgtactttaagtttactcgttacncgttaacgtacttaacttacgtaacgttacgttccgtacccgttaacgttagttaccgggttaccgaaccggtaccgggtaacgttaacgggngttaaaccggagggttaaaccctacggttaaaccgcgggtttcgaaccggtcgtaccgtaacgtaccggttcg

SEQ ID NO: 123645 - DNA, 840 bp, Homo sapiens
  misc_feature: GYAE6OF02HSMTH.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgctattgtctctggcgacctccatcactacgttactactggagctggctccggcacgtcccccgaggggaacggacgtgggacggtcggagtttggggtaattaacgtcttaagtttaaccgaacggttggggaacgtaccgaaccgtaaccgtaaccaaccggtaccccctccctacgaactcggtaacgttccgggaacgtacctaaccctaagtttaccactaacgtaaccgtaacgttccgaaaaagaacccgttacgtttccgtacccctaggtaaaaccgtcggtaacggttacgtacggtacgacccgtaccgttacgggacccggtaaccggtaacccgggtacccgttacgttaaacgtttaccggtacggttacggaaccgggtaacgtttacgtttttacggtttaccgggtttttttagggtagggttttaccgggtttaaccggtcccgggtttaacgttttaccgggtaaccgtttaaccgggtaccggggggtaaccccgttaaccgggggttaaccccgttgggttaaccccggttaaccccggttccctttacccggtaccgttaacccgggtaacccctttaccccggaaaacccggtaaacccccgggg

SEQ ID NO: 123646 - DNA, 772 bp, Homo sapiens
  misc_feature: GYAE6OF02JO6MT.22.73.G07.1.454.CMB.1.raw
  modified_base (198)..(198): a, c, t, g, unknown or other
  misc_feature (198)..(198): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagataccactggagaaatagtgatgacgcagtctaccagccaccctgctgtgtctccgaggggaaancgccaccactcctccgtgcgacggtccacgtcgagtagtgttagacgacgcagtacttacggcctaggtaaccagaccaacggaaaccgtccgggaccaggcctacccgacggtcctaccccgtctaactccgtagtcgggtcgtacctactaccggtaccggacggggacccttacgttaccggtaaccgtacccgtacgtccgggttaacgttaccgaaggtttcgggaccgttaggggtcggttaccggacggggtaaccctaaggttaccgtttaaccgactttcccgtaacctaccgtaacgtactaccggtaccgacgtacccgtacgtccgtacggtacgtaacggttacgttacgtttacgttacgtttaacggtttacttacgttacgtaccgtaacgttactaaccgtttaacgtttaacttaaccggttccgtaacccgtttaccggtaacggtttaccggttacgaacccgggtagggtaaccgtacggtaacggtacggtaacgtaaccgtaacgtaaacgtccggtacggtaccggtaccgtacgtacccgaccgttacg

SEQ ID NO: 123647 - DNA, 849 bp, Homo sapiens
  misc_feature: GYAE6OF02FSTA0.22.73.G07.1.454.CMB.1.raw
  modified_base (197)..(197): a, c, t, g, unknown or other
  misc_feature (197)..(197): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcacgggccagtcagagtgttagcaactacttagtctacggtaccagccaaggacgacctggaccgtacggccctaccccgagggtcccttaccctacgtacgttactacggtttcgggtcgtacccttttaccgaaccgggtacgggtacccgtaacgtttccgggttaaacccttccccccgggaaccgttaacggggttttcccaacgggttccggtacccggtaaggggttccgggggttcggtttacggggaaccgtaagggttacgttttccaaccgtttcccgtaacccgtacccgtaactcccggaacggtcccgaacggttccccgtaggtaaccgtaaccggggttaccgttaacggtttaacgtttttccggaaacttttaaccgtttttaacgtttacggttacgttaccggttaaactaacggttaaactttaaacgttaacgttacggtttaacgtttcgggttaccgttaccgttaaaccttcccgttaacccgggtttccgaaacccggtaaagggtaacctaccggtacgttacgggtaaacgttaaacctttaaacgggaccgttagggtaacggccgttacggtacccaaccgttagttccgttacgttccgttaaccg

SEQ ID NO: 123648 - DNA, 869 bp, Homo sapiens
  misc_feature: GYAE6OF02JJRJR.22.73.G07.1.454.CMB.1.raw
tcagacatacgcgtcacgaccggtgctcgatttagctctacgctcagggggaggaacgtgctcagttaggacccagacggaaccatcggaagcccctagcgtcagcttcgtcttcctcctgcctactcgtggcctcccgagataccactggagaaactgtgactgacgcagtctccagccacctgtctgtcgtctccgaggggaaacacgccaccctcgtcctggccaagggcctaggttcagtagtcgtagcaaacgtacttagctggtaccagcgagagacctggccaggtcctcccgaggtcctccgtacacttccgtagtcggtacgtccttaccgtaaccgacggggtcccctaagttccgggttaaccttcccccggacgttaacggggttttacccaaaggttccggggtacccgttaagggggttaccgggggttaccttaccgggggggtaaacctaacgggttaaaccggttttcctaaccgtttacccgtaccgaaacccgtaacggttccggaaaggtccccgtaacgggtccccgtagggtaccgttaacgggttaccgtaagggtaaaccgggtttagtttttacccggaaccttttaacgtttttaacgttacccgtttacgttaaccggaacgttaccttaaaagtttaaacttaaacggtttccgggttaaccgtttttcgggtttaaccgttaccgggttaacttacccgttaaccggtttaccgggaaccgtaaacggggtacctacgggtaaccgtacgggttaaacggttaaacgttaaaccgggtaacgttcgggttacggtaccgttacggtaccctaaccgttaacgttccgttacggttacccg

SEQ ID NO: 123649 - DNA, 749 bp, Homo sapiens
  misc_feature: GYAE6OF02ISW33.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactgggtagaacgtccttcggacgaccccgttggtcccctcacctgctattgtcctcgtggcacctccatcactagttacctacgtggagcgtcggccgtcccggcaacggtcccccgaggggtaacgggacgtagggacggtaggtaggtttacgggggttatacgttcttaacgttaaccgacggttgggacgtaccgaacccggtacttaaccgaccgtcccccctacccgtctacgtgtacgtaccgtacgtacctacctactttccaacgtaacgtaccaccgtaccgaaaccgtaaccgtactttacccgtaccctaaggaaccgtagtacggtcttacggtacgccggtaaccgtcgaccgggacgccggtacccgttacttaacttccggtgcggtaccgtagtttacgttttcgttcgttttcgggagtttcgggttacccggtcgttacggtttaccgtacgttacgggttccggggaccgttaaccggggtaacccggttcggtaccccgtacgtttccgtaccttaccgacggtaccccttacccgacggtaaccccggg

SEQ ID NO: 123650 - DNA, 609 bp, Homo sapiens
  misc_feature: GYAE6OF02F71GR.22.73.G07.1.454.CMB.1.raw
  modified_base (401)..(401): a, c, t, g, unknown or other
  misc_feature (401)..(401): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggacgaccctgtccctcacctgccattcgtctctggcgactccatcactagttactactggagctggctccggcacgtccccgaggggaacggactggagtggagttgggtatatctattacacgttgggagcaccgactacgcgcccctcctacatgacgtcacgtccactactttcactagacaccgtaccaacgaaccagtttccncctacgaactgtacggtctgtcgtacgcgtgccggacgcgtccgtactatacgtgtgacgtagttagtttgttacgtttttggtacgttcggttaccggtccgttcggtttcgtaccgttcgtacggggtaccgtaaccgggtaccctcggtccgtaccgtttccgtacccgttaccgaccgtcccgtacccgtaacccgaacccggg

SEQ ID NO: 123651 - DNA, 800 bp, Homo sapiens
  misc_feature: GYAE6OF02GFU4Q.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtagaagccttcggagaccctgtcccatcctacctgactattcgtctcgtacggccgtactccatactaacttacgttactacgtggacgtcgtggccgtccgacgtaccccggtacccggaaggggaacggtacgtaggaggttacggtaggtttagggttaactaacgttccttaaacgtttaccgacgggttacgggaacgaccgtaaacccgtacgtacccgtacccgtacccccttccctagtaaccgtgtaacgggtcgtaaccgtaccctaaactttacctttacaaccgtacgtaacccgtaaccgttaaccaaaccgtaccgttaccgtttacccctacccggttaaagaaacccgttgggttaacggttccgtacggtaccgacccgtggtacggaccggtacccggtaccggtcccgttaatttaccgtttacgttcgaacggacgttacgtttagttttacggtttcgttttaaggggcgttttaccgggtaccgtcccggtttagtttacggaaccgtttcgggaccgggtacccgtaacggggttacccctgttaccccgtacgttccctacccggtacgtaccctacccgtacccgaacccggg

SEQ ID NO: 123652 - DNA, 776 bp, Homo sapiens
  misc_feature: GYAE6OF02JO9E9.22.73.G07.1.454.CMB.1.raw
  modified_base (330)..(330): a, c, t, g, unknown or other
  misc_feature (330)..(330): n is a, c, g, or t
tcagacatacgcgtcacgaccggtgctcgatttagctctacgctcagggggagaactgctcagttaggacccagacggaaccatgggaagccccagcgccagcttctcttcctcctgctacgtctggcctcccagactaccactggaacgaaatgtcgatgacgcagtctccagcccacctgtctgtcgtctccgaaggggaacacgcccacctctccgtagccgacgggacagtacgacgtagtcgttaagcctaacgtaacttggtctacggtaaccagactagacgtactcggaccagcctccgaacggtcctccgtctatcgtagnggtctcttccgacgacggcctacgtcgtcctcccgtacgtcgttaccgagtcgtaccgtcggtcgggttccacggtactaggtacttccacgtactccgaactgtccaacgtccacgtaccgtaggtcctagtacgtaggtaaactttcgtttacgtacctttaacgttactttaccgtacgtcgtaaataccgttaaaacgttagtaaccgttaccggttaacggtttacctttacccggtaacgttaccgtttaaccccggtttaacccgggtacccggggttaaacgtaaaacccgggttacgttaaaaccgggttaccggtaaaaaccgttaacccggaaaaaccggtttaaacggtcccggttccgggttaaaacccgtccggttaaaacccggttcccgtaagggttttacccttaacgggttccccgttttaaaacccg

SEQ ID NO: 123653 - DNA, 619 bp, Homo sapiens
  misc_feature: GYAE6OF02JG09T.22.73.G07.1.454.CMB.1.raw
  modified_base (313)..(313): a, c, t, g, unknown or other
  misc_feature (313)..(313): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcactccatcactagttacactggagctggctccggcagtccccagggaaggctggagtggagttgggatagtctaattacactggganacgaaccgactacacgcccctcctacactgagtcgagtcaccgtatttcaactagacctacgtaccaacgaactacgttcctacctagaaacctgtaacggtctacgtcgaaccgtctcgacggtacacggccgtactacttacgtcgtagacgtagtacttttgtcgttttttacgggagtttgggttaccgtcggtacttttagaccgttacggtacggggtcccgtaacgggtaacccgttggtaccgtacccggttcgttacccgtaccgtaccgacccgttacccgaaccggtaacccggg

SEQ ID NO: 123654 - DNA, 675 bp, Homo sapiens
  misc_feature: GYAE6OF02HOPDQ.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggacgaccctgtccctcacctgctattgtctctggcactccatcatagttactactgagtctggactccggctacggtaccccgaagggaacgggacgtggagttggagttaggggtacttaagttcttaattaccgacgtagggacgtccgaacccgaacttaccaccgtccccctaccgtactacgtaggacgtacgacggttccaacccttaacgtttccaacgtacgaacctacggtaacccaaacgaactacggtttcctacccgtaagaaaccgtggtaacgtctagacgaccgtcgtcggtaccggaccgaccgtccgttactaacgttcgtcgttcgaccgtaagttacgtttgttccggttttagggtagttcgggtaccgacgttcgtttacggtacctggtaccgggaccgtacgggtaaccccgtggtccgacccgttctcccgtcacgtccccgtaccacccggtaacgg

SEQ ID NO: 123655 - DNA, 742 bp, Homo sapiens
  misc_feature: GYAE6OF02F4A0E.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggccaggactggtgagtccgttcggagaccctgtccctcaccgtgcctattcgtcttcgtcggccactccgatcctaacttagttaacctacgtggacgcgtcggccgtccggcacgtccccgaagggacgggtaccgtggaggttggtacgttagggtactattacgtaacttacgacggtacgggacgtaccaaccgtactaaccgaccgtcccccttaccctacgtactacgtacggtaccgtaaccggtcctaaccgttacgtttaccaacgttacgaaccgtaacccggtacaaaaaccgtaaccgtaacgtttccctaacccgttaagtaaaccgttaggtaacggtttaccgtacggttacggtacccgtcgtacggtaccggaacggtacccgtaccttacgttacttacgtaggtcgtaagtacgttatttcggtttacgttttcggtagtttacggtaccgtcggttacgtttcgtacgtaccgggtcgggtaccggtacggtacccgtcggtacccgtaccgttccgtaccgtccgtacccgtaccctaccgacccgtacgg

SEQ ID NO: 123656 - DNA, 779 bp, Homo sapiens
  misc_feature: GYAE6OF02IB6OL.22.73.G07.1.454.CMB.1.raw
  modified_base (145)..(145): a, c, t, g, unknown or other
  misc_feature (145)..(145): n is a, c, g, or t
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (576)..(576): a, c, t, g, unknown or other
  misc_feature (576)..(576): n is a, c, g, or t
  modified_base (589)..(589): a, c, t, g, unknown or other
  misc_feature (589)..(589): n is a, c, g, or t
tcagacatacgcgtcacgaccggtgctcgatttagctctacgctcagggggaggaactgctcagttaggacccagacggaaccatggaagccccagcgcagcttctcttccctcctgctactctggctcccagataccactgganaaatagtgatgacgctagtctccagcccaccctgtcctgtcgtctaccggaaggggaancgcccacctctcctgcgaggtccagtcaggagttgtacgacctaaactactttagtcgtacggaaccngaccgaaggacgaccgtcgggaccacggtcctccccgaaggcccttaccgtactaacttcgttaactgggtcgttcctttaacccgccggtaacgggccttaaccgttcgggtaacccttcccccgacggttaggtttccgaggttccgaccgtaggtttcgggacgttacgggaaactacggtgttaccctaccgttactacccgaaaccttcgtacgacggtaccgtacgttccccgacgggtcctaacgtttacgttacggggttaaatttacggttttaccgtaccgtttaaaccttttntttaaacccggtnttaccgtaaccgtaaactttaacgtaaccgtttaagtaccggttccgtttaacggtttcccttaaacggttaccgtaacccgttccccggtttaacggaaccgttaacggggaacctaccgtacggttaggaaacgttaaaccgttagtaacggtcgtacggtctacgaccctagttcgttcgtattccg

SEQ ID NO: 123657 - DNA, 635 bp, Homo sapiens
  misc_feature: GYAE6OF02JDIUT.22.73.G07.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
  modified_base (434)..(434): a, c, t, g, unknown or other
  misc_feature (434)..(434): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtccgggcccaggactggtgaacgtccttcggacgaccctgtcccctcacctgcattgtctctggcactccatcactattacnctggnctgctccgcncgtcccgagggacggtctggagtgtagttaggtatatctatacngtggngcacgactacncgccctccacatcgagtcgacgtaccactnttacatacgactacccgtacaacgtaacctacgtttccctacccgtaagtaaaccgttcgtacggttcgtcgaccgtaccnccgtcggaccggtaccgaccggtccgtacttacgttacaggttgacgtagttagtttcgttacgtttttcgggacgtttggttacccgtcgttcgttttacgaccgtttacgggtccgggaacccggtacccgggtacccgttcggtacccgtacccggttcccttccgaccgtacgccccttacccggacccgtacccgg

SEQ ID NO: 123658 - DNA, 880 bp, Homo sapiens
  misc_feature: GYAE6OF02F4S70.22.73.G07.1.454.CMB.1.raw
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtcctcagccacctgtctgtcgtcctacgaaggggaancgcccacctcgtccngacncgggcctagtcagaggtgtacgactaaacgaactttcgtcgtacggtaccgagacgaagacgtaccgtggacctacgggcctaccccgaggtcctccccgtacgtacgttcgttagtcggttcgtcctttaccgtaaccggtacgggtaccgtacgtacgggttaccccttacccccgggtccgttaaggggttttaccacggttaccggtacccgtacgggggttcgggggttaccggtaggggggttaaacccgacggttaacgggttccctaaccgggtttaccctaccgaaccctaaacgttaccgacggtaccgtaacggtcccgttacggccgttaggtttcccgaaaggttaacgtttacgtttcgtaaccgttttaaacgtttttaagttaccttagggtaacctaacgttaaaccgttaaagtttaaacgtaactttacgggtaacgttttccgggtttaaaccgttaccggttaacgtttacccgggtttaaacccgtttacccggggaaacgttaaaacgggggttacccaaccggggttacggttaacgggtttaaaccggaaaaccggtttaaaccggtaccggttacgggtaacgtacccggttacctaacccgggttacttaacggtttacccttacccgggtttaac

SEQ ID NO: 123659 - DNA, 652 bp, Homo sapiens
  misc_feature: GYAE6OF02IO1E0.22.73.G07.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgcagtctccagccaccctgtctgtgtctcgaaggggaaancgccaccctntcctgcgagggccagtcagagttattagacaacaacttagccgtagtaccagcagagacctggccaggctccagctccnctatctatgttgcatccagcgacgggccactcggtacccagcctaggtcagtggactaggtcgggtgtagggactaggtacgtctacttctaccgacctactacgacgcgaacgtccgtagccgtattacgtagtaaagttacgtttagtacttaagtttaattacgttagtacacgacttaacgtaattaaacttaacgtacgggtaccttaccggttaactttaacgggttttacggaacccggttaacggggtaacccgtaaggtaccgtagggtaaacgttaacggtaaaccgtaaaacggtaccggttaaggttacggtaccggttaccgaacccgttaacctacgttaccgtttaccgg

SEQ ID NO: 123660 - DNA, 867 bp, Homo sapiens
  misc_feature: GYAE6OF02IF4ZB.22.73.G07.1.454.CMB.1.raw
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
tcagacatacgcgtcacgaccggtgctcgatttagctctacgctcagggggaggaactgctcagttaggacccagacggaaccatggaagccccagcgcagcttctcttcctctgctactcgtggctcccagactaccactgganaaatgngatgacgcacgtctcagtccaccctgtcctgtcgtctaccgaaggggaacncgacctacctctcgtcgccgtaagggccagtcgagtagtgttacgacaaactacttaggtcgtacgtaaccgagtacgacgtaccggaccgttacgggaccgtaaccggtcctacccccggtaaaggtccccgtttacccgtaaccggttaccgtttaccgttaaccggtttccgggggtttaaccgtttaccccgtttaccggttaaccccgggtaccggggttacccccttaaccggggtttacccggttaaccccggtaccccccggttaccggtttaacgggtttaccggtacgggttacccgacccgggtttaagggttccgggggttaccgtaccgggggtactaacgggttaccgttacgtaccgttaccgtaccctaaacgtccgttacgacgttaaccgaccgtcgtaccgtccgttaaggtactaacggtaaacgtttccttacggtaaccctttaacgtttacgttactcggtaacctaacttaacgttaagtaactaacggttaactacggttttcgtaaccgtacgttaaccttcccgtacccggtaaggtaacccggtaagtaccgtacggtaccgttacgaagtttaaaccgtaaccgtaagttcggtaccgtaccgtacgtcccttaagacgtttccgacttttacccg

SEQ ID NO: 123661 - DNA, 741 bp, Homo sapiens
  misc_feature: GYAE6OF02H5CZ2.22.73.G07.1.454.CMB.1.raw
  modified_base (150)..(150): a, c, t, g, unknown or other
  misc_feature (150)..(150): n is a, c, g, or t
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (382)..(382): a, c, t, g, unknown or other
  misc_feature (382)..(382): n is a, c, g, or t
tcagacatacgcgtcacgaccggtgctcgatttagctctacgctcagggtcggaggaactgctcagttaggacccagacggaaccatggaagccccagcgcagcttctcttcctcctgctactctgctccagataccatggagaaatgtnatgacgcagtctcagccgacctgtctgtctcncgagggaancgccacctnccngcaggccagtcagtcgtntaacgctaaactattgtctacggaccagtcgaagacgccgtagaccgtacggtccgacccgagtcctccctanacgtactaggttcggtnacctttcgacgacggcctacgtcggaacctcccggataggttccaggttccggaccgtaggggtttccggngtaacggggtactaacgggtactttcccgaaacttcggtaacccaacggttactaaacggtccgaacgtaccgtacgtcgaaccgtacggttaacgttaaggtaaactttacgtttaccggtaacgttttaacccttttagttaaacggttcggtaaccgttaaagtaacctttaaattaaccgttaaagttacgggtttacgtttaccgggttaccttaaccgggttaccttttaaccggaaacccgggtttaaccggaaccggttaacggtacgtaacggtaacggttaacggaaacggtttaaacctaaaggttcgtacggtacgtaaccgactacccgtaagttcgttccttaac

SEQ ID NO: 123662 - DNA, 827 bp, Homo sapiens
  misc_feature: GYAE6OF02G9HHY.22.73.G07.1.454.CMB.1.raw
  modified_base (200)..(200): a, c, t, g, unknown or other
  misc_feature (200)..(200): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagcccaccctgtctgtcgtctccgaaggggaaanacgcccaccctctcctggcacgggccagtcagtagtgttagacaactaacttagtctcggtaccaggccagacgaccgtggccacggcctcccgaggccttcctcattccgtagtcggtcgtacctttccgaaccgacgggaccctacggttacgggtaaccctcccccggaccgtaacgggttccacgggttcgacccgtaggggtcggggttacgtacgggggtaactacgggtaacgtttccgtaaccgttccgtaccaacccgtaagttaccacgggtacctaccggttcccgtaggacccgttaacgggtttacgttacggtaaacggtttacgttttacgaaccgttaaccgtttttaacgtttaaccgtttacggttaccgtaacggtaaccttaaagtttaacgttaaacgttacggttaaccggttttgggtttaccctaccgggtttaaaccgttccccgtaacccgggttttacccgggaaacccgtaaacgggggtaaccccgtacgggtaaccggttaacgggtaaaccgttaaaccgtttaaaccgggtaacgttacgggttaggtaacccgttcggtaaccctaaccgtacgtttccgttaccggttacccg

SEQ ID NO: 123663 - DNA, 735 bp, Homo sapiens
  misc_feature: GYAE6OF02GM4WJ.22.73.G07.1.454.CMB.1.raw
  modified_base (514)..(514): a, c, t, g, unknown or other
  misc_feature (514)..(514): n is a, c, g, or t
tcagacatacgcgtcacgaccggtgctcgatttagctctacgctcagggtctccgaaggcttcaccagtcctggacctcctgtgcaagaacatgaaacatcgtagtggttcttcctttctcctggtggcagctcccagatgggtctgtcccagctgcagctgaccagggacgtcgggccccaagggactcgggtcgaaacgtccgtttccgggaagtacccctggtcccctcaaccgttgacctatttcggtcctcgtggaccgaccttccgaatccaacgttattaacgtacttggagcgtggccgtaccggaccacggtcccccgaaggggaacggggtacctgggtaacggtgggtaagttcggggtaattacgtactaatttacgacgtagggactacgacccgtaagttaccagtacccctccgtcaagtcgaacgtccagtaccaccgtatttacatacgacgacgtaccaagtacccgagtttacgcctagaaacgttgaacggttntgtacgaccgcgtcggaaccggtacgaccggttccgttactaactttacgtaccgtaggaccgttaagtacgtttttacggtaccgttttttgggaaacgttcggttaaccggtccgttaccggtttggaacttcggtacgggggaccctaaccgggggtaacctcgggttccgaacccgttcgtaccctcgtacccggacttccccgaacggaacccggg

SEQ ID NO: 123664 - DNA, 942 bp, Homo sapiens
  misc_feature: GYAE6OF02IMERZ.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtgcagctcccagatgggtcctgtcccagctgcagctgcagggacgtcgggcccaggactgggtgaacgccgttcggacgacccttgtcccgtcacctgctatttgtcctcgtcggacgaccttccatcctaacttaacgttaccgtacttgggaacgtcgttgggcctcccggggactaccgggtacccccgaggggggaacgggtacgtaggggacggttagggtacggttttagggggttaactttaacgttaccgttaacgttttaaccggaaccggtttggggaacggtacccgaaacccgggtaaccttaaccggacccgttccccccgttacccgtacgtacgttacggacggtttacggaacggttaccctaaccgttacttttaaccgaccgttaaacgacccgtaaccgtaaccctaaaacgggtaaccccttacgtttacccttaccccggttaaaccgtaaaccggtacggttacgggttaccgttacggttaccggacccggttaccgtcgggaacccggtaacggtaccccgggttacccgtttaccgttacgtttaaccggtacgggtacggttaccggtaaggtttacgttttttacggttccggttttttaacgggtcggttttaacgggtttaacccgggttccggtttaccggttttacggtacccggtttaacgggtaccggggggtaacccggttaacccggggttaacccggtttaccgggtccccgttaacccggttcccgtttaccccggtaccggtaccccggtaccccgtacccggaaacccccggtaccccggg

SEQ ID NO: 123665 - DNA, 684 bp, Homo sapiens
  misc_feature: GYAE6OF02GM8KY.22.73.G07.1.454.CMB.1.raw
  modified_base (650)..(650): a, c, t, g, unknown or other
  misc_feature (650)..(650): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtcctccagccaccctgtctgtgtctccgaaggggaagacgccaccctctcctgcgacgggccagtaccaggtagtgttacgacaaactaacgtttagtcttacggtaccagccgaagacgacccgtggacccgacggcctccccgaggtccctcccgtaccacttcgtacgtgggtctccttaccgtaccggacgggtaccctacggttacggtacccttcccccgggaccgttacggtttacgacgtcggaccggtaggggttcgggtacgttcggggactacgggtacgttcaccttccgtaccaccgtatccgaagtccgacggccgtagacgttacgtcgtaagttaagtttactttcgacctttaattttacgtttaaccgtgtacctaagtactaaagtacttaaagcgttacgttgtcctacgtactaccgtccggtaacgaccggtaagaccctagacgtaaggtaacgtaattaaccggntcggtagtcacgaccctataccgttgtaccttcg

SEQ ID NO: 123666 - DNA, 690 bp, Homo sapiens
  misc_feature: GYAE6OF02J2QAH.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggttcttccttctcctggtggacagctcccagatggtcctgtccagctgcagctgcaggtagtcgggccaggactggtagaacgtccctttagggacacccgttgtccctacacctgcttaattcgtctcgtaggcctacctcctaatcgtacttaagttaccgtacgttggcgtcgttcgccgttaccggactaccggtcccggaaggggagtccgttggaagtcggttagttggtatactacgtaacgttaacgcgtacgggacctaacgaccgtacgaccgtaccgccctcctaggaagttcgaacgttccgaacgtacctacctacttacgagtacgtacccgaacgtaccaacgtacttacgtcctaccgtagaacgttcggtacgtagttccggaacgtcgtcgccgtaaccgaaccggtcgtacttagttaactcggtacttcgaacgtttcacgtttttcgtaacggtttcgtagggttccgtaccgtcgtttaacgttcacgtttacggcgggtaaccgtacggtcgttaccgtacgtcccgtcgttacgcgtaccccgtcgtaccgaccgtaccgg

SEQ ID NO: 123667 - DNA, 626 bp, Homo sapiens
  misc_feature: GYAE6OF02GTBC4.22.73.G07.1.454.CMB.1.raw
  modified_base (151)..(151): a, c, t, g, unknown or other
  misc_feature (151)..(151): n is a, c, g, or t
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagacatacgcgtcacgaccggtgctcgatttagctctacgctcagggggagaactgctcagttaggacccaggacggaaccatggaagccccagcgcagcttctcttcctctgctactctggctcccagataccactggagaaatagtnatgacgcagtctcagccacctgtctgtntctcgaagggaancgcctacctctccagcgagggccagtcagagttcgtaagcaaactatttacgtactaggtaccaggacagacgacgtcggaccaggccctccgacggccttaccgtcatactagtggtgtccttactaccggaggcctacgtcgtacctcccgcgtacggttcacggttcgaccgtagggttcgggtcgttacggaacgtagtacggtccaccgttntacccaccgtacncgtaacgcctacggtcctacgcgtaacgtcgtagtaagttcttacgtcttagtttattcgtagtaccagtactaattacgtaagtagttcgttcgttacctacgtacctcggtaccgttcggaaccgagtaccgtacggtaatacggtaagtaaccgttaacgtacgtacggtagcgttacgccgtaatcgttaccgcgttacc

SEQ ID NO: 123668 - DNA, 681 bp, Homo sapiens
  misc_feature: GYAE6OF02GTH8E.22.73.G07.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
  modified_base (417)..(417): a, c, t, g, unknown or other
  misc_feature (417)..(417): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccatggagaaatgtgatgacgcagtctccagcccaccctgtctgtcgtcctccgaggggaaancgcccacccgtctcctggcagggccagtcagagttgtagcaacctaattacgctaggaccagcagacgacctggccaggcctacccaggcctcctcatctagtggtcnccttactaccgaggccacgttcggtaacctcccccgacgtaggttccaggtccgaccgtaggttcgggtctggactagtcgtacacgtcctacaccatcagcacgtcccgngcgtacgtcgtagtaacgttagtttcgaacgtttacgtttaacttacgtttcgtacgtaacgtacgtaacgtttagtttaaacgtttccgtacgggttcccgttaacgggttaccgtttccgggaaacccgtaaacggggtacccgtaaaggggttaccggtaaagtacccggaaacggttaaccggtgggtacgtaccgtagacccgttaacgtacgttttaccgtaacggtttcctacgttacccgttaccgtttacccccg

SEQ ID NO: 123669 - DNA, 911 bp, Homo sapiens
  misc_feature: GYAE6OF02GH00K.22.73.G07.1.454.CMB.1.raw
  modified_base (305)..(305): a, c, t, g, unknown or other
  misc_feature (305)..(305): n is a, c, g, or t
tcagacatacgcgtcacgaccggtgctcgatttagctctacgctcagggtctccgaaggcttcaccagtcctggacctcctgtgcaagaacatgaaacatctgtgttctccttctcctggtgcagctcccagatgggtcctgtcccagctgcagctgcaggagtccggccaggactggtgaacgtcccgttcggacgtacccctcgtcccctccaccgtagcctaagttcgtccgtactgggcctaccttccatcctaacgttaacgttaccgtacgtggtaacgccgtacggtccgtacccggngaaccggttacccccgaaagggggtaaacgggaccggtagggtaacggtacgggtaagtttcggggtaacttaacgttacgtaacgtttaaccgaaccggttaggggaaacctccgtaaaccccgaaccgttaaaccgacccgtacccccccgttacctaccctaagttaccgggtaacggttcccgtaacggttacccgtaaacccttaattttaccaaaccgttaaaaccggtaacctaaaccccgggtttaaaccaaaaccgtaaacccgttaccggtttaaccccttaccccggtaacggtaaaaccgtccggttaacgggttacccgttaacggtaccgtaccccggtacgttaccggacgttaaaccggtacccgacccgggtccttaaccgttaacgtttaaccgttggtaccggtacggttacgttacgttttacggtttccgtttttaacgggacggtttacggttacggtccgggtttacgtttacggttacgttaccggggtccggggtaacccgtaaccggggttaccccgtaggttacccgttaccgttacccggttcccgtaccgtcccgtacccgtaacccgtaacccggg

SEQ ID NO: 123670 - DNA, 860 bp, Homo sapiens
  misc_feature: GYAE6OF02GIQKO.22.73.G07.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagacaacacttagtctggtaccagcagagacctggccaggcctacccgaggcctcctcacttctagtggtctccttccgtaaccggngggtccctacgttcgggtacctcccccggcgtaggttcaggtccgccgagggttcggggtcgtaggggaactaggtacggtttccaccgttcctaccaacccgtagtcccaaggtacccgtaccggtcccgttacggtacccgtaacggttaccgtaaggtaaacggtttacgttttaccgggtaacccttttaaccgtttttaacgtttaccgttacgggttaaccctaacgggttaaccttaaacgtttaaacgttaaaacgggttccggttaaacccggtttttccggggttttaacccgtttaacccgggttaaacccgtttaccccgttttaaacccccgggttttacccggggaaacccccggttaaaacgggggggtaccccttaaccggggggtttaaccccgttaaggggggtaaaacggtttaaaacccgggttttaaaacccgggaacccggtttttaggggttaccgggtaccctttaaccgggaaccccttaacccggtttacgtttaccggtttaccgtttaaccccg

SEQ ID NO: 123671 - DNA, 691 bp, Homo sapiens
  misc_feature: GYAE6OF02GKRUO.22.73.G07.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggagaaatagtgatgacgcagtcctcagccaccctgtctgtntctccgagggaacncgccaccctctcctgcacgggccaggtcaggagtgttacgacaactaacttagtcgtacggaccagcagacggacctggccaggcctcccgaggctccctnactctagtggtcnccttcaccggacggcctacgtcggtacctccccgcgtaggtcaggtccgctagggtcgggtctacggggactacgtacgttcaccgttcctaacgaacccgtacttaccgacggtaccgacgtaccgtacgtccgtaacgtacgttaacggtaaagtttcgtttacggtaaccttacgttttaacgttaccgttacgtacgtaaggtaacctaaattaacgttaacgtacgttacgggttacgtttacccgtagtaccttacccgttaccggttaccggaacggtaacccggtactacggtacgtacggtaacggttaaacgttaacgtacgttcggtaccggtacctcggaacccttacgtaccttcgttacgttaccg

SEQ ID NO: 123672 - DNA, 708 bp, Homo sapiens
  misc_feature: GYAE6OF02FYIVF.22.73.G07.1.454.CMB.1.raw
  modified_base (212)..(212): a, c, t, g, unknown or other
  misc_feature (212)..(212): n is a, c, g, or t
tcagacatacgcgtcacgaccggtgctcgatttagctctacgctcagggggaggaactgctcagttaggacccagacggaaccatggaagccccagcgcagcttctcttcctcctgctactctggcctcccagactaccactggagaaatgtgatgacgcagtcctccgagcccacccgtgttccgtgtgtcctaccggaagggggaaaacncgccctaccctcctcctgcgacgggccagtcagtagtgtagacaactacttcgtctacggaaccagcaaggacgaccgtggacccagggccctcccggacggtcctcctactacgttccttaggtcggtctccttaccgtaccggacgggtcctacgtcggtaccctccccgcgtacggttcaggtcgaccgtagggtcggtcgtacgggactacggtcgttaccacgtcctaccacctctaccgagaccgtacgtcgtacgcgtacggtactaggtaactttcgtttaccgtacctttaacgtttttacttaccgttgttacgtaacgtaaccttaaacgttattaaacgtcgttacgttcgtttacctacgtacttcccgtaacgttcccggaaccgtaacggtactaaccggtaggtaacggtaacgttaaacgttaaaccgtacgtacggttacgtaccgtacgtaaccgtaccgtcttcgttaccgttacc

SEQ ID NO: 123673 - DNA, 952 bp, Homo sapiens
  misc_feature: GYAE6OF02J0ZJY.22.73.G07.1.454.CMB.1.raw
  modified_base (140)..(140): a, c, t, g, unknown or other
  misc_feature (140)..(140): n is a, c, g, or t
tcagacatacgcgtcacgaccggtgctcgatttagctctacgctcagggggaggaactgctcagttaggacccagacggaaccatgggaagccccagcgcagcttctcttcctcctgctacctgtcgcctccagacaccngtaggaaataatgtagtactacggaccgacgtacgtcctaccgaccgccctaccgttgtcgtcgtcgtccacgggaagggaatccacccgtacctcctcggtacgcggacggtactagacgtagttagtacgtacacctaaacgtacttacgtcgtaacggtaccgagacgacgaccgtccggtacgacggtaccgcccgtaaccggtcgtcctacgttactacttacgtacggttcggtactaccgtaccgtaccggtccgaccgttaacgttccggtaccccgttcccggtacgttacggtaccgtacggtccggtaaccgttcggggtacgggttccgggtaaccggtacggttaacgggttaccttacggtaccccgttacctaacccgttaaccgttacgtaccggtaccgaccggtacccgttacggtaccgttacggttaacgggttaccgtaaacgggtttacgttttaacgtttaccgtttaacgtttttaaccgttttaactttaccggtttaacgttaacccggtaacttaaaaccgtttaaagtttaaacgtttaccgggttaacggttttaccgttaccgggtttaaacccgttacggttaccctttaaaccccggggttaccccgggtaaccggttaaaccggggaacccgtttacccgggttaaacgggacggtttttaaacccgggaaaagggtttaaacccggttaaaccgggttaccgggttaacggtcccggttaacctacccgggtaaacccgttaacccggttacgtttaccgtttacccccggtttaacg

SEQ ID NO: 123674 - DNA, 804 bp, Homo sapiens
  misc_feature: GYAE6OF02HO9KV.22.73.G07.1.454.CMB.1.raw
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
  modified_base (511)..(511): a, c, t, g, unknown or other
  misc_feature (511)..(511): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctccagatgggtcctgtcccagctgcagctgcagggacgtccgggacccaggacgtggtacgaacgtccgttacggaacgtccccttcgtccccgtaccaccgtgctattggtcctacgtggccgtaacctccaactctaacgttagtaacctaagtcggagtcgtggcctccggacgacggtacccgaggggtaacggacgtcggaggtggtacgttaggtactactactacttacgacgtcgggtaacnctaaccggactacaccgcccttccgtangtacgcgtcgacgtccacttagttaccacgttaacgacgtacctacgaaacttacgcttacctaccgtaacgtacgttacggaacgtttccgagtaccgtaccncgtacggccggaaaccggtccgggacctttaccgttaaagttccgtacgttacgggtaccgttaagttttccggttttacggttacgggtttttaccggtacgggttttaacggggttaccccggtaccgggttttaaccggttttacggtaaccccgttacgggggtttacccgggaacccgggggttaaaaccgggtcccgttaaacgggtccccgtaacccgggtttccccgaaccgttccggtaaaccccgggtcccctaacccggggtaacccggttaaacccccggg

SEQ ID NO: 123675 - DNA, 770 bp, Homo sapiens
  misc_feature: GYAE6OF02JME7X.22.73.G07.1.454.CMB.1.raw
  modified_base (201)..(201): a, c, t, g, unknown or other
  misc_feature (201)..(201): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtcctagtgtcctccgagggggaaanacgcccaccctctcctagccacgggtccaggttccaggagttggttacgctaactaacgttagtctggtacccaggcgaagagacctggcccaggtcctccccgaagggtcctaccccgtactattacccttagtgggttacgtccttaccgtaacccgtacggggaccctaacggttcgggtaacccttcccccggacgttagggtttccacggttagccccgtaagggttcggggttactagggggaccgtaagtagttaccctccgtcttaccgacctactaccgacgtaccgacgtcccgtgacgtcgtactagtaacgttattccgtacgtttactttaacgttcgtactacgtactaacgttaatacgtaagttacggttacttacggttaccttacggtacttaccgttacccggttacccggtaaacggtacccggttaaccgtaccgttaacgggtaaccgggttaaacggtaaaccggttttaaaaacccggaccgttaggggttaaccctacggtacccgtaaccgtacccgttacgtttaccgttagtttaccccgg

SEQ ID NO: 123676 - DNA, 733 bp, Homo sapiens
  misc_feature: GYAE6OF02FXRUA.22.73.G07.1.454.CMB.1.raw
  modified_base (200)..(200): a, c, t, g, unknown or other
  misc_feature (200)..(200): n is a, c, g, or t
  modified_base (682)..(682): a, c, t, g, unknown or other
  misc_feature (682)..(682): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagactaccactggagaaatagtgatgacgcagtctccagccacctgtctgttcgtctacggaagggaacncgcctacctctcgtgaccgacggccagtcagtgtgtacgactaactacttacgtctacggacacgacgacgtaccgaccgtcgaccgacgtccctaccggacgtccctaccgtactacgttacgtaggttacggtcttaccttaccggaaccggtacgggtcctaacgggttccggtaaccccgttccccggaacgttacggttaccgtacgggttccgtaccggttagggggttccggtaaccggtacggaaacggttcggttaacttccaccgtacctacgtaacctacgtcgaaccgtccgtaccgtcgtagtaccgtagttacgttaagtaagttttaccgttacgttacctttaaacgttttagttaccgtagtaacgttactaaacgttaattaacgtagttacgttagttttcggacttacggtaccttccggtaaaccgtcgaaccgtaacgggtaccaggtacgaggttaaanaaccgttaacgtcggttagcgactcggaccctaagtcgtaccttacgtccg

SEQ ID NO: 123677 - DNA, 703 bp, Homo sapiens
  misc_feature: GYAE6OF02I8ZOI.22.73.G07.1.454.CMB.1.raw
  modified_base (200)..(200): a, c, t, g, unknown or other
  misc_feature (200)..(200): n is a, c, g, or t
  modified_base (364)..(364): a, c, t, g, unknown or other
  misc_feature (364)..(364): n is a, c, g, or t
tcagacatacgcgtcacgaccggtgctcgatttagctctacgctcaggggggaggaactgctcagttaggacccagacggaaccatggaagccccagcgcagcttctcttcctcctgctactctggctcccagataccactggagaaatagtgatgacgctagtctccagcccaccctgtctgtgtctccgaggggaaanacgcccaccctctcctgcagggccagtcagagtgtagacaactaacttagtctacggtaccagcgagacgacctggccaggcctcccgaggcctcctctactctagtggtcgtccttaccgtaccgacgggccctacgtcggtacctcccccgactacggtacnggtacgcgtagggtcggggtacgttcggggaccaggtacgttacgacctcgtaccacctactccggtagaccgtacgtcccgtacgacgtacgtcgtaacgtaagtttactttacggtccttaacttttacttacgttcgtaaccgtactaacgttaaataacgttaagttaacgtacctttaccgggttattcgtacttcccgttaaccttccgggtaacccgaacggttaccgacggtacgttaacgggtaaacgttaaacgttaaaccgtaaccggtttacgggtacgggtaccttacggtacccgtacgtttaccgttactttaccggttacccg

SEQ ID NO: 123678 - DNA, 790 bp, Homo sapiens
  misc_feature: GYAE6OF02I4M0N.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggtttcttccttctcctggtggcagctccagatgggtcctgtcccagctgcagctgcgaggagtccgggcccaggacttgggtagaacgtccgttacggacgaccccttcgtaccccctcacctgctagtttcgtcctcgtcggaccgtaacctcctaatacctaacgttaacgtttaaccgtacgttagggacgtcgttacgggccgttccggaccgtaacgtaccccggaaggggtaacggtacgtagggtaggttaggtagtttacggggttaattaacgttacgttaattacgacggttaggggactaccgtaaacccggtactaacgacccgtacccccgtctaacacgtacggacgtacgtactaccgaaccttaagttacaaactacgaactaccgtaacaaacgtaaccgtacgttacctaccgtaaacgtaaacgtggtaacggttatacggtacgtaacgtacggtcgaccggtaacgtaccggttccgtactacgttacgtagtcgtaacggtattacgttttacgttcgtttttacgggagttccggttaaccgtccggttagtttaccgtagggttaccgtccgggggtaaccgtaacgggtaacccgttcggttcccgttaaccgtccttacccgtacgtacccgtacccgttacccgaaccggtaacccgg

SEQ ID NO: 123679 - DNA, 673 bp, Homo sapiens
  misc_feature: GYAE6OF02GNDTB.22.73.G07.1.454.CMB.1.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (307)..(307): a, c, t, g, unknown or other
  misc_feature (307)..(307): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccacccgtctccgtgcagggccagtcagagtgttacgcaactacttagtctggtaccagcagganacctggaccaggtcctcccaggtcctcctcacttctagtcggttnccttacgtacccgaggggtccctacgtacggtacctccccggactacggttccaagtcgaccgtaggtcggggtactagggactaggtacgttccacttccgtacacccgtagtccgaagtccaacgtccgtacgacctaggtacctaggtaacttagtttacgacttacgttttattacgttgttacagtactaattaatagtgtaaccttggttacctcgtaacttcccgtaacccgttccgggaaaccgtaacgggtaacctaccggtaacggtacggtaaacgtaaacgtttaaaccggaacgttacgggtacggttaccgttcgaacccgttaccttcggttaccgttcgttttaaccccg

SEQ ID NO: 123680 - DNA, 765 bp, Homo sapiens
  misc_feature: GYAE6OF02F6CDS.22.73.G07.1.454.CMB.1.raw
  modified_base (270)..(270): a, c, t, g, unknown or other
  misc_feature (270)..(270): n is a, c, g, or t
tcagacatacgcgtcacgaccggtgctcgatttagctctacgctcagggtctccgaaggcttcaccagtcctggacctcctgtgcaaagaacatgaaacatctgtggttcttccttctcctggtggcagctcccagatgggtcctgtcccagctgcagctgcaggacgtccgggcccaggactgggtgaagtcccttcggaagtaccctcgtcccctcacctgctattcgtctctggcctactccgatcacttagttacctacgtggacnctcggccgtcccggcgtaccgtaccccggaggggtaaggcgttagggagtggtacgttggtatacttctattaaccgacggttgggaacgtaccgaacccggtattaacccgaccggtcccccttaaccctctacgtacgacggttaccgtcgtacctaccgttacttacaacgtacgacaaccggtacctaaacgaaccttacgtcctaccgtaacgtaaacgtgtacggtcttaggcggaaccgtcgtcggaccggtaaccgacccggttactttccgttaacgttacgtaggttacgacgttagttacggttttcgttttagtttacggggtacgttccgggttacggttcccggtttacgtttccggtaaccgttcggggtacccggggtacccgtaacccggggttaccgttacccggtacccgtttaacccgttccgtttaacccggtccttaaacccggtccccgtacccgaacccgggttaacccgg

SEQ ID NO: 123681 - DNA, 786 bp, Homo sapiens
  misc_feature: GYAE6OF02I28UD.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggctccagataccactggagaaatagtgagtcgacgcagtctccacgccaccctgtctcggtgtactccgaaggggaaacacggacctaacccgtccttccgtaggccgaaacggggtccaacggttaccgagggtacgtttagggttaacaccgaaaacttaaacgttacgtacgttacgtaacccgtagcgaacggtaacaccgttggaccgaacggtccctacccgacggacctttaccactaacttcgttagttggttacttccttacgtaccgacgggtcctacgttaccggtactcccccgtagtcgtttacgacgttcggacgtcggttcgggttacgtcgggggaactacggtacgttaccacgtaacctccgtaaccgttagaccggttacgacggtacgtccgtacgtaccgtacggtacgttacgtaaacgttcgttttaccgtacttttaccgtttaacgttacttagtccgtaagtacgtaataaacgttaagttaacgtacgttaccgttagtaacccgtacgtaaccgttaccgttacggaaccggtaaggtaacccgtacgggtaatacggtaaacgtaaacggttaacgtaacgttacggtccggtaccgttacggaccctaacggtaccttacgtaccttaaccg

SEQ ID NO: 123682 - DNA, 729 bp, Homo sapiens
  misc_feature: GYAE6OF02IA026.22.73.G07.1.454.CMB.1.raw
tcagacatacgcgtcacgaccggtgctcgatttagctctacgctcagggtctccgaaggcttcaccagtcctggacctcctgtgcaagaacatgaaacatctgtggtttcttccttctcctggtggcagctcccagatgggtcctgtcccagctgcagctgcaggagtcgggcccaggactggtgaagccttcggacgaccctgtcccgcaccgtgctattcgtctcgtggccgactccactcactacggttacctacgtcggacgtccgtggtccgtaccggctaccggtaccccggaaggggtaacgggtacgtgggtaggtcggtacgttcggggttaattattaccgttaacgttacgtacggtcgggacgtaccgaccgtaacttacgacccgtccccgtacccgtacagcgtacgtacgtacgtccacttacgtttacgtaacgtacgaccacggttaccaaacgacctacgttaccctacccgttagaaacgttcggaacgttcgtacgtcgaccgtcgtacggccggacaccggttctacttactttacggcgagtacgtagtttacgtttcggttacgttttagggacgtttcgggtacccggttcgttccgggttttacgccgtttacggtcggggttaccgtaacccgggtttaccgtacggttacccgtaccggtttcctcccgcgtacctacccgtacccggtaccggtaacccgg

SEQ ID NO: 123683 - DNA, 779 bp, Homo sapiens
  misc_feature: GYAE6OF02IMAMJ.22.73.G07.1.454.CMB.1.raw
  modified_base (273)..(273): a, c, t, g, unknown or other
  misc_feature (273)..(273): n is a, c, g, or t
tcagacatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcgaggacgtccgggacccaggactgggtagaacgtccgttacggacgtacccgtcgtccctcaccgtgctattcgtcctcgtcggctactccatcctacttacgttactacgnggtagtcgtcgtccgtccggacaccggtaccccggagggaacggacgtgggagtggtagttggtacttacgtactacgttacgcggtggactaccgtaaccgtaacctaccggacccgtcccctacctagtacgtacgtacggttccgacgtacctaaccttactttaccgagtaaccgtaccgtaccgtaaaccgaaacgtaaccttaccgttaccctaaccgtaaacgtaaaccgttggtaccggtttcgtacggtacgtacccgtcggtacggaaccggttaccgtaccggttaccgttacgtttacgttacgtcggtagtaccggttagtttacgttttcgtttacgggtttttaggaccggttttcggttaccggttccgttaaggtttaccggtaccggttaacgggtcccgggaaccggttaaccgggttccgttcgtaccccgttacgttccctccggtaccgtaccccggttacctacccggtaacccggtacccgg

SEQ ID NO: 123684 - DNA, 733 bp, Homo sapiens
  misc_feature: GYAE6OF02F1E6E.22.73.G07.1.454.CMB.1.raw
  modified_base (320)..(320): a, c, t, g, unknown or other
  misc_feature (320)..(320): n is a, c, g, or t
  modified_base (649)..(649): a, c, t, g, unknown or other
  misc_feature (649)..(649): n is a, c, g, or t
  modified_base (702)..(702): a, c, t, g, unknown or other
  misc_feature (702)..(702): n is a, c, g, or t
tcagacatacgcgtcacgaccggtgctcgatttagctctacgctcagggggaggaaactgctcagttaggacccagagggaaccatggaaagccccagctccagcttctcttcctcctgctactctggctcccagagaccaccggagtaagttgtgttgaacacagtttccagccaccctgtcttgtctccaggagaggcggccaccctcgtcctgcgacggaccgaatgaagtagtaacttagacgtactaacgtacgccgtaggtaacctaaaccgaggacggcctggaccaggccttcccgacggtcttccgtaccngttagtagtacggtagtacgtccgttaaaccggaaaaacgggtcccctaacggttcgggaccttaaccggtaccccgtaagtacccgttaggttcctaaacggggtcggtacggtacggggttacggtaccggtaaggggtaacggtaaccggtttaccgtttacctaacccgttacccgtaacgttaacccaacttaacccgaaagaccgtaaccgttacgacggtaacccgtagtacgaaacgttcttacggactttaacggttactcgtaggtactacgacaacggttcacgtacggtcgtacgttccggtacgtttccggaccgnggggtactacggtcgtaaagtgacgatacggacgacggttcgcgacgtcgacnctcgtaactcggtcttacctacgtcctcccg

SEQ ID NO: 123685 - DNA, 687 bp, Homo sapiens
  misc_feature: GYAE6OF02JLT4M.22.73.G07.1.454.CMB.1.raw
  modified_base (131)..(131): a, c, t, g, unknown or other
  misc_feature (131)..(131): n is a, c, g, or t
  modified_base (155)..(155): a, c, t, g, unknown or other
  misc_feature (155)..(155): n is a, c, g, or t
  modified_base (209)..(209): a, c, t, g, unknown or other
  misc_feature (209)..(209): n is a, c, g, or t
tcagacatacgcgtcacgaccggtgctcgatttagctctacgctcagggggagaactgctcagttaggacccagacggaaccatggaagccacagcgcagcttctcttcctcctgctactctggctccagntaccatggagaatagtgatgacgnacgtctccagcccacctgtctgtgtctcgaggggaaagcgcctaccctctccgngcgagggccagtcaggtagtcgttacgaccaactaacgttagtcgttacggtaccgtagacgaaggtacgtaccgtggaccgaggtcccctccgtacggccttcccgtcacttccgttaggttcggtcgttcctactaccggacgggtccctaacggttcggtaccctccccgtacgtacggttcacggtcgacccggtaggtcggtcgtacggacgacggtcgttccagttcctacgacgtactaccgcgtaccgactcccgtgcgtacgtcgtacgtacttagtttacgcgtttacttacgtttcgttcgtacgtaactacgtaagttactaacggtcttacggttccgttacgtacgttacgttcccgtaacgttaccgggacgtaacgggccaacggtcggttaacgggaaactttaacgtaaacggtcgttcgggtacggtacctacgtacccgtaactacgtttacttccgg

SEQ ID NO: 123686 - DNA, 687 bp, Homo sapiens
  misc_feature: GYAE6OF02FLP5U.22.73.G07.1.454.CMB.1.raw
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
tcagacatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtactccgaaggggaagacgccaccctctcctgcagggccagtcagagtgttagcaactacttagccgtcgaccagcagacgcgtcgcgacgcctaccgagtcctccnctatcgtagtcgtcgtcttccgacgcggtcctacgtacgtacccnccccgtacgtagtcgtagtccgacgtaggtcggtcggaggtacgagtacgtcgtactccgtaacgacctgtacgacgaccgtactacgtcgctaacggttactaacggttaacgttttacgtttcctaacgttttaaccgttttaacgttacgttacgtacgtaacgtaacttaaattaacgttaagttaccggttacgtttacgggtttcctacgtacccgttaccgtaacccggttacggaaccgtaacgggtaccgacggtaacggtacgtaaacggttaacgtaaaccggttacgttcggtaacggtaccgtacgaacccttacggtaccgtttccgttactttacccg

SEQ ID NO: 123687 - DNA, 940 bp, Homo sapiens
  misc_feature: GYAE6OF02H318F.22.73.G07.1.454.CMB.1.raw
tcagacatacgcgtcacgaccggtgctcgatttagctctacgctcagggggaggaactgctcagttaggacccagacggaaccatggaacgccccagcgcagcttctcttcctcctgtctactctggctcccagagaccgaccggagaagttgtagttgacacgagtttccagcctaccctgtctttagtctccaggagacggccggccaccctctccgtgaccgtacggcaatggaagagttagttagcgtaacttactacgtccgtacggtaacccaacgacggtacggaccgttacggacccaacgggtcccttccccggaacgggtacccttaccccgttaccgtaaggtttacggttaacgttacggttaacggttacccgggttaacccttttaaacccggggaaaaaaccggggtacccgttaaacccggttacgggtaaacccgtaacccggttaccccggtaaaccggttaccccggttaaacgggtttacccggtaaaggtttccggggaacgttaacggggtttccgggttacggttaaacggggaaacggttaccggttaaccgtttacccgaacctttcccgtaaccgttaaaccctaaacgttaccccgaaaacgtaccgttaacccgtaacggtaaccggtacccgtaaggtaaccggtacttttaccgtagaacgtttacgttaattaccgtgtaactacgtacgtacgtaccgttaaccgaacgtccgtacgttaccggtaccggtttacggaccggggtaaccgggtaacctacgggtaaccgtagggtaaccgtacgttaacgggtaacgtaccggtaacggtttcgggttaccggtaacgtaccgtaacgtaacccgttaccggttaaccgtttccgtttaaaccgttacccggttaactttacccccgggttaaccccg

SEQ ID NO: 123688 - DNA, 864 bp, Homo sapiens
  misc_feature: GYAE6OF02JMJ17.22.73.G07.1.454.CMB.1.raw
tcagacatacgcgtcacgaccggtgctcgatttagctctacgctcagggggaggaactgctcagttaggacccagacggaaccatggaagccccagcgcagcttctcttcctcctgctactctggcctcccagactaccactggagaatgtgaatgaccgcagtcctccgacgtcccacccgttgtcgttaggtcgtcctaccggaaagggggaaaacaccggtcccctaaccccttccgttaccgtcggcgacgggccctaggttaccgagtaggttacgttaacggaccaaaccgttaacgttacggtaccgttacggtaccacgtactaacggaacgtcccgtacgggacctaacgggccctacccggacggtacccgtcctacccgttatacgtacggttggtacccggttccttaaccggacccggacggtccttacgtaccgtaccccgccccggtacgttcggtacgacgtccggaccgtggggttacggtaccggtcgggactttacggtcgttccgttacctaccctaccaccggttacaaccgtcgaccgaccgtccgtaccgaccgttagtaaccggttaacggtaagttacgtttaccgttaccttacgtttaaccgttcgttacgtacgtaccgttaaagtaactaacggttaactcgggttaaccgttccggtttacgtaccggttaaccgttacccgtttacccggttaccggtaacccggtaacgggttaaccggaccgttaacgggttaacggtaaaccggttaaacgtttaaaccgtaacgggttaccttaccgggtactttaccggaccgttaaacccggtcgtttaccgttaccgtttaacccg

SEQ ID NO: 123689 - DNA, 860 bp, Homo sapiens
  misc_feature: GYAE6OF02IQ03L.22.73.G07.1.454.CMB.1.raw
  modified_base (116)..(116): a, c, t, g, unknown or other
  misc_feature (116)..(116): n is a, c, g, or t
  modified_base (426)..(426): a, c, t, g, unknown or other
  misc_feature (426)..(426): n is a, c, g, or t
  modified_base (626)..(626): a, c, t, g, unknown or other
  misc_feature (626)..(626): n is a, c, g, or t
tcagacatacgcgtcacgaccggtgctcgatttagctctacgctcagggtctcgaaggcttcaccagtcctggacctcctgtgcaagaactatgaaacatctgtggttcttccttntccgtggtcgctagccttcccaaaggattcggggtccctacgtaccccgagccgttcgaccgtaggtccttggaccgaaaggggtacgggttcccgggggaacccccaggggtaaaccgttgggtaccgaaaccggttcccgttacgggaaccggtccctctacccccgttaccacgttcgtactgtttcgtaacctcggtcggtaacctcctacgattaccgaactttaggttaacctcggtaggacgtcgtgacgtccgacgtccggacccgtagggacgacgtggagtcggtagttggtacttagtnttaacgtacgtacggtgaccaggaccgtacaccgtcctaccctctacgacgttggacctcgtaccgtatacccgttattacccagttacaccgttaccgaacctaacgacctttcccgtactaaccgagtaaccgcgttacggttaccgtacgtaccgtcggtacgtccggaacccggaacgtaccgtttaaccccgttntttaaacggttaacccgggtgtttaaccgggtaacgttacggttttaacgggtttcctttacggggttttcgttaaaagggtccccggtttaaacggtccgggtttccgttaacgttaccgggggtacggtcccgggtaacccggtaccggttaacccgtccgttaccccggttaaccttcccggttccggtaacccggtccttacccccggtaaccggtacccggtaacccgg

SEQ ID NO: 123690 - DNA, 373 bp, Homo sapiens
  misc_feature: GYAE6OF01D89NE.51.77.G11.1.454.CMB.1.raw
  modified_base (369)..(373): a, c, t, g, unknown or other
  misc_feature (369)..(373): n is a, c, g, or t
tcagcgatcgtatacacgaccggtgctcgatttagctagtcactcaagggaaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtctccccctggcaccctcctccaagagcacctctgggggcacagcggccctgggctgcctggtcaaggactacttcctcgtagcactctgagcgggctggcaaggcgcatagnnnnn

SEQ ID NO: 123691 - DNA, 374 bp, Homo sapiens
  misc_feature: GYAE6OF01BZ41L.51.77.G11.1.454.CMB.1.raw
  modified_base (370)..(374): a, c, t, g, unknown or other
  misc_feature (370)..(374): n is a, c, g, or t
tcagcgatcgtatacacgaccggtgctcgatttagctagtcactcaagggaaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnn

SEQ ID NO: 123692 - DNA, 373 bp, Homo sapiens
  misc_feature: GYAE6OF02HP6NJ.51.77.G11.1.454.CMB.1.raw
  modified_base (369)..(373): a, c, t, g, unknown or other
  misc_feature (369)..(373): n is a, c, g, or t
tcagcgatcgtatacacgaccggtgctcgatttagctagtcactcaagggaaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctgggggcacagcggccctgggctgcctggtcaaggactacttcctcgtagcactctgagcgggctggcaaggcgcatagnnnnn

SEQ ID NO: 123693 - DNA, 516 bp, Homo sapiens
  misc_feature: GYAE6OF02JMJBM.51.77.G11.1.454.CMB.1.raw
  modified_base (472)..(472): a, c, t, g, unknown or other
  misc_feature (472)..(472): n is a, c, g, or t
  modified_base (474)..(516): a, c, t, g, unknown or other
  misc_feature (474)..(516): n is a, c, g, or t
tcagcgatcgtatacacgaccggtgctcgatttagctagtcactcaagggaaagggccgcttcatcatctccagagacaattcccagaacaccctgtttctgcaaatgcacagcctgagacctgaggacacggctgtgtattactgtgcgaacttaatcgacggaggacaacggtcgacccccgtcgcgtcggtgcggaggtcgtcggggaccgaaggggacccacggtcagtccgtcctcctcacgccctaccgaaccgaacggggcccctaagtcccggttcccttccccccgtggcccctaccccgtccctaccaaaggccgccacccgttcggcgggggccaacgcggtcccgggcccttcggggcctcggcccgtcggtaccgaacgggtaccttaccgttccctacggtaacgccaccgttcgaggcggccggggtctacgggccgaaagggccgtacaagtacgngnnnnnnnnnnnnnnnnnnnnnnnnnnnnnnnnnnnnnnnnnnn

SEQ ID NO: 123694 - DNA, 121 bp, Homo sapiens
  misc_feature: GYAE6OF02HSAW1.51.77.G11.1.454.CMB.1.raw
  modified_base (119)..(121): a, c, t, g, unknown or other
  misc_feature (119)..(121): n is a, c, g, or t
tcagcgatcgtatacacgaccggtgctcgatttagctagtcactcaagggaaagggcagcgtcactctgttcccgccctcctctcgtagcactctgagcgggctggcaaggcgcatagnnn

SEQ ID NO: 123695 - DNA, 507 bp, Homo sapiens
  misc_feature: GYAE6OF01BKDTY.48.67.G01.1.454.CMB.1.raw
  modified_base (203)..(203): a, c, t, g, unknown or other
  misc_feature (203)..(203): n is a, c, g, or t
tcagagtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctcctctcctgcagggccagtcagcatgttagcacctacttagcctggtaccaacaaaagcctggccaggctcccagactcctcatctatgatgcgtctaccaggccactggcgtcccggcaggttcagtgccagtgggtctgggacagacttcactctcaccatcagcagcctagacgcccgaagtattttgcggtttattactgtcagcagcgtgccaactggcctctcgacgttcggcggagggaccagggtgacatacgaaacgacgtgtggctgcaccatctgtcttcatcctcccg

SEQ ID NO: 123696 - DNA, 715 bp, Homo sapiens
  misc_feature: GYAE6OF01ESQMX.48.67.G01.1.454.CMB.1.raw
tcagagtatacatacacgaccggtgctcgatttagagtatacatattgggtttgggggaggaactgactcagttaggacccagagggaaccatcggaaggccccagcccagcttctcttcctcctgctactctcggctccctagctagccaccgggagaaattgtgctgacacagtctccagccacctgtccttgtctccagggcaaagagcctcctctcctgccagggccaggtcagcatgttagcaccgtacttagccttggtaaccaacaaaagcctaggtccaaggtctccagacgtcctcagtctatcgatgcgtctaccgagggccacgtcggcgtccggcaggttcagtcgccagtgggtctagggacaggacttcgacttctacaccatcaagactaacgacctaggacgtacccgtaaagtagtttttacggacggttttaattaaccgtggttacctaaggtcctaaggtccgttaggacccctaaacgttcggggcccctttacgttaccgtaaccggggttttccggggaccggggtaacggggtaacccgtaaaggggtttacggaaaccgttaagttaacccgaaaaaaccggtaaccgttcgggtttaccgggttacccttacggtaccctaaacccgtaacgttttcccgttacgggtttacccttttacgtaaccggtttcccccgtttaccccccgg

SEQ ID NO: 123697 - DNA, 522 bp, Homo sapiens
  misc_feature: GYAE6OF01BDID4.48.67.G01.1.454.CMB.1.raw
  modified_base (514)..(514): a, c, t, g, unknown or other
  misc_feature (514)..(514): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccacgtggccgtcccggccaggttcagtcgccgaggtgggtctgggacagacttcactctcacatcagcagcctagacgcccgaagtattttgcggtttattactgtcagcagcgtgccaacgtcggcctctcgtacggttcggcggagggaccagggtcggacatacgaaacgacgtggtggctgccacatctgtcttcntcctcccg

SEQ ID NO: 123698 - DNA, 505 bp, Homo sapiens
  misc_feature: GYAE6OF01AMAXD.48.67.G01.1.454.CMB.1.raw
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccaggccactggcgtcccggcagggttcagtgccagtgggtctgggacagacttcactctcaccatcagcagcctagacgcccgaagtattttgcggttttattactgtcagcagcgtgccactcggcctctcgacgttcggcggaggaccaggtcgacatacaaacgactgngctgcacatctgtcttcntcctcccg

SEQ ID NO: 123699 - DNA, 513 bp, Homo sapiens
  misc_feature: GYAE6OF01ASMAH.48.67.G01.1.454.CMB.1.raw
  modified_base (505)..(505): a, c, t, g, unknown or other
  misc_feature (505)..(505): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagacgcccgaagtattttgcggttttattactgtcagcagcgtgccaacgtggcctctcgacgttcggcggagggaccagggtcgacatacaaacgacgtggtggctgcacatctgtcttcntcctcccg

SEQ ID NO: 123700 - DNA, 542 bp, Homo sapiens
  misc_feature: GYAE6OF01ETZRJ.48.67.G01.1.454.CMB.1.raw
  modified_base (400)..(400): a, c, t, g, unknown or other
  misc_feature (400)..(400): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccgagggccactggccgtcccggccaggttcagtgccaggtgggtctgggacagacttcactctcaccatcagcagcctagacgcccgaagtnttttgcgtttatactgtcagcagcgtgccctatcggcccttctcgtacggttcgggcgggacgggacctaagggtggaacagtaccgaaaacgtacgtggtaggctggaccacattctgttccttcacttcccgttaccccg

SEQ ID NO: 123701 - DNA, 544 bp, Homo sapiens
  misc_feature: GYAE6OF01C7N5Q.48.67.G01.1.454.CMB.1.raw
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgtagcacctacttagcctggtaaccaacaaaagcctggccaggctccagactcctcatctatgatgcgtctaccagggccactggcgtcccggcaggttcagtcgcaggtgggtctgggacagacttcactctcacatcagcacgactagacgacgtaagttntttcggtactttagtactgtcngacgngtcgtcactacgcgtctctacgtcggtacgggacggacggacgtagggtacgaactagaaccgaaacgtcgtggacgtctcgtaccactacgttcttacgtcttactcttcccgtacccg

SEQ ID NO: 123702 - DNA, 546 bp, Homo sapiens
  misc_feature: GYAE6OF01AKYAX.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctcctctcctgcagggccagtcagcatgttagcacctacttagcctggtaccaacaaaagcctggccaggctccagactcctcatctatgatgcgtctaccgagggccacgtggccgtcccggcctaggttcagtcgccaggtgggtctgggacagacttcactctcacatcagcagcctagacgcccgaagtattttgcggtttatactgtcagcagcgtgccaacgtcggccttcgtcgtacggttccgggacggagggacccaagggtcgacagtaccgaaacggtacgtggtggctggacccaccgtattcctagttcttctacttccgttccccg

SEQ ID NO: 123703 - DNA, 565 bp, Homo sapiens
  misc_feature: GYAE6OF01BFOWC.48.67.G01.1.454.CMB.1.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggcaggttcagtcgccagtgggtcngggacngtacttcactctcacatcagcacgcctagacgccgaagtntttgcgtttatactgtcagcagcgtacgccaacgtcggccttcgtaccgtacgggttccgggacgggtaacgggaaccgaagggtcgaaccagtaaccgaaaaccggtacgtggtacggcgtcggacctaaccgacttcgtcgttacctttcaccgtttccgtaccccg

SEQ ID NO: 123704 - DNA, 742 bp, Homo sapiens
  misc_feature: GYAE6OF01BZX03.48.67.G01.1.454.CMB.1.raw
  modified_base (489)..(489): a, c, t, g, unknown or other
  misc_feature (489)..(489): n is a, c, g, or t
tcagagtatacatacacgaccggtgctcgatttagagtatacatattgggggtttgggggaggaactgcctcagttaaggacccagagggaaccatggaagccccagccccagcttctcttccctcctgctactctggctcccaggcgagcccaccggtagtaaagttggtgctgaacaccagtcgtccacgccctaccctgtccgttgtcctccgagggcaaaagcgccctccctctccgtgcgaggggccaaggtcgacgcgtattcggttaacgccaacccgttacttacgtcccttaggtaacccaaaacgaaacgtcccgtgggaccaggtcctaccgaagtacccttcctactaatcctaagtggactcggtaccgtacgtacccgacggggcctacggtcggtccgtccccggacggtacggttcgagtcggacctagggttcgggtacgtagggactagtaccttcgacctctaccactancgagccgagccgtaggaccgaccgaaatttgtttacggtacggttttataccgtgtaccgaacgccgtaggtccgtacgaaccctaacggtcggtaccctaccgttaccggaccgggttcgggaacgggaacgggtaaccggtagggtcggaacctaaccggttaccgtaaaaccggttcgtggtcggtactaccggacccgtacgttacgggttcggttacttaccgttcctaacgttccccgttaccccgg

SEQ ID NO: 123705 - DNA, 596 bp, Homo sapiens
  misc_feature: GYAE6OF01C55JL.48.67.G01.1.454.CMB.1.raw
  modified_base (569)..(569): a, c, t, g, unknown or other
  misc_feature (569)..(569): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgctccagggcaaagcgcctcctctcctgcagggccagtcagcatgtagcactacttagcctagtaccaacaaagcctggtcaggctcccagactcctcatctaatgattcgacgtctaccagggcccacgtcggccgtcccggccaagggttccaaggtcgcccgtaggtcggggtactgggggaaccaggactttcacctctccaacatcagcaggcctagacgcccgaaaggtacttttggacgtttatactgtcgtaagctagccgttagacgtaacgttcggccctacgtccgtaacggtttccgggacgggaacgggacccgaagggtggaaccagtacccgaaaaggtaaccgtggtaggcctgctaaacccgtntcttagtacccttactctcccgtaccg

SEQ ID NO: 123706 - DNA, 572 bp, Homo sapiens
  misc_feature: GYAE6OF01BWYJR.48.67.G01.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctntcctgcagggccagtcagcatgttancacctacttagcctggtaccaaacaaaagcctggccaggctcccagactcctcatctatgatgccgtctaccagggccacgtcggccgtcccggccaggttcagtgccagtggtctgggacagacttcactctcacatcagcagcctagacgccgaagtattttgacgtttatactgtcagcagcgtgcccaagtcggccctctccgtacggttccgggacggaacgggtacccgaagggtcggaactacgtaaccgaaaaccggtaacgtggtacgggccttcggacctaacccgagttccttcggttcctttcccgtccgtccccgtaccg

SEQ ID NO: 123707 - DNA, 653 bp, Homo sapiens
  misc_feature: GYAE6OF01D3PJG.48.67.G01.1.454.CMB.1.raw
  modified_base (205)..(205): a, c, t, g, unknown or other
  misc_feature (205)..(205): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaaagngcctccctctcctgcagggccagtcagcatgttagcacctacttagcctaggtaaccaacaaagcctggccaggcctccagactcctcatctatgatgccgtctaccgagggccacgtcggccgtcccggctaggttcagtcgccgtaggtcgggtctggggacacggtacttcgacttctacaacctatcagcacgtcctaaggacgacccgtaagttacttttcggacggttttaattacgtgtacagtcgagtccgtagaccctaacgttcggcccttcgtaccgtaccgggtttcgggaccggggtaacgggtaacccgaaggggttacggaacctaacgttacccgaaaaacggtacgttcgggtacgggccttacggaccctaacccgtacgtttccgttacggtttaccctttaccgtaaccgttccccgtttacccccgg

SEQ ID NO: 123708 - DNA, 653 bp, Homo sapiens
  misc_feature: GYAE6OF01AUFT8.48.67.G01.1.454.CMB.1.raw
  modified_base (111)..(111): a, c, t, g, unknown or other
  misc_feature (111)..(111): n is a, c, g, or t
tcagagtatacatacacgaccggtgctcgatttagagtatacatagttgggtttgggggaggaactgctcagttaggacccagagggaaaccatggaagccccagcccgancttctctcctcctgctacctctgctcccagcagccaccggagtaaattgtgctgacacgagtcctcgacgccaccctgtccttgtctccgagggcaaagcgcctcctctcctggccagggccaggtcagctatgtacgcaccgtattaggccttggaaccaacaaaacgcctggccgaggcctccagtactcctcatctagtgactcgcgttaccaccgacgggcctaaccgtcggccgtcccggtacctaggttcgaaggtcgaccgtggttcgggtcgtcgggtactacgtaccttctacctctaccgaacctacgtacacgcctaacgacctacgaccggtaccccgttaagttacgttttacgtacggttttaataccggtgtacctaaggctacggtcggtagcctaacggtcggccttacgtacgtaccggtccgggacggaacggtaccgaaggtcgaacacgtaccgaaacgtaccgtgtacggactcggtacctaactcgttccgtacgttccctacaccgttcccgtacccg

SEQ ID NO: 123709 - DNA, 501 bp, Homo sapiens
  misc_feature: GYAE6OF01C8H1Z.48.67.G01.1.454.CMB.1.raw
  modified_base (239)..(239): a, c, t, g, unknown or other
  misc_feature (239)..(239): n is a, c, g, or t
  modified_base (494)..(494): a, c, t, g, unknown or other
  misc_feature (494)..(494): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttancacctacttagcctggtaccaacaaaagcctggccaggctcccagactcctcatctatgatgcgtctaccagggccactggcgtccggccaggttcagtgccagtggtctgggacagacttcactctcaccatcagcagcctagagcccgaagacttttgcggtttatactgtcagcagcgtgccaactggcctctcgacgttcggcggaggaccaggtgacagtcaaacgacgtgtgctgcacatctatcttcntctcccg

SEQ ID NO: 123710 - DNA, 629 bp, Homo sapiens
  misc_feature: GYAE6OF01BHIPW.48.67.G01.1.454.CMB.1.raw
  modified_base (496)..(496): a, c, t, g, unknown or other
  misc_feature (496)..(496): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcgggcgacgtcacgcgactagttagtacacctacttacgtcctcggtaaccgtaaaccaaaaacgaaccgtcggtccgacggacgtccctacgactcctccatctatagagtagcgtcgttaccacgggaccgacctacggccggtccccggtcccggacggttacgtacgtcgccgacggtggggtcgtcgggtacgacgtacgttctactctcaccactcacgcacgccttacggacgcccgaaacgtatttttgtcggtttattaactgtcagcngacgtcgaccaactgggcctctcgacggtcgggtcgggaaggacgaggtcggacaatacgaaaccggaactggtcggtcgactccgaaccaacgttcttcggtactttaccacgttcccgtttccccggaccc

SEQ ID NO: 123711 - DNA, 503 bp, Homo sapiens
  misc_feature: GYAE6OF01EY87U.48.67.G01.1.454.CMB.1.raw
  modified_base (434)..(434): a, c, t, g, unknown or other
  misc_feature (434)..(434): n is a, c, g, or t
  modified_base (494)..(494): a, c, t, g, unknown or other
  misc_feature (494)..(494): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtccggcaggttcagtgccagtggtctgggacagacttcactctcaccatcagcagcctagagcccgaagattttgcggtttattactgtcagcagcgtgccaactggcctcncgacgttcggcggaggaccaggtgacatacaaacgacgtgtggctgcacatctgtcttcnttcctcccg

SEQ ID NO: 123712 - DNA, 546 bp, Homo sapiens
  misc_feature: GYAE6OF01A7ZD8.48.67.G01.1.454.CMB.1.raw
  modified_base (534)..(534): a, c, t, g, unknown or other
  misc_feature (534)..(534): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctcctctcctgcagggccagtcagcatgttagcacctacttagcctggtaccaacaaaagcctggccaggctcccagactcctcatctatgatgcgtctaccagggccacgtggcgtcccggccaggttcagtgccagtgggtctgggacagacttcactctcaccatcagcagcctagacgccccgaagtattttgcggtttattactgttcagcagcgtgcccaacgtcggcccttcgtccgtacggttccgggacggacggggacccaagggtcggacagttaccgaaacgtacgtggtaggctgccaccattctcgttccttcncgttcctccccg

SEQ ID NO: 123713 - DNA, 547 bp, Homo sapiens
  misc_feature: GYAE6OF01EBPTF.48.67.G01.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctcctctcctgcagggccagtcagcatgtancacctacttagcctggtaccaacaaaagcctggccaggctcccagactcctcatctatgatgcgtctaccagggccactggcgtcccggccaggttcagtcgccagtgggtctgggacagacttcactctccacatcagcagcctagacgcccgtaagtattttgcgtttatactgtcagcagcgtgcacgtcgcctctcgacggttcggacggtacgggaccaagggtcgaactagtaccgaaaacgtacgttggtaggccttcggcctaaccgtagtccttacgttaccttctattcccgttaccccg

SEQ ID NO: 123714 - DNA, 502 bp, Homo sapiens
  misc_feature: GYAE6OF01AWBAV.48.67.G01.1.454.CMB.1.raw
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggaggaccaaggtgacntacaaagactgngctgcacgatctgtcttcntctcccg

SEQ ID NO: 123715 - DNA, 549 bp, Homo sapiens
  misc_feature: GYAE6OF01E4RER.48.67.G01.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaaagcctggccaggctcccagactcctcatctatgatgcgtctaccagggccactggccgtcccggccaggttcagtgccaggtgggtctgggacagacttcactcncaccatcagcagcctagacgacccgaagtattttggcggttttatactgtcaggcagcgtcgaccctaacgtcggccctctccgacgggttcgggacgggacgggaccaagggtcggacataccgaaaacgtacgtggtaggcctggaccaccagtctgttccttcattccgttccccg

SEQ ID NO: 123716 - DNA, 571 bp, Homo sapiens
  misc_feature: GYAE6OF01D9L1O.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaaagcctggccaggcctccagacctcctcatctatgatgcgtctaccagggccacgtcggccgtccccggcaggttcaggtcgccgaggtggggtctgggacagtacttcactctcaccatcagcagcctagacgacccgaagttacttttgtacggttttattacttgtcagcagtccgtcgccgtaacgtcggccctcgtccgtacggttccgggacgggacgggaccgagggtacgaacacgtaccgaaacgtacgtggacggctcgaccacctacgttcctagttccttctcttcccgtccccg

SEQ ID NO: 123717 - DNA, 593 bp, Homo sapiens
  misc_feature: GYAE6OF01AOPSX.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagacgcctccctctcctgcagggccagtcagcatgttagctacctacttagcctggtaaccaaacaaaagcctggccaggcctcccagactcctcatctatgatgctctaccagggccacccgtggccgtccccggcctagggtttccaggtcgcctaggtgggtcgtgggacagtaccttcgactctcacctactcagcacgcctagaccgccgtaagtacttttggacggtttattacgtgtacagcagtccgtgacccacgtcggccttcgtaccgtaccggttcgggaccggtaagggacccgtaagggtcgaacgtataaccgaaacgtagtcggtacggactcgcctaacgtacttcgttcgttaccttactcttcccgtcccccg

SEQ ID NO: 123718 - DNA, 558 bp, Homo sapiens
  misc_feature: GYAE6OF01A90DW.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccacgtggccgtccccggcaggttcagtgccgagtgggtctgggacagacttcactctcaccatcagcagcctagacgcccgaagtattttgcggttttatactgtcagcagcgtcgacctaacgtcggcctctccgtacggttcgggcgggacgggaccaagggtcgaactagtaccgaaaacggtacgtcggtaggctggccctacgactttccgtagttcctttcacttcccgttacccccg

SEQ ID NO: 123719 - DNA, 617 bp, Homo sapiens
  misc_feature: GYAE6OF01C5YCW.48.67.G01.1.454.CMB.1.raw
tcagagtatacatacacgaccggtgctcgatttagagtatacatatttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagctacctacttagcctaggtaaccaacaaaagcctggccaggcctccagacctcctcatctatgatcgcgtctaccgagggccacgtggccgtcccggccagggttccagtcgccgaggtcgggtctgggacagacttcactctcaccatcagcacgcctagacgacccgaagtattttgtacggttttaatactgtcagccagtccgtcgacctaacgttcggcccttacgtccgtacgggtttccgggaccgggtacggggaaccctaggggtcggaactaacgtaccgaaaaccggtacgtcgggtcgggtacttacgaccgtaaccctagtttccgttagtttaccctttccaacgtttcccccgttaaccccg

SEQ ID NO: 123720 - DNA, 596 bp, Homo sapiens
  misc_feature: GYAE6OF01EI3TL.48.67.G01.1.454.CMB.1.raw
  modified_base (401)..(401): a, c, t, g, unknown or other
  misc_feature (401)..(401): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccgagggccactggccgtcccggcctaggttcagtgccaggtgggtctgggacagacttcactctcaccatcagcagcctagacgcccgaagtnttttgacggtttatactgtcagcagcgtgaccctaagtcggcccttcgtccgtaccgggtttccgggaccggggtaacgggaccgtaaggggttcggaaacctagttaacccgaaaacggtaccgttgggtacgggtcctcggacccaacctagttccgttaggttaccctttcaccgtttcccgttacccccgg

SEQ ID NO: 123721 - DNA, 637 bp, Homo sapiens
  misc_feature: GYAE6OF01CTB3Y.48.67.G01.1.454.CMB.1.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggcaaaagcgccctccctctcctgcagggccagtcagcatgtancactntagcctgtacaanaagctgacagctccagactctnatctangatgcgtactacgacggccacgtcgggccgtccccggctaggttcagtcgccgagtcgggtctagggacagtacttcacgttcaccacgatcaagctagacctagacgacccgtaagttactttttcggacgttttattaacgtcggttacaagcgtaacgtcggtacgcctaaccgtggaccccttcgttaccaccggggtttaccgggacgggttaaacggggacccgtaaggggtacggaacctaacgtaaccgtaaaacggtaccggtacgggtacggtaccttacggacccgtaaacctagtttcccgtacgtttacctttacctacgttccccgttaacccccg

SEQ ID NO: 123722 - DNA, 550 bp, Homo sapiens
  misc_feature: GYAE6OF01CSF1T.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaagcctggccaggctccagacctcctcatctatgatgcgtctaccagggccacgtggccgtcccggcaggttcagtcgccgaggtgggtctgggacagacttcactctcaccatcagcagcctagacgccgaagtatttgacggtttattactgtcagcaggtcgtcgccaacgtcggccctacgtccgacggttcggacggacgggaccagggtgacctagtaccgaacgacgtggtggcgtcgacctaccgtagttccttacgttactttcacttcccgttcccg

SEQ ID NO: 123723 - DNA, 700 bp, Homo sapiens
  misc_feature: GYAE6OF01A5ZP1.48.67.G01.1.454.CMB.1.raw
  modified_base (303)..(303): a, c, t, g, unknown or other
  misc_feature (303)..(303): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaaagcgcctccctctcctgcagggccagtcagcatgttacgcacctacttagcctggtaaccaacaaagcctggccaggcctccagacctcctcactctatgntcgccgtactaccgagggccacgtcggccgtcccggcgaggttcagtcgaccgtaggttcggggtctcgggactacgtacttccactctaccgacctagtcgacgacacggtaccctaaggacgtaccccggtaaagttacgtttttcggtacgggtttttaacttaccgttcgtaccgtaagccgttacgggtccgttacgacccgtaaccggttccgggtaccccttctacccgggtaccgggtttccgggacgggtaacggggaaccgtaagggttcgggaaactaccggttaaaccggaaaaccggtacggttacggtagggacccgttcggacccttaacccgttacgttccgttaccgtttcccttttacccgcccgtttaccccggaccc

SEQ ID NO: 123724 - DNA, 657 bp, Homo sapiens
  misc_feature: GYAE6OF01EO76L.48.67.G01.1.454.CMB.1.raw
tcagagtatacatacacgaccggtgctcgatttagagtatacatattggggtttggggggaggaactgctcagttaggacccagagggaaccatggaagccccagcccagcttctcttcctcctgctactctggctcccagcagccaccgggagaaattgtgctgacacagtctccagcccaccctgtcccttgtctccagggcaaagcgcctcctctcctgcagggccagtcagcatgttagctacctacttacgcctggtaaccaacaaacgcctggccaggcctccagacctcctcatctatgatcgcgtctaccgagggccagttcggccgtcccgcgaggttcagtcgcgagtgggtctgggacaggtacttcactctcacatcagcacgcctagacgcccgtaagttcttttgacggtttattacgtgtacgagcgtaggtccgtgacccgtaacgtcgggccctttccggtaccgtaccggggtttaccgggacgggggtaaccgggaacccgtaaggggttacggaaacccgtaacgtttaccggaaaaaaccggttaccggttacggttacggggtaccttcgggaccctaaccgtaaccgtttccggttacgtttacctttaccgtacccgtttcccgttacccccg

SEQ ID NO: 123725 - DNA, 553 bp, Homo sapiens
  misc_feature: GYAE6OF01B842P.48.67.G01.1.454.CMB.1.raw
  modified_base (97)..(97): a, c, t, g, unknown or other
  misc_feature (97)..(97): n is a, c, g, or t
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (442)..(442): a, c, t, g, unknown or other
  misc_feature (442)..(442): n is a, c, g, or t
tcagagtatacatacacgaccggtgctcgatttagagtatacatattggggttggggaggaactgctcagttaggacccagagggaaccatggaacncccagccagcttctcttcctcctgctactctggctccagcagccaaccgagaaattgtgctgacacagtctccagccaccctgtccttgtctccgagggacaaagcgcctcctcgtcngcacggccagtcagcatgtagcactatagctagaccaanaaacnctgacagctccgagactcctcatcctangactgcgtctacgacggccacgtcgcgtccggcaggtccagtcgcgtagngggtcgnggacaggtctcgactctacctacatcagcagtcctaagaccgaccgtaatagtttgacgtttaactagtgttacgagactacgtcgttacactaacgnggtaccctagtcgacggttacggcggaacggtaccagggtcgacgtactaaccgaaacgaacgtgacgtacacggacctaacgtgtctacgttactcgtattccgtacccg

SEQ ID NO: 123726 - DNA, 660 bp, Homo sapiens
  misc_feature: GYAE6OF01DMJZJ.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagcgcctccctctcctgcagggccagtcagcatgttagcaccttacttacgcctaggtaaccaaacaaaacgcctggaccaggcctacccagacctcctcacttctatgatgccgtcgtaccgacggccacgtcggccgtcccggcaggttcacgtgccgtaggtcgggtctcgggactacgtacttccacttccacaccatcgagccaacgtccgtacgaacgtacccgtaaagttcgttttcggtacgttttataccgtgtactacgcacggtcgtcgaccctacgtcggacccttcgtacgtaccgggttcggggaccgggtaacgggaccgtaaggggtcgtaacgtaacgtaacccgaaaacggtacggttcggtagggtcccttacggacccttaaccgtacgtttccgttaccggtttacctttccctaaccgtttcccccgttaaccccgg

SEQ ID NO: 123727 - DNA, 704 bp, Homo sapiens
  misc_feature: GYAE6OF01CX0KV.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggcaaagacgccctccctctcctgcagggccagtcagcatgttacgctacctatagcctaggtaaccaacaaagccgtggaccaggcctacccagtacctcctcatctatgatcgcgtctaccgagggccacgtcggccgtcccggcgtaggttcaggtcgccgtagggttcggggtcgtacggggaactacggtaccttacgaccttcctacctaaccctaagttccaacggcctaacggtacccgttaaggaacccggtaaccccggttaaagtttacgttttttcggtaacggttttttaacttaccgtttcgtacgtaacggtaccgacggtaccggttacgacccgtaaacggttccgggtacccttccgttaccgttaccgggttccggggaccggggaacgggtaacccggtagggtacgaacgtaacgtaccgaaacgtacgtggttacggcttcgacctaccacgttcgtacgttacctttcacgttcccgtaccccg

SEQ ID NO: 123728 - DNA, 618 bp, Homo sapiens
  misc_feature: GYAE6OF01B3CH9.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaaagcgcctccctctcctgcagggccagtcagcatgttagcactacttagcctaggtaaccaaacaaaagcctaggaccaggcctacccagacctccgtcatctatgatgcgtctaccgagggccacgtcggcgtcccggctaggttcagtcgccgtaggtcggggtctggggacacggtacttcgaccttcgtccaaccatccgaagccgaagtcccgtaagacgacccgtaaagtcgtttttaggaccggttttaatacgtgtacagcctagcgtcgaccaacgtcggcctacgtcgaaccgggttcgggaccggtaagggaccctaagggtcggaacacgtaccgaaaacgtacgttggcgggactcggacccaaccgtgttccctgttcctttaccacgtttcccgttaccccg

SEQ ID NO: 123729 - DNA, 593 bp, Homo sapiens
  misc_feature: GYAE6OF01DY0FI.48.67.G01.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaaagngcctccctctcctgcagggccagtcagcatgttagcactacttagcctggtaccaacaaagcctggccaggcctccagtactcctnatctatgatgcgtctaccgagggccactggccgtccccggcctaaggttcaggtcgccgtaggtcgggtctgggactaggactttcgaactctcaccatcgaagcagccctagacgcccgtaaagtagtttttgacggttttaattaccgtgttacagcagcgtacgcctaacgtggccttccgtcgtaccgggttccgggacggaacgggtaaccgagggtcggaacctagttaccgaaaacgtacgttggtacgcgtgacccactagttccttcgttcttaccacgtttcccgtaccccg

SEQ ID NO: 123730 - DNA, 568 bp, Homo sapiens
  misc_feature: GYAE6OF01ANCOT.48.67.G01.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctcctctcctgcagggccagtcagcatgttagcacctacttagcctggtaccaacaaagcctggccaggctcccagactcctcatctatgatgctcaccgngggccactcggcgtccccggcaggttcagtcgccgagtgggtctgggacagacttcactcncaccatcagcagcctagacgacccgaagtntttcgcgtttattacgtgtcagcagtccgtncctaactcggccctcgtcgtaccggttcggaccgggacgggacccgtaagggtcggaactacgtaccgaaaacggacgttgggnggtacctggacccaccttagtccgttagttaccctttcacgttccccgttacccg

SEQ ID NO: 123731 - DNA, 584 bp, Homo sapiens
  misc_feature: GYAE6OF01EKQZA.48.67.G01.1.454.CMB.1.raw
  modified_base (571)..(571): a, c, t, g, unknown or other
  misc_feature (571)..(571): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggcaaagcgcctccctctcctgcagggccagtcagcatgttagcaccttacttagcctggtaccaacaaaagcctggccaggcctccagacctcctcatctatgatgcgtctaccgacgggccacgtcggccgtcccggcctagggttcaggtcgccgtaggtggggtctgggacaggtacttcactctcaccatcgacgcacgccgtaggacgaccgtaagttagttttggacggttttattacgttgtcagcgagcgtgaccctaacgtcggtccttccgtcgtacgggttccgggacgggacgggaccgtaagggtcggactagtaccgaaacgtcgtggtcggctcggacctcacttcgtcttaccttcncttcccgttcccg

SEQ ID NO: 123732 - DNA, 564 bp, Homo sapiens
  misc_feature: GYAE6OF01CLNFF.48.67.G01.1.454.CMB.1.raw
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaaccaaacaaaagcctggccaggcctcccagacctcctcatctatgatcgcgtctaccgagggccacgtcgggccgtcccgggcctaggttcaggtcgccaggtgggtctgggacagacttcactcncacatcagcacgcctagacgccgaaagtnttttcgtcggtttatacgtgtacagccgagtcgtgacctaacgtcgcccttctccgtacggttcgggacgggacgggaccgagggtcggaacacgtaccgaaacgtacgtcggtaggactcgacaccattctgttcctctcttccgttcccc

SEQ ID NO: 123733 - DNA, 716 bp, Homo sapiens
  misc_feature: GYAE6OF01BQMEV.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccacgccaccctgtccttgtctccgagggacaaagcgccctccctctcctgcgagggccagtcagctatgttacgcaccttagtacgcctaggtaaccaaacgaaacgtcctacggaccacggcctaccacgtacctcctactaactcttatgtacgtcgccgtaccgtaccggacggggtccctacggtcgggtccccggtaccccgggtacgtacgggttcctaggtccggtacccggtaggggtcggggtcgtacggggtaccacggtaccgttaccaccgttaccgtaccaactacgtaccgaacgccgtacggtaccgtaggaccggacccgttaaaggtttcttttacggtacggttttaacttacgtagttaccgagtaccgtacgcgttaccgaccgtaacgtccgtcctcgtaccgtaccggttcggacgggacggtaacgagggtcgaacgtcgaaccgtaaaacggtcgtacggtcggactcgtaccgtaaccctagttccttacgttacccttcttaccgtcccgttaccccg

SEQ ID NO: 123734 - DNA, 920 bp, Homo sapiens
  misc_feature: GYAE6OF01B51BA.48.67.G01.1.454.CMB.1.raw
  modified_base (207)..(207): a, c, t, g, unknown or other
  misc_feature (207)..(207): n is a, c, g, or t
tcagagtatacatacacgaccggtgctcgatttagagtatacatattgggtttgggggaggaactgactcagttaggacccagagggaaccatggaagccccagcccagcttctcttcctcctgctactctggctcccagctagccaccggagaaattgtgctgacacagtctccagccaccctgtccttgtctccgagggcaaagngcctcctctcctgcagggccagtcagcagtgttacgctacctacgttacgccgttggtaaccaaacgaaaacgtccttaggaccctaaggtcccttacccgaaggacccttccctacaagttcctaagttcgtaacgttcggaccggttaccgtaaccggacggggtccctaaccggttcgggtacccggttaccccccgggtccgtaacggggtttcccaacgggttacggacccgtaaggggtttcggggttacccggttaggggggaaaccctaagggtaacccgttttaccgaacctttcccgttaacccaaacccctaacgtttacccgaacggtacccgaacggtaccccgttaaacgggaaccgtaaccccggttaaaggttacgtttttttacgggtaacccggttttttaaagtttaacccgtcgggttaaccgtacggtaccgtaccggttccggtacgtaccccgtaaaccgttccgggtcccctttaccggttaacccgtacccggggttttacccgggggaccgggtaacggggtaaccccggttaaaggggttccgggaaaacgttaaccggttaacccgaaaaaaaccggttccgtttggggttaaacccgggtccttaacccggtacccttaaacccgtgttttacccggttacggttacccttttaccgtaaacccgtttccccggtttacccccg

SEQ ID NO: 123735 - DNA, 768 bp, Homo sapiens
  misc_feature: GYAE6OF01D1MNV.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggacaaagacgccctccctctcctgcagggccagtcagcatgtagctacctacttagcctgtaaccaaacaaaacgcctggccaggcctacccagtacctcctcattctatgatcgaccgtcgtaccgacgggccacgtcgggcccgtccccggcctacgggttcagtcggcccgtaggtcggggtcgtacgggactacgtaccgttactaccgtacctacctaaccctattccgaacggcctaacgacccgttaaggaaccggtacccccggtaaagtttacgtttttacgggtaccggttttttaacgtttaccgttacgggttacccagggtacccgtagggtcccggttaaccgtacccgtaaccggttcgggtaccccttaccggtaccggtaacccggggtttccggggaaccgggggtaacgggtaaaccccggtaaggggtacgggaaacccgtaacgtaaacccggaaaacggttaaccggttcgggtcggtaccgttccggaccgtaaccctacgtttccggttacttacccgtttctaacccggtttcccttaccccccgg

SEQ ID NO: 123736 - DNA, 761 bp, Homo sapiens
  misc_feature: GYAE6OF01BKK00.48.67.G01.1.454.CMB.1.raw
  modified_base (747)..(747): a, c, t, g, unknown or other
  misc_feature (747)..(747): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggacaaagcgccctccctctccgtgcgacgggccagtcagcagttgttacgcctacctacgttacgaccgtaggtaaacaaacaaaacgtccgtaggaccacggtcctacccgagtaccttccctactacttaccgtatacggacgttcggtccgttaccgtaacccggacgggaccctaacggtccgggtcccggttaccccgggaccgttaacgggtttaccgaacgggttcggtacccggtaggggttacggggtaccggtacggggaacctacgggttaaccctttaccgaaccttccgttacccaacctacgttacgacggaccgtaaccggtccgtaacggaccgtaccggtaaagtttcgttttacgggttacgttttaacttacgtcgtacgacgtacgtacggtccgtacgaccctacgtcgtcctccgttacgaccgggttcgggacgggtaacggtacggtaggcgaacgtaccgtaaccgaaaagtcggtggtaccgtacgtccgacctaacgttacgttcgttacgttcctttaacncttccccgtacccg

SEQ ID NO: 123737 - DNA, 664 bp, Homo sapiens
  misc_feature: GYAE6OF01EB9D3.48.67.G01.1.454.CMB.1.raw
  modified_base (265)..(265): a, c, t, g, unknown or other
  misc_feature (265)..(265): n is a, c, g, or t
  modified_base (650)..(650): a, c, t, g, unknown or other
  misc_feature (650)..(650): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagcccaccctgtccttgtctccagggcaaagcgcctccctctcctgcagggccagtcagcattgtagcacctacttagcctggtaaccaaanaaaacgcctggccaggcctacccagacctcctctattctatgatcggccgtctaccgagggcccacgtcgggccgtaccccgggctaacgggttcaggttcggccgtaggttcggggtctaggggaccagtaccgttcaacctcctaccaacctattaccgacgcctaacggcccgtaaaggaccgtaccccggtaaagttacgttttttcggaccgggtttttaattaacccgttggttaccagggtaccgtacggtccgttacgaccctaaccgttggccccttactccggtacgggtttccgggacgggtacgggtaaccgtagggtgaactagaccgaaaacgtacgtgtacggctcgaccactatccttagttccttacnctcccgttaccccg

SEQ ID NO: 123738 - DNA, 730 bp, Homo sapiens
  misc_feature: GYAE6OF01E0S56.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccacggagaaattgtgctgacacagtctccagccaccctgtccttgtctccagggcaaagcgcctccctctcctgcagggccagtcagcatgttacgcacctacttagcctaggtaaccaacaaaacgcctggccaggcctccagactcctcatctatgatcgccgtctaccgacgggccacgtcggccgtcccggcctaggttcagtcgccgagggttcgggtcgtaggggacacggtaccttcgacttcctaccaacccgtatccgaacgccacgtacccgtaaggaccggtaccccgtaaaggttacgttttttacgggaccggtttttaattaccgttcggtacctaacgggtaccgtaacgggtcccggttacggaaccccctaacggttcgggtacccccgttaccgttaccccggtaccggggtttcccggggaccggggtaacgggtaaccccggtaaaggggtccggaaccgtaacgttaacccgaaaaaccggttaccggtaggtaccgggtcctacggaccctaacccgtattcccgtttacggttacctttaccgtacctttccccgttacccccg

SEQ ID NO: 123739 - DNA, 569 bp, Homo sapiens
  misc_feature: GYAE6OF01BBG3X.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctactagcctggtaccaacaaaagcctggccaggcctccagactcctcatctatgatgcgtctaccgagggccacgtcggcgtccccggctagggttcaggtcgcgaggtgggtctgggacagtacgttcactcacaccatcacgcagtcctagacgaccgaagtattttcggcggtttatacgtgtctagctagcgtacgcctaagtcgtctcgtccgtacggttcgggacggacgggaccgtaagggtcggaacacgttaccgaaacgttacgtggtaggacgtcgactacctagtccgttagtcttccacgttcccgttacccg

SEQ ID NO: 123740 - DNA, 889 bp, Homo sapiens
  misc_feature: GYAE6OF01AFBMR.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtcctccgagggcaaagcgccctccctctccgtgcacgggccagtcagctagtgttacgcctaccttacgttacgccttacggtaacccaaaacgaaacggtcccgtacggacccgacggtccctacccgacgtaccctcctacctaacttcctaagtgtacgtcgtacccgttaccgtaacccggtaccgggccctaccggttcgggtaccccggttaccccgggaccgttacggggtttaccaccggtttccggacccggttaaggggtttcggggttaccggtacgggggtaaacctaccgggttaaccctttccgtaacccgttcccttaacccgtaaacccgtacgttacccggaccggtacccgtaaccggttacccggtaaacggaacccgggttaaccccggttaaaggtttttaccgttttttaccgggttaaccggttttttaactttaacggtcggttaccgacggtaccgtacggtccgttaccgaccgttaaccggtccgtccttaccggtaccggtacggggttacccggggacgggtaaccggtaacggtaacggggtccgtaaccgtaacgttaaacccgggaaacgttaccggttcggggtacgttaacccggtcggtaccccgtaacgttcggttacctttaccggtttaccttacccttccccggtttccccgttaaccccg

SEQ ID NO: 123741 - DNA, 651 bp, Homo sapiens
  misc_feature: GYAE6OF01BR46F.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagacgcctccctctcctgcagggccagtcagcatgttagcacctactagcctggtaaccaaacaaaacgcctggccaggcctacccagacctcctcatctatgatcgccgtctaccgacgggccacgtcgggccgtcccggcgtaggttcagtcgccgtaggtcggggtcgtggggacacggtactttcgacttcgtaccaacctagtccaaggccaacgcccgtaaggaccgtacccgtaagtttacttttcggtacggttttaacttaccgtgtaccaggcctacggtcgtacgacccgtaccgtcggtccctcgtccgtaccgggttccggggacgggtaacgggacccgtaaggggcgaaccgaagtacccgaaaaacggtccgtggtacggacgttcggacctaccgacgtttctacgttaccttacctacgttcccttaccccg

SEQ ID NO: 123742 - DNA, 1043 bp, Homo sapiens
  misc_feature: GYAE6OF01CLTZU.48.67.G01.1.454.CMB.1.raw
  modified_base (179)..(179): a, c, t, g, unknown or other
  misc_feature (179)..(179): n is a, c, g, or t
tcagagtatacatacacgaccggtgctcgatttagagtatacatattgggggtttgggggaggaactgcctcgagttaacggacccagagggaaccactggaagccccagccccagcttctccttcccttccctgcctactcgtggcgtcccaggcagcccaccggtagtaaagttggngactgaacacacgtcgtccacgccctaccctgtccttgctaccgaggggaagccgccaccctcgtccgtgggtacggccaaggtcgaaggaagttcgggttaaacgggactcccgtaacgttccgttaacgggcccctttcggggttaacccccaaggtaaccctaaaaaaaacccggttccgggtacccccgtaaggtacccccgttacccccggtaaacggggtccctttaacccccggtaccttaccgttaacccgttaaccggttacgggaccccggtttcccggaacccggaccggggaaccccgtaacccggtcccgggttaccgaaacccggttccccggaaacggtttaaccgaacggggttttacggaacgggttacggggaacgtacggggttaccgggtaccgtaacggggtacgtaacggtaccgttttacaccgttaccgtaccctacccgtaactccgaaaccctaacgggtaccgttaacggggtaccggtacccgttacggtaacggttaccgttaaagtttttcggaccggtttagggtttttaccggtttttccgtaacgggttacccggaaacgttcccggtaacggttacggtaacggggttaaccctttaaccgaaccgggtttaccggaaccgttaccggtttcccggggaacggtaaacgggggttaaccgtaaacggggttaccggaaaaacgttaccgggaaaaacccggtttacggtttaccggttccgggtaacgtacccggtacccgttaacccggtaacccggttcggttaacccggggttaccggtttaccccgttaggtttcccccggtttaaccggtacccccggtttaacg

SEQ ID NO: 123743 - DNA, 787 bp, Homo sapiens
  misc_feature: GYAE6OF01C6MMG.48.67.G01.1.454.CMB.1.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagcccaccctgtccttgtctccgagggcaaaagcgcctccctctcctgcagggccagtcagcatgtancactacttgcctgtaccaanaaagctgccagcctccagactcctacntctatgagtcgtcgtcctaaccgnggccacgtcggccgtcccggccgacggttcgagtcgccgaggttcgggtcgtacgggacaacgttaccttacctaccttcctacccgaacctagtaccgagtccgaacggtcccgtaacgggtaccgtaaccccggtaaagtttacggttttttacgggttaacggtttttaacgttaccgtttgggttaccaaggtaccgtacggtccggtaccgaaccccgtaaccggttccgggtaccccttccgttacccggttacccgggggtttccggggaacccgggggtaaccgggtaaacccgggtaacggggttcgggtaaaaccgtaaacggttaaaacccgggtaaaaaccgggtaaccggttacgggttaaccgggtaccgttaaccggaacccgtaacccgttaacgtttacccggtttaccgtttacccgttttacccctaacccggttttcccccttaacccccccggg

SEQ ID NO: 123744 - DNA, 928 bp, Homo sapiens
  misc_feature: GYAE6OF01ALLLP.48.67.G01.1.454.CMB.1.raw
tcagagtatacatacacgaccggtgctcgatttagagtatacatattggggttttgggggggaggaactgctcagttaggacccagagggaaccattggaagccccagcccagcttctcttcctacctgctactctggctcccagctaggccaccggagaaattggttcgctgactactagtctccacgcctaccctgtccttgtctccgagggcaaagcgcctccgtctccgtgccagggccaggtcacgcatcgttacgcctaccgttacgttacgcccgttacgggtaacccaaaactaaaacgtcccgtacggtacccaagggtcccttacccgaggtaccttccctcgtacttcgttaacgtcggacgtcggtccggttaccgtaacccggacgggacccgtacggttcggggacccggttccccggggtaccgttagggtttaccgtagggttcggtacccggtaagggttcggggttaccggttagggggtaacctaacgggttaacctttacctaacccgttcccgtaccaaccccgtacgtacccgaacgggaccgtaaccgggtacccttaaacggtacccggtaaccccggtaaaggtttacgttttttacggggttaccggttttttaaacgtttaacccgttacgttaaccgtaacggttacccgttaacggtaccggttaaccgtaacccgtaaaccggtttccgggacccctttaccggttacccggtaaccggggtttccggggaaccggggtaacccgggaaccggtaacggggtccggtaacgtaaccgtttaaaccgtaaaacccgggttacggtttcgggtacggtaccggtacggtaaccccgtaaccggttacgttccgggttaccgtttaccccgttcccgttaaccgttccccgtttacccccg

SEQ ID NO: 123745 - DNA, 614 bp, Homo sapiens
  misc_feature: GYAE6OF01DAY0D.48.67.G01.1.454.CMB.1.raw
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
tcagagtatacatacacgaccggtgctcgatttagagtatacatattgggtttgggggaggaactgctcagttaggacccagagggaaccatggaagcccagcccagcttctcttcctcctgctactctggctccagcagccacggagaattgtgctgacacagtctccagccacctgtccttgtctcgagggacaaagcgcctcctctccngcgagggccagtcagcatgttacgctaacctattacgcctaggtaaccaaaanaaacgcctaggaccacggcctaacccagacctcctacattctaatgactcgcgtacctaccgaggccagtcggccgtccgcgtaggttcaggtcacgaggtcgggtcngggaactgtaccttcacttcaccgacgtcagtacgacgacgtcgacctagaacgttnttgacgtagtcgtattagcgtcacgtctaagtacgtgacgtcctcgaaccgttactacccgtaccggtaccggaccgaaagggtaccaaccgtaagggtacgaaacgtaaaccgttaaaccggcgtttggacggtactaccggaccctaacgtagttctacgtttcccttacgtaccgtttccc

SEQ ID NO: 123746 - DNA, 564 bp, Homo sapiens
  misc_feature: GYAE6OF01EUOJD.48.67.G01.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaaagcctggccaggcctccagacctcctcatctatgatgcgtctaccgaggccacgtggccgtcccggcctagggttcagtcgccgaggtgggtcgtgggacagtacttcactcncaccntcagcagcctagacgcccgtaagtcttttgacgttttatacgtgtcngcagcgtgcctaacgtcggccttcgtcgtacggttccgggacggtacggaccgaagggtcgaacagtaccgaaacggtacgtcggtaggccgtgaccacctagttctcgttacttcgtacttcccgttaccccg

SEQ ID NO: 123747 - DNA, 689 bp, Homo sapiens
  misc_feature: GYAE6OF01EEQSD.48.67.G01.1.454.CMB.1.raw
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggcctcccagcagccacggagaaattgtgctgacacagtctccagcccacctgtcctgtctccgagggcaaagcncctcctntcctgcaggccagtcagcatcgtacgctacctactagcctaggtaaccaacaaaacgcctcggccacggcctacccagacctccgtacattcctagtgactcggccgtacgtacccgacggtccacgttcggaccgttcccgggctacgggttcagtcggaccgtaggtcgggtcgtacgggacacgtacgtccacttccgccaactatcgaacgtaccacgtacccgtagaccgtacccggtaagttcgttttacggtaccggtttttataccgtacgtacgacggtcgtaccgttcggactacccgtaacggtcgtacccgtcgttaccggtacgggttaccggggaccggtaacgggaacctaggggtagaaccgttacgaaaccgtaaacgggttacgcgggttaccgggtacctacgtacccgaacccttagttccgttacgtttaccgtaccctacgttccccggttaccc

SEQ ID NO: 123748 - DNA, 671 bp, Homo sapiens
  misc_feature: GYAE6OF01A4JQ7.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagacgcctccctctcctgcagggccagtcagcatgttacgcacctacttagcctggtaaccaacaaaacgcctaggccaggcctccacgacctcctcattactatgatcgcgtaccaccgacggccacgtcgggccgtccccggccgtacggttcacggtcgccgtaggtgggtacgtggacgagtacttcgacttctaccacatcgacgcgacgtcctaggaccgtacccgtaaggttcgttttacgggtaccggttttaattaccgtggttacacggtccgtacggtcgtacggacccgtaacgttccgggtcccttcgtccggtaaccgggttccggggaaccgggtacgggtaaccggtaacgggtcggtaacccacggtaaaccgaaaacgggtaacgttcgggtacggctacggacccgaacctcgtttaccgtgtttaccccttgtaaccttcccgtaccccg

SEQ ID NO: 123749 - DNA, 721 bp, Homo sapiens
  misc_feature: GYAE6OF01CHRPW.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctccagcagccacggagaaattgtgctgacacagtctccagccaccctgtccttgtcctccgagggcaaagcgccctccctctcctgcgacggccagtcagctatgttacgctaccttacgtacgcctaggtaaccaaacgaaaacgccgtaggaccgaacggtccctacccgaacgtccttaccctactacttactaagttgacgttcgtccgtaccgtaacccggacgggtccctaccggtccggtcccggtacccgggtacccgtaggttaccgacgtccggaccggtagggttacggggtcgtaggggtaccacggttaccttccactcctaccgaacctagtccgacggtaccaacggtacccggtaagaccggtaacccggttaagttcgtttttcggtaaccggtttttaacttacgttcggttacgaggtccgtaggtccgttacgaaccctacgtcgtcccttacgtccggtaccgggtcggacgggtaacggacgaaggtcgactaacgtaacgaacgtacgtcggtgtacctcgaccgtactcgttactttcgtacttacctccgttcccgttacccg

SEQ ID NO: 123750 - DNA, 867 bp, Homo sapiens
  misc_feature: GYAE6OF01DCBHR.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtcctccgaggcaaagacgcctccctctcctgcacgggccagtcagctatgtagctacctacgttagccttaggtaacccaaataaaacgcccgtagggacccagggtcctacccgacgtaaccttcctacctaacttcctaattcggtaacttcggtaccgttaccgtaaccggacggggtacccctacggtcgggcccgggttaccccgggaccttaacgggtttaccgacgggttcggacccggttaggggtcgggggttaccggtaggggtaaccgtaacggttacctttaccgtaccgttacccttaacccaacccggttaactaccgacggtaccggtaaccgtaacccgttaacggggtaaacccgtaccccggtaaaaggttttacgttttaccggtttaacgggttttaaccttaccgttcggtacgtacgtacgtaaggtcccggttaacgaccggtaaccgtcggtacccttacgtcccggttaaccgggtttccggggaacggggttaacccgaaccgggtacgggtacctaaacggtaacgttaacccggaaaaccggttaacggtcgggttaccgggtaacccgtcgggaaccccttacccggtttaacgttccggtttaccggttttaccctaacgggtttaccccttccccggttaacccccg

SEQ ID NO: 123751 - DNA, 700 bp, Homo sapiens
  misc_feature: GYAE6OF01BTRBD.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctactagcctaggtaccaacaaaagcctggccaggcctaccagacctcctcatctatgatgcgtctaccgaggccacgtcggccgtcccggcaggttcagtcgccgaggtcgggtcgtacgggacagtacctttcaccttcgtaccaacctatccgaacgcctaacgtccccgtaaggaaccgaccccgtaaaggttcgtttttacgggtaccggtttttaatttaccgttcggttaccaggtaccgtacggtaccgttacgaacccgtaacggttcgggtcccttaccgttaccggtacccggggtttcggggaccgggtaaccggggtaacccgtaaggggttaccgggaacgtaacgttaccgaaaaccgggttacgttcgggtaacgggtctaccggaccctaaccgttagttcccgtccggtttaccttccttaccggttccccgttaccccg

SEQ ID NO: 123752 - DNA, 647 bp, Homo sapiens
  misc_feature: GYAE6OF01EQTPS.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagcgcctccctctcctgcgagggccagtcagcattgttacgcaccttacttagcctacggtaaccaaacaaacgcctaggccaggcctcccagacctcctcacttctatgactcgccgtctaccgacgggccacgtcgggccgtcccggcgtaggttcacggtcgccgtaggttcgggtcgtacgggacgtaggtaccttcgaccttcctactacctatccgacgcgacgaccgtaggacgacccgtaagttacgttttggtacgttttattaccgtgtacgagtcgacgtccggtagacccgtaacgtcggtaccctccgtaccgtaccggggttcgggacggggtaacggtaccggtaggtacgtaacacgtaaaccgaaacggtagtcgggtacgtctacgacccgtactacgttcgtcgttacctctccgttcccgtacccg

SEQ ID NO: 123753 - DNA, 706 bp, Homo sapiens
  misc_feature: GYAE6OF01BAMFP.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggcaaagcgccctcctctcctgcagggccagtcagcatgttacgcctaccttacttacgccttaggtaacccaaacaaacgccgtcggccaggcctacccagacctcctcactctatgatgcgtctacgcgggtccacgtcggccgtcccggctaggttcaggtcgacgtaggtcgggtcgtacgggactacggtaccttccaccttcctaccgtaaccctagttaccgacggtaccgtaacggaccgttagggaccgtacccgttaggtaactttacggttactttttcggacgtttagtttttcggtttttcgacgttcgaagtaccgttaagttacggttacgggttaacgttacccgtaccgttacggtaacgttaccgggttccggaccgggtaacggggtaaccggtaagggtaacggtaaactaaccggtaaacggtacgtgggtacggtccgtacgaacccaccgttacgttcttacgttaccttccgtccgtttaccccg

SEQ ID NO: 123754 - DNA, 800 bp, Homo sapiens
  misc_feature: GYAE6OF01C1V5W.48.67.G01.1.454.CMB.1.raw
  modified_base (772)..(772): a, c, t, g, unknown or other
  misc_feature (772)..(772): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctccagcagccaccggagaaattgtgctgacacagtctccagccaccctgtccttgtctccgagggcaaagacgccctccctctcctgcgacgggccagtcagctatgttacgctaccttagttacgccgtacggtaaaccaaacgaaaaacgtccgtacggacccgaacgggtccctacccgaacgtaaccttccctactactacttaacgtcgaagttcggtccggttaccgtaacccggaacggggtccccgtaaccggttccggggtaccccggttccccccggggtaccgtaacggggttttacccgaacggtttccggacccggttaaggggtttcggggggttaccggtacgggggtaacctaacgggtttaaccctttccgaacccgtttaccgttaaaccgaacccctaaacttaccggaaccgcctaaaccggtacccgtaacggaaaccggtacccggtaaagtttacgtttttacggtaacggtttttaactacgttcgttacgacgtcgaggtccgtacgaccgtaacgtcggtaccttccggtacgtacgggttccggacgggtaacggaccgtagggtcgaaacgtacgtaacgaaacgtcggtacgttgacgtcgacctacgtnttccgtattctaccgaccgttcctcccg

SEQ ID NO: 123755 - DNA, 756 bp, Homo sapiens
  misc_feature: GYAE6OF01A7OE4.48.67.G01.1.454.CMB.1.raw
  modified_base (717)..(717): a, c, t, g, unknown or other
  misc_feature (717)..(717): n is a, c, g, or t
tcagagtatacatacacgaccggtgctcgatttagagtatacatattgggtttgggggaggaactgctcagttaggacccagagggaaccatggaacgccccacgcccagcttcctccttcctcctgtctactctggcctcccagcacgcccaccgggaagaaattgtgctgacacacgtcctacccaaccctaccctgtccttcgtcctccgagggacaaagcgccctcccctcctccgtcgcgacggggacctacgtacgagacctacgttgttacgacctaacccttacgttaccgtacccgttacggtaaacccaaaacgaaaaccgtcccgttacggacccgaccggtccctacccgaactacccttccctactacttctacgtagtacgtcgtaccgtacccgtaaccggtacgggaccctacggtcgggtcccgtccccggccgtacggttcacggtcgccgtagggttcgggtacggtacggactacgtacttcgaccttccaccactactccgacgtccgacgtccgtaacggaccgtaaccgttaagtttcgtttacggttaacgttttattaccgtcgtacgtacgtgaccggtccgtacaccgttaccgtccgtctccggtacggttcccggtacggggacggtacgggaacgtaggacgaactacggaaaccaagggtctaacgggtcctcgacaccgttaccncgtttccgttctccgttcccaccgttccgtccccgtaac

SEQ ID NO: 123756 - DNA, 623 bp, Homo sapiens
  misc_feature: GYAE6OF01A7I2K.48.67.G01.1.454.CMB.1.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgctccgagggcaaagcgccctcctctcctgcagggccagtcagcatgtagcactntcgctgacaanaagcngcagcnccagctcncatctatgatcgcgtctaccgacggccacgtcggccgtcccggcgtaggttcagtcgcgtaggtgggtcgtacggactacggtacttcgactcctaccacctagtccacgcaacggtcctaacggaccgtaccgtaaggttcgttttacggtacgttttacttacgcgttacgagccgtaggtccgtacgacctacggtcggtcccttcgtaccggtaccgggtcggggaccgggaacgggaaccgaacgggtcgaaacgtacgtaaccaaacggtacgttgggtacggtcttacggacccttaacgcgtttccgttacgtttaccttccgttacgttccccgttacccg

SEQ ID NO: 123757 - DNA, 917 bp, Homo sapiens
  misc_feature: GYAE6OF01DTWLA.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctccagcagccacggagaattgtgctgacacagtcctcacgcctacccttgtccttgtcctccgagggacaaaagcgtccctccctctcctgacgacgggccagtcagtctattcgttacgcctaaccttacgttacgcccgttaaggtaaacccaaaaccgtaaaaacgcccgttacgggaccccgaacgggtacccttaccccgaacgtaaccccttacccgtaccctactttaccgttaagttacggtaacgttccgggtaccgtttacccggtaaaccccggtacgggggtacccctaaccgggttcccggggtcccccgggttacccccggggaccccggttaaacgggtttaccgaacggtttaccggaacccggttaagggggtttcggggggttaacccgtacgggggtaacctaaacggttaacccgtttacccgtaccttcccgttaccaacccgtacgttaccgaaccgggttacaaccggtccctaaacggggaacccggtaaccgtaaacggttttcgttttttagggttaacgggtttttaactaccggttcgtacgaccggtacgtaaccggttcgtaaccgaccctaaggttcccggtaccttcccggtaacggtttaccggggtccggggaaccgggtaacggggtaaccgttaagggtacggaaaccttaacgtaaaccgtaaaccgggtacggtcgtcgggtaacctcggacctaaaccggtctttcgtaccgtttacctttaccgccgtttcccggttaaccccc

SEQ ID NO: 123758 - DNA, 703 bp, Homo sapiens
  misc_feature: GYAE6OF01EHEKY.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagacggaaccatggaagccccagcgcagcttctcttcctcctgctactctggctcccagattccactggacaaatagtgatgacgcagtccccagcccaccctgtctgtgtctccgaggggaancgtcaccctctcctgcgagggccaggtgagagtcttgacagtccttccgttacgccgttacggtaacccaaacgaaacggccgtcggcccacgccctacccgaggtccttccctctaattttacgtagtaactaccactacccgaccgacgggcctacgtcggtcgtacccagcccgtaggttcacgtcggggtcggttgggtcgtagggacaggtacgttcctactcctaccgacctatccgagacacgtcccgtgaccgtacgttcgtaaggtaacgtttaactttttaacttaagtttttacttacttcgtacgtacgtactaggtttacgtacgttaggtcggtaaccgttccggttacggtttacgggaaccgtaagggtaacctaaggggtacgtaacgtaacgaaacggtagtcggtacggtccgtagacctaccgtacgttaccgttacgtttccttaccgtaacctttccccggtcccgtacgttaaccg

SEQ ID NO: 123759 - DNA, 725 bp, Homo sapiens
  misc_feature: GYAE6OF01EYDNS.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaattgtgctgacacagtcctcagcccacccttgtccttgtctccgagggccaaaagcgcccttccctctcctgcagggccagtcagcagtgttagccaccttagttacgccttacggtaaccaaacgaaacgccgtcggaccacggcctacccaggaccttcctctacttcgtagtgacttcgccgtcctaccgcggcccacgtcggcccggtcccggcgtacggttcgacgtcggaccgtaggtcgggtcgtacggggactaggtccttacgacctacctccaacctacttccgaacgtccaacggtacccgtaacgaccgtaaccccggtaagtttagttttttaccggtacgggtttttaacttaccggtttagtacctaggaccgtaggtacccggttcgtaacccgtaacgttcggtcccttacctacccgggttaccggttacccggggacggggtaacggacccggtaaggtacgggaactaacggtaccgtaaaaccggtaccgtggttacgggactcggaacctccgtacttccgttcgtacctttacgccgtttccctaccccg

SEQ ID NO: 123760 - DNA, 843 bp, Homo sapiens
  misc_feature: GYAE6OF01BXA7T.48.67.G01.1.454.CMB.1.raw
  modified_base (149)..(149): a, c, t, g, unknown or other
  misc_feature (149)..(149): n is a, c, g, or t
  modified_base (255)..(255): a, c, t, g, unknown or other
  misc_feature (255)..(255): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctccagcagccacgganaattgtgctgacacagtcctccagcccacccttgttccttgtcctccgagggactaaagcgtcccttccctctccgtgcgacggtccagtcagctagttcgttacncctaaccgttacgttacgccgtacggtaaaccaaacgtaaaacggccgtacgaccgacggtcctaccgagtacctccgtactactactagtgacgtcgtaccgtcgtaacccggcgggacctacgggtccggtacccggtccccgggtaccgttacggtttccgaacggtccggtacccgtacggggtttcggggtacccgtacggggtaacgtacggttaccctttaccgcccttacctaccctaacgtaacttccgacgacgtaacggtacctaacgggtaacccgaccggttaacgttttacggtttttcggtaaccggtttttacttaacccgttcggtaaccttaggtcccgtacggtaccgttaccgtacccgttaaccgtccggttcccttaccggttaccggtaccggggttacccggggtaccgggggtaacggtaccccgggtaagggtaccgaaccggttaaccgtaaaccggtaaaaaccgggtccggttagggtaccggtacggtcccggtaccgttaacccgttcgttttccgttacgttagttaaccccttaccgttcccccggtttaacccg

SEQ ID NO: 123761 - DNA, 680 bp, Homo sapiens
  misc_feature: GYAE6OF01ATZRH.48.67.G01.1.454.CMB.1.raw
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagcccacctgtccttgctccagggacaaagcgcctcccgtctcctgcgagggccagtcagcatgtagctacctatacgccgtagtaccaaanaaacgcctaggccaggctacccagcctcctnatcgtatcgatcgtacgtcctaccggaggccacgtcgggtccgtacccgcgtaggttccgacgtgaccgtaggttgggtcgtacgggacctacggtcctttacgaccttaccgtaccaaccgtactaccgacggaccgtaacgtcccgtaaagggaccgtaacccggttaaggttacgttttgggtaaccggttttaacttacggttcgtacgtacgtacgtacgccgttagaccctaacggttcgcccttacgtaccggtacggttaccggggacggtacgggaaccgaagggtcgacgtaactaaccgaaaggttaccgtggtaacggcgttaccgacctacgtacgttacgttcttaaccttcgtaccgtcccgttacccg

SEQ ID NO: 123762 - DNA, 799 bp, Homo sapiens
  misc_feature: GYAE6OF01CC7GH.48.67.G01.1.454.CMB.1.raw
  modified_base (630)..(630): a, c, t, g, unknown or other
  misc_feature (630)..(630): n is a, c, g, or t
tcagagtatacatacacgaccggtgctcgatttagagtatacatattgggtttgggggaggaactgctcagttaggacccagagggaaccatggaagcccagcccagcttctcttcctcctgcctactctggcctcccagcagccgaccggaataattgtcgctagacacgacgtcctccacgccctacccttcgttcctttcgtacctccgaaggggaccaaaacggacctcccttcccttcctccgtggaccgacgggaccaggtccagctagttcgtacacctaccgttactcgccgtaacggtaaaccaaacgaacgccgcggaccgaccggtacctacccgatacccttcctaacgtcttactagttagacgtccgtaccgtacccgtaaccggtacggccgtaccggttccgggaccccggtaccggtaccggttacggtttacgacggttccggaccggtaggggtttccggggtacgacgggtactaccggttaaacctccgtacccttaacgacccaaccgtactaccggaacgtaccctaacggtacccggtaaggaaccccggttaccgtttaaggttttacggtttacggtttaccgtttactccggtcgttagacgnaacccggtgtaccactccgtcgtccttacgggtccggtagggtccgggaacggtacggtaacggtacggtacggaaacttaaggaacccgtaaggacggttggtacccggtacaccgttaacgaccgtttcttaccgtttacttaccttcccttcggccccctttacgg

SEQ ID NO: 123763 - DNA, 716 bp, Homo sapiens
  misc_feature: GYAE6OF01B4T9K.48.67.G01.1.454.CMB.1.raw
  modified_base (167)..(167): a, c, t, g, unknown or other
  misc_feature (167)..(167): n is a, c, g, or t
  modified_base (181)..(181): a, c, t, g, unknown or other
  misc_feature (181)..(181): n is a, c, g, or t
  modified_base (445)..(445): a, c, t, g, unknown or other
  misc_feature (445)..(445): n is a, c, g, or t
  modified_base (507)..(507): a, c, t, g, unknown or other
  misc_feature (507)..(507): n is a, c, g, or t
  modified_base (529)..(529): a, c, t, g, unknown or other
  misc_feature (529)..(529): n is a, c, g, or t
  modified_base (682)..(682): a, c, t, g, unknown or other
  misc_feature (682)..(682): n is a, c, g, or t
  modified_base (693)..(693): a, c, t, g, unknown or other
  misc_feature (693)..(693): n is a, c, g, or t
  modified_base (700)..(700): a, c, t, g, unknown or other
  misc_feature (700)..(700): n is a, c, g, or t
  modified_base (706)..(706): a, c, t, g, unknown or other
  misc_feature (706)..(706): n is a, c, g, or t
  modified_base (713)..(713): a, c, t, g, unknown or other
  misc_feature (713)..(713): n is a, c, g, or t
tcagagtatacatacacgaccggtgctcgatttagagtatacatattgggtttgggggaggaactgctcagttaggacccagagggaaccatggaacgccccagcccagcttctcttcctctgctactcgtcggcctcccaggcacggcccaacggaagtaaattgngactacgactaacngtcctaccgacgccctacccgttcgttccttcggtaccctaccggaagggaacaaaacggcctccctcccgttctaccgcggacgacgggtcaaggtcagtacagttcgtacgacctacctacgttcgaccgttacgaaaccaaacgaaacgtccgacggccgaacggcctaccgtaactacccttcctactaacgtcttagtcgacgtccgtaccgtacgacccgggtacgtcacgggtcccggtcccggtacggacttacgngacggttcgaaccggttgggccggttcgacgtacgacttcgtacctacgtcctacctacganacccgacgtacgcggtgtaacnctacgtatcgttaagttcgagttttagtttcgttacgtacgtaccgtagtaacgtaggtaccgttaagtactaccggtaaccgtcgtaaccgttaccggaccgggttagaccgggtaaccgaggttaaaccagtaacgtacgagttcgacgtnacgtcacgttntacgctnttaccnccttacnccg

SEQ ID NO: 123764 - DNA, 670 bp, Homo sapiens
  misc_feature: GYAE6OF01DY2TJ.48.67.G01.1.454.CMB.1.raw
  modified_base (151)..(151): a, c, t, g, unknown or other
  misc_feature (151)..(151): n is a, c, g, or t
  modified_base (257)..(257): a, c, t, g, unknown or other
  misc_feature (257)..(257): n is a, c, g, or t
  modified_base (510)..(510): a, c, t, g, unknown or other
  misc_feature (510)..(510): n is a, c, g, or t
  modified_base (630)..(630): a, c, t, g, unknown or other
  misc_feature (630)..(630): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggcctccagcagccaccgganaaattgtgctagacacagtctaccagcccaccttgtccttggtacctcgagggacaaagtacgccctcctctcctggccgagggccagtcagctaattcggttacnctaaccttacgttaggcccttaaggtaaaccaaaacgaaacggtcctacggtaccacggtcctaccgtagacccttcctactacttctaagtgacgtcgcggtaccgtaccgacgggtcctaacggtcgggtcccggtccgtacgtagggttcacggttcgaccgtaggttcgggcttacgggacaacgtcctttcgaacctttgacccaacgtatacgaacgctaacgaccgtaagtaccgaccgtaagttntttacggtacgtttagttacgtgtactagcgatcgtcgaactcgtcgtcctacgtccggtacgggttcggtacgacgggaccagggtacgtaacctagaacccgtaaagtcggttaacgnggtacgcgaacctcgtatcttacgtctccgtctcctaccg

SEQ ID NO: 123765 - DNA, 780 bp, Homo sapiens
  misc_feature: GYAE6OF01CRSL2.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctccagcagccacggagaaattgtgctgacacagtctccagcccacctgtccttgtctccgagggcaaagcgccctcctctcctgcgagggccagtcagtcagttcgttacgcctaaccgtacttacggcccttaaggtaacccaaaacgaaacgtcccgtggacccacggtcctacccgagtacccttcctacgtatacttagtacgtactcgtaccgtacctaaccggcggggacctaccggtccgggacccggttcccggaccgtacgggtttcaaggtccgcggtaagggttcggggtacgtacggggaactacggtaccttaccgtacctcgtaacctaccgtaacgtccaacggactaaccggtaccgtacggaaccgggcccgtttaaaggtttcgtttttacggttacgttttaaccgttcggtacgttccggaagtccgacggtccttacgacccgtaacgtcgtacccgtccgtacggttaccgggtcgggaaccggtaacggggaccgtagggtacgaaccgtaaacgaccgaaacggttaaccggttggtaccggtacgtacccggaccttaccggttacgtttacccggtttaggttaccccttttaaacgtccccggtttccccgttaccccgg

SEQ ID NO: 123766 - DNA, 758 bp, Homo sapiens
  misc_feature: GYAE6OF01EZIW1.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcacgccaccgggagaaattgtgcctgacacagtcctccagccaccttgtccttgtctccgagggacaaagcgccctccctctcctgcgacgggccagtcagcattgttacgcctaccttacttacgccttacggtaaccaaacaaacgcctcggaccaggcctcccgagacctcctctacttctatgactcgcgtctaccgacgggcctacgtcggcccggttcccggacgtacggttcacggtcgaccgtagggtcgggtcgtacggggaacctaggtaccctttccaccgttccgtaccaacccgtactaccgaacggtccaacggtacccgtaaggacccggaaccccggttaaagttcgtttttacgggttaccggtttttaacttaccgttggttaccacggtcctaacgggtccgttacgtaccccaacgttccggtacccctttcgtacccggtaccgggttccggggaaccgggtaaccgggtccggtaaaggggtccgtaacctacggtaaaccgtaaaaccggttacggttcggtccggaccgttcgaaccccgtaaccttacgttaccggtttcttaccctttaccgtccgtttacccccgttccccg

SEQ ID NO: 123767 - DNA, 720 bp, Homo sapiens
  misc_feature: GYAE6OF01BNOQ5.48.67.G01.1.454.CMB.1.raw
  modified_base (686)..(686): a, c, t, g, unknown or other
  misc_feature (686)..(686): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggacaaagacgcctccctctcctgcgacgggccagtcagacatcgttacgccacctacttacgccgtacggtaaccaaacaaacgtccgtacggaccaggtaccctccaacgtacctcctactacttactatcgagtcggtaccgttaccgtaccggacggtcctacggtcgggcccggtacccggaccgtacggttcgtacggtccggtccggtagggttcgggtcgtacggggacacgtaccttaccgaccctaccccgaccgtacgtcgacgcgtaaccgtacccgtacggaaccggtaacccgttaagttccggtttttacggaccggtttttaactacgttcggtaccacggttacgcgggtaccgtcaaccgaacgttccggacctcgttacggtccggttacggggacgggaacggtaacggtagggtacgaacgtaacgtacggtaaacggtacgtggtaccggtcgtacggccctacgtnttcgtacgttcttaccgtcttcccgtccgtaccg

SEQ ID NO: 123768 - DNA, 601 bp, Homo sapiens
  misc_feature: GYAE6OF01DRDG2.48.67.G01.1.454.CMB.1.raw
  modified_base (440)..(440): a, c, t, g, unknown or other
  misc_feature (440)..(440): n is a, c, g, or t
  modified_base (513)..(513): a, c, t, g, unknown or other
  misc_feature (513)..(513): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (571)..(572): a, c, t, g, unknown or other
  misc_feature (571)..(572): n is a, c, g, or t
  modified_base (592)..(592): a, c, t, g, unknown or other
  misc_feature (592)..(592): n is a, c, g, or t
tcagagtatacatacacgaccggtgctcgatttagagtatacatattgggtttgggggaggaactgctcagttaggacccagagggaaccatggaacgccccagcccagcttctcttcctcctgctactctggctcccagcagccacggagaaattgtgctgacacagtctccacgtcccacccttgtccttcgtcctaccgagggacaaagcgccctccctctccgtagactacgggccaggtcagctatgtacgctaactacttcgccttagtaaccaacaaacgcctggaccacggtcctccagcctacctctacttctactagagtcgtccgtccgaccgacggccctaggtccggccgtacccggcgtacggtctaggtccaccgtagggtcggtacgtcggactagtacttcacctcgtaccacctagtcgacnccgacgaccgtacgacgtaccgttagttacgttttcgtacgttttactacgtgtacgtgcgtacgtcggtacnctaacgtcgcttcgacgtccgtaggcggaggtacagntaacntacgagtaccgtgccnncaactctacgtctgtctacncttcacccg

SEQ ID NO: 123769 - DNA, 615 bp, Homo sapiens
  misc_feature: GYAE6OF01EVT4Q.48.67.G01.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (583)..(583): a, c, t, g, unknown or other
  misc_feature (583)..(583): n is a, c, g, or t
  modified_base (601)..(601): a, c, t, g, unknown or other
  misc_feature (601)..(601): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccacctgtccttgctccagggcaaagngcctccctctcctgcacgggccagtcagcatgttanccaccttacttagcctaggtaaccaaacaaaaggcctggccaggcctcccagacctcctcattctatagactgccgtctaccgacgggccacgtcggccgtcccggctagggttcacgtcgaccgaggttgggtctgggactacggtaccttcgaccttcgtaccacctatccgaacgctaacggcctaacggacgaccccgttaaagttacgtttttcggaccggtttttaattccgtaggttaccaaggtccgaggtccgttacgaccctaagtcggtaccctcgtaccgtacgggttcgggacggaacgggacctaagggcgacaacgtacaaacgtcgtgnggtcagccactgttcttntctctctcctcccg

SEQ ID NO: 123770 - DNA, 743 bp, Homo sapiens
  misc_feature: GYAE6OF01BR3U2.48.67.G01.1.454.CMB.1.raw
  modified_base (571)..(571): a, c, t, g, unknown or other
  misc_feature (571)..(571): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccacgccaccctgtccttgtctccgagggacaaagcgccctccctctcctgcgacgggccagtcagctagtgttacgcctactacttagacctacggtaaccaaacgaaaacggtccgaggacccgaacggcccttacccgacgtacccttaccctactacttacctaagtcgtaacttcggtaccgtacctaccggacggtacccgacggttccggcccggtccccggccgtaacggttccgacggtccgaccgtagggttcgggtacggtacggggaacctcggtaacctttacaccgtttaccaccaacctactcgacgacgtaacggtcctaggaacccgtaccggtaaagtttaccggtttttaggtacgggttttaacttcgtacgtccgtaanccggtacgaccggtacgccgtaacgtcggttccctcgtaccgttacgggtacccgggagggaaccgtcggtaagaccggttaacacggtacctaaaagcccggttagtaccgggattccgacgtcctaacttcgggttacctacccgtttcaacccgttccccgggttaccc

SEQ ID NO: 123771 - DNA, 622 bp, Homo sapiens
  misc_feature: GYAE6OF01BXQXK.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggcaaagcgcctcctctcctgcgaggccagtcagcatgtagctactacgtcgccgtaggtaaccaacaaagcctaggccacggcctccaagtcctccactatctatgtacgtcgcgtacctacggacggtccacgtcggtccgccggtaccaggttccagtcgaccgtaggtcgggtctcgggactacgtacttacgacgtctaccgactatcgagcacggcctagacgtaccgtaagttatttacggtcgtttatactgtacagctagcgttacgaccttaacgcggtccgtaccgtactacgggttccgggacgggtaacggacggtaacggtcgaactaacgtaccgaaaaacgtcgtcgggtacgactcccgaactaccggtaacttctagttaccctttacgtacttccccggttaaccc

SEQ ID NO: 123772 - DNA, 725 bp, Homo sapiens
  misc_feature: GYAE6OF01B38JA.48.67.G01.1.454.CMB.1.raw
  modified_base (167)..(167): a, c, t, g, unknown or other
  misc_feature (167)..(167): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcacgccaccggagaattgtgctgacacngtctccagccacctgtccttgtctccgagggacaaagcgcctccctctcctgcgagggccagtcagcagtgttacgctacctacgttacgccgttacggaacccaaaacaaaacggtcccgttacgggacccaacgggtccctaacccgacgtacccttccctacaacttcttaatcggtaacttcggaccgttaccacccggacggggtacccacgtcgggcccggtccccggaccgtacgggtcacggtcgaccggtagggttcggtacggtacggggacctacgtacctttaccaccgttccgtacctacgtaccgtacgaccgaccgtacggaccgtacggacgtaacccgtaaggttacgttttcggtacgttttaacgttcgtacggtacgtacgtccgtaggtccgtacgaccgtaccgtcgttcctcgtaccggtacgggtccgggaaccggtacggaaccgagggtacgaacgtagtaaccgaaaggtccgtggacgtgtacccgacgtaacggtcttcgttcgttaccttacctcgttccctacccgg

SEQ ID NO: 123773 - DNA, 799 bp, Homo sapiens
  misc_feature: GYAE6OF01DUCNE.48.67.G01.1.454.CMB.1.raw
  modified_base (156)..(156): a, c, t, g, unknown or other
  misc_feature (156)..(156): n is a, c, g, or t
  modified_base (243)..(243): a, c, t, g, unknown or other
  misc_feature (243)..(243): n is a, c, g, or t
tcagagtatacatacacgaccggtgctcgatttagagtatacatattgggtttgggggaggaactgctcagttaggacccagagggaaccatggaagccccagcccagcttctcttcctcctgctactctgctccagcagccaccggagaaattgngctgacacagtctccagccaccctgtccttgtctccgagggcaaagacgccctccctctccgtgccagggccagtcagctatgttancctactacttgcctaggtaaccaaacaaacgccgtcggaccaacggccctacccgaagtaccccttcctacagtttcctaattcgattcggtcgtacccgtaaccggacgggtccctacggtccgggtacccggtccccggaccgtaacggtttccgaacggttcgaccgtaggggttcggggtcgtacggggaactaggtacctttcctaaccgttcctaccaaccctacgtaccgaacggtccgaacgtaccccgtaagggtaaccccgtaccggttaaaaggtttacgttttttacgggtaaccgggtttttaaatttacccgttgggttacctacggtccgtaacggtccggtttacacccgttaacggttccggtaccctttaccgttaccggtacccggggttacggggaccgggtaacgggtacccgtaaggggtacgaaaccgtttaacgtaaacccggtaaacggtacttcggggttacgccgttaacgaccctaaccgtcgtttcccgtacggttaccctttaccgccgtttaccccgttaccccg

SEQ ID NO: 123774 - DNA, 834 bp, Homo sapiens
  misc_feature: GYAE6OF01CYVEV.48.67.G01.1.454.CMB.1.raw
  modified_base (156)..(156): a, c, t, g, unknown or other
  misc_feature (156)..(156): n is a, c, g, or t
  modified_base (246)..(246): a, c, t, g, unknown or other
  misc_feature (246)..(246): n is a, c, g, or t
tcagagtatacatacacgaccggtgctcgatttagagtatacatattgggtttgggggaggaactgctcagttaggacccagagggaaccatggaagccccagcccagcttctcttcctctgctactctggctcccagcagccaccggagaattgngctgacacagtcctccagccaccctgtccttgtcctccgaggcaaagcgtcctccctctcctgacacgggccagtcagctagttcgtacnctacctacgttacgcctacggtaaccaaacgaacgtccgtacgaccgacggtcctaccgagtaccttccactacttactagtcgacgttccggtaccgttaccgtaccgggaccggtcctaccggtcgggtcccggtccccggtacggttaacgggtcctaacggtccggcgggtaagggttccggggtacggtaagggaccgtaagtaccccgttacgtaacccgttacgtaacccgtaccgtacgtcccgaaggtacccgtaacggtacccgttaacgggacccggttaccccgggtttaaagttttaccgggtttttacgggtaaccggttttaacgtttaaccgttcgggttacccgtaaacggtccgtaaccggttccgtacccggtaacccgttaccgggttccgtaccccgtaccggttacccgggttacccgggggttacccgggaacggggtaacccggtaaccgggtaagggttacccgaaacggtttaacccaaccgggttaaaacgcggttcggaaggtcccgtacggaccgttaacgtacgtcgttacccgttatacgtccgttccccggttacc

SEQ ID NO: 123775 - DNA, 763 bp, Homo sapiens
  misc_feature: GYAE6OF01A94L0.48.67.G01.1.454.CMB.1.raw
  modified_base (603)..(603): a, c, t, g, unknown or other
  misc_feature (603)..(603): n is a, c, g, or t
  modified_base (609)..(609): a, c, t, g, unknown or other
  misc_feature (609)..(609): n is a, c, g, or t
  modified_base (720)..(720): a, c, t, g, unknown or other
  misc_feature (720)..(720): n is a, c, g, or t
  modified_base (733)..(733): a, c, t, g, unknown or other
  misc_feature (733)..(733): n is a, c, g, or t
tcagagtatacatacacgaccggtgctcgatttagagtatacatattgggtttgggggaggaactgctcagttaggacccagagggaaccatggaacgccccagcccagcttctcttcctcctgctactctggctcccagcagccacggagaattgtgctgacacagtctccacgccacctgtcccttgtctccgagggacaaagacgtccctcctcgtcctggcgacgggtccacgtcagctagtcgttacgcctaccgttacgttacgccgttacggtaaccaaacgtaaaaccgccgtacgacccgaacggtccctaccgaacgtaccttcccgtactacgttaccgttagtacggtacgttcggtacccggttacccgaaccgggtaaccgggtccctaaccggggttacgggccccgggttaccccgggtaccggttaacgggtttaccgaaccgggttccgaacccggttaggggttacggggttacgttaccggggaactacgttaaccgttccaccttacctaccgaactacgtacgacgcttaacggccctaacgggacttaccgtaaagtttcgtttacgttaattctaacgngtaacncgtagtacggtactccacgtacgttccgactttcccgacgggtttaccgggccggaacgggaccggtaaggacgtacggtacctaataaccggaacttcgggcgtaccgtntacgtaccacttntacgttccttacctactccgttaccctccc

SEQ ID NO: 123776 - DNA, 641 bp, Homo sapiens
  misc_feature: GYAE6OF01AW88X.48.67.G01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagattccactggacaaatagtgatgacgcagtccccagccaccctgtctgtgtctccaggggaaanagtcaccctntcctgcagggccagtgagagtctgacagctcctagcctggtaccaacaaggcctggccagcctccaggctcctcatttatgatacatccaccagggccacgtcggtcgtcccagcctaggttccacgtggcggtggtctggggacaggagtcccactccgtacaccgatcaggccaggtaccctgaccgtacggtctagaacgttacttttaactatttttaacttaccgttgttacctaagtcgtagttattacggttaagtcggtactcccggtaacgttttcgggacccgtaaacggggtacccgtaaagggttcggaaacggttaccgaaaaaccggtacgtaggtacgggtcgtcggaccctaaccgtacttacgttacgttaccctttccaacgtttccttcccccggtaccctagttaccg

SEQ ID NO: 123777 - DNA, 985 bp, Homo sapiens
  misc_feature: GYAE6OF01ECZ6X.48.67.G01.1.454.CMB.1.raw
  modified_base (424)..(424): a, c, t, g, unknown or other
  misc_feature (424)..(424): n is a, c, g, or t
tcagagtatacatacacgaccggtgctcgatttagagtatacatattgggtttgggggaggaactgctcagttaggacccagagggaaccagtggaacgccccagcccagcttctcttcctcctcgctactcgtcggcctacccagccacgcccgaaccgggtaagtaaacttggtacgctagacctaactacggtcctaccaccgtcccctacccgttcgttccgtttacggtccgtaccggaagggtaaccgaaacgccgttcccccttccccttcttacccgtcggaccggtacccgggtacctacggtaccgaacgttacgtacgtttacggttacacccgttaaccgtttacgttaaccgtaccgttaaccggtaaacccgtaaaacgaaccgtccgtacgggacccgtaccgtacccncgtacctacccttacctactcgttacgtagtcggtacgtccgtaccgtacccggttaccgcccggtacccgtaccggtacccgggtccccggttaccgggtacccgttaaccgggtttaccgacggtaccggtaccggtttacgggggttaccgggtcggttaaaccggtccggtttaaccgttaaccctcccgttaaccctacggtttaacccacgttaccgtacggacccgtaacggtacccggtaacccgttaaggaaccccggggttttacgtttaaaccggtttttcggttttaaaccggtttacgtttccgtttaaccggtacggttaaccgggtaccgtaccggttacggtaacccgggtaccgttaacccggttacccgtttccgttacccgggttacgtttaaccccgggggtaccgggtaccgggggtaaaccggtaccgggtaacggtaccggtaaccgtaaacgtaccggtaaccgtaaacggttcggtccgtaagtcccggaacttccgattcccgtattacccttagtccgttccctacccggtccg

SEQ ID NO: 123778 - DNA, 741 bp, Homo sapiens
  misc_feature: GYAE6OF01CLMAD.48.67.G01.1.454.CMB.1.raw
  modified_base (598)..(598): a, c, t, g, unknown or other
  misc_feature (598)..(598): n is a, c, g, or t
  modified_base (663)..(663): a, c, t, g, unknown or other
  misc_feature (663)..(663): n is a, c, g, or t
tcagagtatacatacacgaccggtgctcgatttagagtatacatattggggtttggggggaggaactgctcagttaggacccagagggaaccatggaacgccccagcccagcttctcttcctcctgctactctgcctccagcacgccacggataattgcgctagacacacgtctccacgaccctacccttgttccttcgtcctaccggagggacaacgtaccgtcccttccctccgtccgtcggaccgacgggtcctaggtcacggtacgtacgttacggtaccacccttaccgttacgttaccgtaccgtaacgtaacccaaaacgaaccggtccgtacggaccgtaccggtaccctacccgtacgtacccttacctcttaacgttactacgtacgtacgttccgtaccggttaccgaccggtaccggaccgtaccgggtcccggtacccggtacccggtcgttaccggttacgcggtccgtacggttacgggtcggtcgacgggtactacgtacctacacctcactcactcacgacacgtacggtacgacggttacgttaggttttccgtttacgttacgttactaacgtcgtacnggccgtacggtcctacgtaacgtccgtcgtctacggtacgggtaccgggtagggaggaccgttanacgggactacgtataaaccgtgggactcggtacaccctcgagttccctagtttcccttgttacctcccagttccctag

SEQ ID NO: 123779 - DNA, 803 bp, Homo sapiens
  misc_feature: GYAE6OF01EC4F6.48.67.G01.1.454.CMB.1.raw
  modified_base (246)..(246): a, c, t, g, unknown or other
  misc_feature (246)..(246): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaattgtgctgacacagtctccacgcctaccctgtccttgtctccgagggacaaagcgccctccctctcctgcgacgggccagtcagcattgtacnctaccttacgttagccttacggtaaccaaaacgtaaaacggccgtacggacccgtacggtccctacccgagtacccttacctacgtaactttacgtaatcggtacttaccgggtaccgttccgtaaccggacgggtaccccgacggttccgggtaccccggttacccccgggaccgttaacggttccgtacggttcggacccggttaggggtttacgggtccggtacggggtaacctacggttaccttaccctacgttaccgtaccctaacctacgttccgaacggcctaacgggttacccgtaaacggacccgggtaacccgtaaaggtttttcgttttaacgggtaccgtttttaataccggtttacgtaacgacgtacgtacgtcgttaccgaccgtaacgttcggtacccttacgtcggtaccggggttacgggaacgggaccggtaacggtacggtggaaacctaacgtaacccggtaaaagtacggttcgggtacggcctcggaactacccggttagttcttaccgttacttcctcgttccccgtaacccg

SEQ ID NO: 123780 - DNA, 874 bp, Homo sapiens
  misc_feature: GYAE6OF01DUX2T.48.67.G01.1.454.CMB.1.raw
tcagagtatacatacacgaccggtgctcgatttagagtatacatattggggtttggggggaggaactgctcagttaggacccagagggaaccatggaagccccagcccagcttctcttcctcctgctactctggctcccagcagccaccggagtaaattgtgctgacacagtctccacgccaccctgttccttgtcctccgagggcaaagcgccctccctctcctgcgacgggccagtcagctagttagttacgcctaccttacgttacgccgtacggtaaccaaacgaaacggccgtacggaccgtacggtccctacccgacgtacccttcctactacttaccttagtcgtattcggtccgtaccgtaccggaccgggtcccaccggtccgggtaccccggtcccgggtaccgtacgggttccaggttccgaccgttaggggttcgggtcggtacggggaacctacggttaccttccgtaccttccgtacctaaccgtactcccgtaacggacctaacgggtacccgtaacgggtaacccgggtaaccggtttaaagggttttacggttttttaacggggttaccggttttttaaattaccggtttcggtaacccgtaaggtaccggtaccgggtccggtaccgtacccggttaaccggttcccggttcccgttaccggttcccgggttaaccgggggtttccggggaaccggggttaaacgggtaaaccgggtacggggttaaccgtaaaccgtaaccggttaaaccggaaaccggtttacggtaccgggtggtacccgttacggtaacccgttaccgttacgtttccggttaaccctttacccggttaccttcccgtttcccccggtaccc

SEQ ID NO: 123781 - DNA, 819 bp, Homo sapiens
  misc_feature: GYAE6OF01C1ZE1.48.67.G01.1.454.CMB.1.raw
  modified_base (152)..(152): a, c, t, g, unknown or other
  misc_feature (152)..(152): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggcctcccagcagccaccgganaattgtgctgacacagtctccagcccacctgtccttgtctccgagggcaaagacgtcctcctctcctgcgagggccagtcagtcatgttagcctacctactcgcctaggtaaccaacaaaacgcctacggacctacggtcctacccgacgtaccctacctacttacctacgtacgtacgtacgtaccgttaccgtacccggtaaccggtaccggtaccggtccgggtccggttaccccgggtcccgtaccgggttaaccgtccgtacggtaccgtcgggttacgggttcgggtacgggtaaccggtaacgttaacccttaccggtaccttaacccgttaccgtaaccctaaccgttacgaaccgtaccgttaccggaaccgttaacccgggtacggtaacccggttaacggtttaaccggttttacggtttacggtttacgtttaaacttcggttacctacggaccgtacggtaccggtccgttaacccggaccgttaccggtacccgttccgttaccggttaccggttacccggggtaccgggaaccggggtaacgggtaccgacggtaaccaaccgttaacgaaccggttacgtacggtacggtcgaacccgtcgaccctttagtccgttacgttccgttactacccttcccgtcccgttacccg

SEQ ID NO: 123782 - DNA, 736 bp, Homo sapiens
  misc_feature: GYAE6OF01D6M46.48.67.G01.1.454.CMB.1.raw
  modified_base (151)..(151): a, c, t, g, unknown or other
  misc_feature (151)..(151): n is a, c, g, or t
  modified_base (258)..(258): a, c, t, g, unknown or other
  misc_feature (258)..(258): n is a, c, g, or t
tcagagtatacatacacgaccggtgctcgatttagagtatacatattgggtttgggggaggaactgctcagttaggacccagagggaaccatggaagccccagcccagcttctctttcctcctgctactctggctcccagcagccacgganaattgtgctgacacagtctaccgacgccctacccttgttccttgtcctccgagggacaaaggcgtcccttccctctcctgacgacgggccagtcagctatggttacncctaccttacgttacgccgttacgtaaccaaacaaaacggcccgtacggaccacggtccctacccgagacccttcctactacttctaacgtgacgtggtaccgttccgtaaccgacgggccacgttcgggtcccgtccccgggtaccgtagggttaccaggtccgtacgtagggttcgggtcgtacggtacgaacggtaacctttcgacctcgtaccaaccgtactaccagacctacgacccttaacggaacgtacccggtaaagtttcgttttacggtacgttttaacgtactcgtacagtccgtaggaccttcggacctaacgtcgggtacccttcgtccggttacgggtcgggaccgggaacggtaaccgtagggtacgaacctagtaaaccgaaacggttacgtgggttcgaaccgtcgaccgtaaccctttaagttcttactttacccttagtaccccttcccggttaccccg

SEQ ID NO: 123783 - DNA, 900 bp, Homo sapiens
  misc_feature: GYAE6OF01DKJJY.48.67.G01.1.454.CMB.1.raw
tcagagtatacatacacgaccggtgctcgatttagagtatacatattgggtttgggggaggaactgctcagttaggacccagagggaaccatggaacgccccagcccagcttctcttcctcctgctacttcgtcgcctcccagcacgccaaccggaagtaattggtcgactagaccactacgtcctaccgacgtccctaccgttcgttccttcggttccgaccggaacggaacaaacggccgtccccttcccttccgtttaccgcggaaccgccgagtaccgacgtactacgttcgtacgacctaaccgttcgttaaccggtccgttaaaccgaaaccaaaacgtaaccggtaccgaccgggaccgtacgtaccccgttcccgaacgtacccctccttaccacgttactagtacgagttaccgtaccgtaaccgtaccggaccggtcccgtaccgggtcccgggacccggtacccggtagttaccgggtacgcgggtacggcccggttacgggtccggggtacggtaacggaacgttccgttactacccggtaacctttaccgaccctacccgtataccggaccgtacgacccgacggtacgtaaccggtacggttaacgtttacgtttcggtttacgtttaacgtcgttacgtacgacggtacggtacgaccggtaccgtaaccgttcggttaccgtccggttaccgggtaccggtttaacccggggccggggtaaccggtaaccgggggtaacggtaacccgggtacgtaaaaccggtaaccggttaaaacccggtaaacggtaaccggttcgggttacccggtacgacccgaacggtacccttaaccgttcgttaccgtttcccgttaaccttcccgtttcccgtaccggttacccg

SEQ ID NO: 123784 - DNA, 811 bp, Homo sapiens
  misc_feature: GYAE6OF01ESXGD.48.67.G01.1.454.CMB.1.raw
  modified_base (158)..(158): a, c, t, g, unknown or other
  misc_feature (158)..(158): n is a, c, g, or t
tcagagtatacatacacgaccggtgctcgatttagagtatacatattgggtttgggggaggaactgctcagttaggacccagagggaaccatggaagcccccagcccagcttctcttcctcctgcctactctggctcccagcagccacggagaattgngctgacacagtctccagccctaccctgtccttgtcctccgagggacaaaagcgtccctccctctcctgcagggccagtcagcattgtacgcacctatagcctagtaaccaacgtaaacgcctaggcccaggtcctacccgagacccttcctacaacgttcctagtcgaacgtttcgaccgttaccgtaacccggacgggtccctacggttaccgggccccgttacccccgggtaaccgttaccgggttacctaacgggtccgtaaccggtaaggggttccggggtcctacgggggtaactacggttacccttaccgacccgttccttacccaaacgtacgtccaacgggacctaacggtaccttaaggacccgtaccggtaaaggtttacgtttttacggtaccgttttaacgtttacgtccgggttaactacgggtacctagggtcccgttacggtacccccgtaaacgtttcgggccctttaccggaccgttacccggggttaacgggacggggaaacccgtacgggtaacgggttaccggaaacttaccggaaaaccgtaaagggtaccgttggttacgggtccacgggttacccaaccgggttacttccggttaacttcccgtttacgtacccgttcccccgttaccgg

SEQ ID NO: 123785 - DNA, 736 bp, Homo sapiens
  misc_feature: GYAE6OF01BFONG.48.67.G01.1.454.CMB.1.raw
  modified_base (437)..(437): a, c, t, g, unknown or other
  misc_feature (437)..(437): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggcctcccagcagccaccgggagaaattgtgactgacacagtctccagcccaccctgtccttgtctacgagggcaaagcgccctccctctcctcgacgacgggccaggtcagcagttcgtagcctaccttacttacgcctaggtaaccaacaaacgcctcggaccacggccctccgacgtacctccctacctatcgtatacgtactcggtaccgttaccgaccgacgggtcctaccggtcgggtcccggtcccgcgtaggttcgacggtccggccgtagggtcgggtcgaggggtcacgtccttacnccgtcctacaccgtacaccgacgtaaccgacggtacccgttaacgggaccgttaaccggtaggtttaccggttttacggtttacgttttacgtttacggttcttaccgaacggtccgtaacggtccgtcgtacccgtaaccgttcgtccgttacccgaccggttacggggttacccgggacgggttaccgggaacggtaggtaccggtaaccgtacgttaaaccgaacggtaaccgtacggtcggacgtcgaccctattaccgttcgttaccgtcctttacctcccttcccgttacccg

SEQ ID NO: 123786 - DNA, 502 bp, Homo sapiens
  misc_feature: GYAE6OF02I9Z9L.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagccctagacgcccgaagattttgcggtttatactgtcagcagcgtgccaactggcctctcacgttcggcggaggaccaggtgacatcaacgactggtggctgcacatctgtcttcatctcccg

SEQ ID NO: 123787 - DNA, 558 bp, Homo sapiens
  misc_feature: GYAE6OF02GGH2E.48.67.G01.1.454.CMB.1.raw
  modified_base (399)..(399): a, c, t, g, unknown or other
  misc_feature (399)..(399): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccgagggccactggccgtcccggcaggttcagtcgccagtgggtctgggacagacttcactctcaccatcagcagcctagacgcccgaagtnttttgcggtttattactgtcagcagcgtcgacctaacgtcggccctcttcgaccggtttccgggacgggtaacggggacccgaaagggttcggaacagtaccgaaacgtaccgtggtacggcctgaccaccgattccgtgtcctttcacttccctcccg

SEQ ID NO: 123788 - DNA, 619 bp, Homo sapiens
  misc_feature: GYAE6OF02H0X7Y.48.67.G01.1.454.CMB.1.raw
  modified_base (205)..(205): a, c, t, g, unknown or other
  misc_feature (205)..(205): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaaagngcctcctctcctgcagggccagtcagcatgtagcacctattagcctggtaccaacaaagcctggccaggctccagactcctcatctatgatgcgtctaccaggccactggcgtcccggcaggttcagtgccaggtgggtctgggacagacttcactctcaccatcagcagcctagacgcccgaaagtattttcgcggttttatacgtgtcagcaggccgtgaccctaacgtcggcccttcgttccgtaccggtttccgggaccgggtaacggggaacccgtaaaggggttacgggaacctagttaccgaaaaaccggtaccgttacgggtacgggtccttacgggaccctaacccgtaacgtttcccgttacggtttacccgttttaccaaccgttttccccgttaccccccgg

SEQ ID NO: 123789 - DNA, 538 bp, Homo sapiens
  misc_feature: GYAE6OF02G6LPZ.48.67.G01.1.454.CMB.1.raw
  modified_base (399)..(399): a, c, t, g, unknown or other
  misc_feature (399)..(399): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggccgtcccggccaggttcagtgccagtcggggtctgggacagacttcactctcaccatcagcagcctagacgcccgaagtnttttgcggtttattactgtcagcagcgtcgccaacgtcggcctctccgacggttcggcggtacgggccaagggtgacagtacgaaacgacgtggtcggctcggacacctacttcgtcgttcttctacttcccttccccg

SEQ ID NO: 123790 - DNA, 535 bp, Homo sapiens
  misc_feature: GYAE6OF02HWJ5J.48.67.G01.1.454.CMB.1.raw
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (505)..(505): a, c, t, g, unknown or other
  misc_feature (505)..(505): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccntcagcagcctagcgcccgaagnttttgcggtttatactgtcagtcagtcgtgaccaacgtcggccctcgtcacggtttcgggccggagggacccaaggtcgaacagtcaaacgtacgtggtggctgacccanacttcgtagttccttcacttccttaccccg

SEQ ID NO: 123791 - DNA, 503 bp, Homo sapiens
  misc_feature: GYAE6OF02G8QXR.48.67.G01.1.454.CMB.1.raw
  modified_base (476)..(476): a, c, t, g, unknown or other
  misc_feature (476)..(476): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtgacatcaacgactgnggctgcacatctgtcttcattctcccg

SEQ ID NO: 123792 - DNA, 505 bp, Homo sapiens
  misc_feature: GYAE6OF02GYV5H.48.67.G01.1.454.CMB.1.raw
  modified_base (395)..(395): a, c, t, g, unknown or other
  misc_feature (395)..(395): n is a, c, g, or t
  modified_base (479)..(479): a, c, t, g, unknown or other
  misc_feature (479)..(479): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctactagcctggtaccaacaaaagcctggccaggctcccagactcctcatctatgatgcgtctaccagggccactggccgtcccggccaggttcagtgccagtggtctgggacagacttcactctcaccatcagcagcctagacgcccgaagnttttgcgtttatactgtcagcagcgtgccaacgtgcctctcgacgttcggcggagggaccaaggtcgacagtacaacgacgtgnggctgcacatctgtctcatcctcccg

SEQ ID NO: 123793 - DNA, 504 bp, Homo sapiens
  misc_feature: GYAE6OF02JDSUU.48.67.G01.1.454.CMB.1.raw
  modified_base (204)..(204): a, c, t, g, unknown or other
  misc_feature (204)..(204): n is a, c, g, or t
  modified_base (486)..(486): a, c, t, g, unknown or other
  misc_feature (486)..(486): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagacgcccgaagtattttgcggtttattactgtcagcagcgtgccaactcggcctctcacgttcggcggagggaccaggtgacatcaacgactgtgctgcacntctgtcttcactctcccg

SEQ ID NO: 123794 - DNA, 509 bp, Homo sapiens
  misc_feature: GYAE6OF02H4VH6.48.67.G01.1.454.CMB.1.raw
tcagagtatacatacacgaccggtgctcgatttagagtatacatattgggtttgggggaggaactgctcagttaggacccagacggaaccatggaagccccagcgcagcttctcttcctcctgctactctggctcacagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtcgtcccagccaggttcactggcggtggtctgggacagagttcactctcaccatcagcagcctgcagtctgaagtatttactattttattactgtcagctagtatcgtaagtgactcgtacgtttggaccgaaggaccaaggtgaagtcaacgactgtggctgcacatctgtcttcacttcctccgtcc

SEQ ID NO: 123795 - DNA, 499 bp, Homo sapiens
  misc_feature: GYAE6OF02FNFMU.48.67.G01.1.454.CMB.1.raw
  modified_base (386)..(386): a, c, t, g, unknown or other
  misc_feature (386)..(386): n is a, c, g, or t
tcagagtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacaggacttcactctcaccatcagcagcctagngcccgaagattttgcggtttatactgtcagcagcgtgccaactggcctctcacgttcggcgagggaccaaggtgacatacaacgactgtgctgcacatctgtctcatctcccg

SEQ ID NO: 123796 - DNA, 609 bp, Homo sapiens
  misc_feature: GYAE6OF02FZW3A.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcactacttagcctggtaccaacaaaagcctggccaggctcccagactcctcatctatgatgcgtctaccgagggccacgtcgggccgtccccgggcctagggttcagtcgccaggtcgggtctggggacagtacttcactctcaccatcagcagcctagacgacccgtaagttattttggacggttttaattacgtgttaccagctaggtccgtgaccctaacgtcggtacccttcgtaccgtacggtttccgggacgggtacgggaaccgtaagggtcggaacctaagtaccgaaaacggtacgtggtacggtccgtacgtaccaccgtagttccgttacgttcctttaccgtacttcccgttaccccg

SEQ ID NO: 123797 - DNA, 526 bp, Homo sapiens
  misc_feature: GYAE6OF02GTTEB.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacattctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggccgtcccggccaggttcagtgccagtgggtctgggacagacttcactctcaccatcagcagcctagacgcccgaagtattttgcggtttattacgtgtcagcagcgtcgcctaacgtcggccctcgtcgtaccggttcgggcgggacgggaccagggtgactatacgaaacgtactggtggctgcacatctgtctcactcctcccg

SEQ ID NO: 123798 - DNA, 557 bp, Homo sapiens
  misc_feature: GYAE6OF02ICT1E.48.67.G01.1.454.CMB.1.raw
  modified_base (210)..(210): a, c, t, g, unknown or other
  misc_feature (210)..(210): n is a, c, g, or t
  modified_base (431)..(431): a, c, t, g, unknown or other
  misc_feature (431)..(431): n is a, c, g, or t
tcagagtatacatacacgaccggtgctcgatttagagtatacatattgggtttgggggagggaactgctcagttaggacccagagggaaccatggaagcccccagcccagcttctcttcctcctgctactctggctcccagcagccaccgggagaaattgtgctgaccacagtctccagcccaccctgtccttgtctccagggcaaaagngcctcctctcctgcaggccagtcagcatgttagcacctattagcctggtaccaacaaaagcctgccagctccagactcctcatctatgatgcgtctaccgaggccacgtcggccgtcccggctacggttcagtcgccgagtgggtctgggacagactcgactctcaccatcagcagctagacgccaagtattttgacgtttatagtcgtcagcagcgttanaccaacgtcggaccctgtcgtacgggttccgggcggtaagggaccaagggtcgaactagtacgaaacgtacgtggtacggctcgtaccaccgtagttcctcgttaccttctaccgtccttaccccg

SEQ ID NO: 123799 - DNA, 540 bp, Homo sapiens
  misc_feature: GYAE6OF02GJT1I.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctcctctcctgcagggccagtcagcatgttagcacctacttagcctggtaccaacaaaagcctggccaggctcccagactcctcatctatgatgcgtctaccagggccactggcgtcccggcaggttcagtgccagtgggtctgggacagcttcactctcaccatcagcagcctagacgcccgaagagttttgcggtttatactgtcagcagcgtcgcctaacgtggccctctccgtaccgttcgggcgggtacgggacccaaagggtcggaactagtacaaacggtactggtacggctgcctaccgtatccgttgtcttccattccttccccg

SEQ ID NO: 123800 - DNA, 512 bp, Homo sapiens
  misc_feature: GYAE6OF02H8JKX.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctccccagactcctcatctatgatgcgtctaccagggccactggcgtcccggccaggttcagtgccagtgggtctgggacagactcactctcaccatcagcagcctagacgcccgaagtattttgcggtttatactgtcagcagcgtgccactggcctcgtcacgttcggcggacgggaccaggtgacatacgaacgactggtcgctgccaccatctgtcttctactccttcccg

SEQ ID NO: 123801 - DNA, 608 bp, Homo sapiens
  misc_feature: GYAE6OF02JVXC8.48.67.G01.1.454.CMB.1.raw
  modified_base (161)..(161): a, c, t, g, unknown or other
  misc_feature (161)..(161): n is a, c, g, or t
  modified_base (347)..(347): a, c, t, g, unknown or other
  misc_feature (347)..(347): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (591)..(591): a, c, t, g, unknown or other
  misc_feature (591)..(591): n is a, c, g, or t
tcagagtatacatacacgaccggtgctcgatttagagtatacatattgggggtttgggggaggaactcgctcaggttaggacccagagggaaccagtggaagccccaggccccagcttctcttcctccgtgctactctggctcccaggcacgccaccgganaaattgtgctgacacagtctccagccaccctgtcccttgtcctccagggcaaagtgcccgtaccctctcctgccacggggtccagtcgacgcatcgttaagctaacctattaggcctaggtaaccaacaaaacgccgtggaccaaggctacccacgactcctcatctatagatcgcgtactaccgnggccgacgtcggccgtaccggactacggttcagtcgactaggtggtcctgggacaggtacttcactcgtacaccntcgancagcctaaggcgacccgtaagtattttgacggtttatctgttaccagacagacgtcgacctaagtcgtcgtatccgtacggtacggacggtaacgggaccgtaggacgtaacacggtactaacggacttcggacgactcggacctacgtctttacgcgtttacnccttaccgtcttacccg

SEQ ID NO: 123802 - DNA, 544 bp, Homo sapiens
  misc_feature: GYAE6OF02GF9DG.48.67.G01.1.454.CMB.1.raw
  modified_base (203)..(203): a, c, t, g, unknown or other
  misc_feature (203)..(203): n is a, c, g, or t
tcagagtatacatacacgaccggtgctcgatttagagtatacatattgggtttgggggaggaactgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccaggctcccaggctcctcatctctgctgcatcctacgacgggccacgtggcactcccgagacaggttcaggtggctaggtgggtctgggactagacttcactctctccatcagcagacgtggacgtcgtagaagtatttagactaatttattactacgtcacgtagtatggtagctctactcttacgttcggacggtacggacgtaaggtgagtacgtacgaacgtaacgtggtcgactgactacgtactctcgtcttactacttccg

SEQ ID NO: 123803 - DNA, 515 bp, Homo sapiens
  misc_feature: GYAE6OF02FUXAS.48.67.G01.1.454.CMB.1.raw
  modified_base (357)..(357): a, c, t, g, unknown or other
  misc_feature (357)..(357): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccacgtggcgtcccggcaggttcagtgccagtgggtctgggacngacttcactctcaccatccagcacgcctagacgcccgaagtattttgcggtttattactgtcagcagcgtgcctaacgtggcctcgtcacgtttcggcggacggaccaggtgacagtacaacgacgtgtacggctgcacatctgtctctctcttcccg

SEQ ID NO: 123804 - DNA, 511 bp, Homo sapiens
  misc_feature: GYAE6OF02GLGDP.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattacgtgtcagcagcgtgccaactggcctctcgacgttcggcgggacgggaccagggtgacatacaaacgactgtcggctgcaccatctgtctcactcttcccg

SEQ ID NO: 123805 - DNA, 583 bp, Homo sapiens
  misc_feature: GYAE6OF02HKZQM.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctcctctcctgcagggccagtcagcatgttagcacctacttagcctggtaccaacaaaagcctggccaggctcccagactcctcatctatgatgcgtctaccagggccacgtggccgtccggccaggttcagtgccagtgggtctgggacagacttcactctcaccatcagcacgcctaagacgaccccgaagtagttttgacggttttaattacgtgtcgtacgcagcgtagccctaacgtcggcccttcgtcgacggttcgggacggacgggaccgaagggtcggaactagtaccgaaacggtaacgttcggtacggtcgtacggaccaacctagttccgttggtttacccttaccgtacttcccgttaccccgg

SEQ ID NO: 123806 - DNA, 542 bp, Homo sapiens
  misc_feature: GYAE6OF02G5PSP.48.67.G01.1.454.CMB.1.raw
  modified_base (439)..(439): a, c, t, g, unknown or other
  misc_feature (439)..(439): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccgagggccacgtcggccgtcccggccaggttcagtcgccaggtcgggtctgggacagacttcactctcaccatcagcagcctagacgcccgtaagtatttgacgttttatacgtgtcagcagcgtgccacnggcctctcgacgttcgggacggaggaccgtaaggtcgactactacgaaacgtacgtggtcgctcggaccacctagttcctgttcctttacattcccttacccg

SEQ ID NO: 123807 - DNA, 622 bp, Homo sapiens
  misc_feature: GYAE6OF02G0R8J.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctttccttgtctccagggcaaagngcctccctctcctgcagggccagtcagcatgttagcacctattagcctggtaccaacaaagcctggccaggcctcccagacctcctcatctatgatgcgtctaccgagggccacgtcggccgtcccggctaggttcaggtcgccaggtcgggtctgggacagacttcactctcaccatcagcacgcctaggacgacccgaagtacgtttttggacggttttatcgtgtcagcaggtccgtagacctaacgtcggccttccgtccgtacggtttccggggcgggtaacgggtacccgaaggggtaccgaacgacgttaaccgaaaccggtacgttacgggtacggtccgttcggaccctaacccgtagtttccgtacggttttcccttaccgtaccgtttccccgttacccccgtaccg

SEQ ID NO: 123808 - DNA, 561 bp, Homo sapiens
  misc_feature: GYAE6OF02IMY57.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctaccagcagccaccggagaaattgtgctgacacagtctccagccaccctgtccttgtctccagggcaaaagagcctccctctcctgcagggccagtcagcatgttagcacctattagcctggtaccaacaaaaagcctggccaggctcccagactcctcaatctatgatgcgtctaccaggccactggcgtcccggccaggttcagtcgccagtgggtctgggacaggacttcactcgtcaccatcagcagcctaagagcccgtaagattttcgacggtttaattacgtgtacagcaagcgtcgaccaacttgcctactcgacgtttcggaccggtagggaccctaaagggtcgaactagtaccaaacggacgtcgtcggacgttcgacaacctagttccgtacgttccttccttccgtccccgtacc

SEQ ID NO: 123809 - DNA, 517 bp, Homo sapiens
  misc_feature: GYAE6OF02FJMJ1.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaaacgcctggccaggctcccagacctcctcatctatgatgcgtctaccagggccacgtggccgtcccggccaggttcagtcgccgagtgggtctgggacagacttcactctcaccatcagcagcctagacgcccgaagtatttgcggtttatactgtcagcagcgtgccaacgtcggcctcgtccgacgttcggacggtacgggacaaggtcgacatacaacgactggtgctgcacatctgtctcatcctcccg

SEQ ID NO: 123810 - DNA, 568 bp, Homo sapiens
  misc_feature: GYAE6OF02GMIQX.48.67.G01.1.454.CMB.1.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagnggcctccctctcctgcagggccagtcagcatgttagcacctacttagcctggtaccaacaaaagcctaggccaggctcccagactcctcatctatgatgcgtctaccgagggccacgtcggccgtccccggcctaggttcagtcgccaggtgggtctgggacagacttcactcncaccatcagcagcctagacgcccgtaagtcttttaggacggtttattacgtgtacagctagtcgtcgccaacgtcggccttctccgtacggttcgggaccgggacgggacctaagggtcgacacgtacgaaacggtacgtggtaggcctagcctaccgtattccgttgttcctttcctccgtcccgtacg

SEQ ID NO: 123811 - DNA, 528 bp, Homo sapiens
  misc_feature: GYAE6OF02IOXN0.48.67.G01.1.454.CMB.1.raw
  modified_base (400)..(400): a, c, t, g, unknown or other
  misc_feature (400)..(400): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagccctccctctcctgcagggccagtcagcatgttagcacctacttagcctggtaccaacaaaagcctggccaggctcccagactcctcatctatgatgcgtctaccagggccacgtggccgtcccggcaggttcagtgccagtcgggtctgggacagacttcactctcaccatcagcagcctagacgcccgaagtnttttggcgtttattacgtgtcagcagcgtgccaacgtcggcctctccgacgttcggcggacggaccgaaggtcgacatacgaaacgtacgtgtcggctgaccactagtctcgtctactctccgtcccg

SEQ ID NO: 123812 - DNA, 593 bp, Homo sapiens
  misc_feature: GYAE6OF02GVXD3.48.67.G01.1.454.CMB.1.raw
  modified_base (427)..(427): a, c, t, g, unknown or other
  misc_feature (427)..(427): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccacgtggccgtcccggccaggttcagtcgccgagtgggtctgggacagacttcactctcaccatccagcagcctagacgcccgaagtattttgcggtttattacgtgtcagcngcgtgacctaacgtcggccctctcgtaccggttccgggacgggaacgggaacccgaaagggttggaacctaacgtaccgaaaaccggtacgttcggggtacgggtacctggacccttacccgagttccttacggttacctttacctaccgttccccgttacccccg

SEQ ID NO: 123813 - DNA, 549 bp, Homo sapiens
  misc_feature: GYAE6OF02I5GI0.48.67.G01.1.454.CMB.1.raw
  modified_base (295)..(295): a, c, t, g, unknown or other
  misc_feature (295)..(295): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctactagcctggtaccaacaaagcctggccaggcctccagactcctcatctangatgcgtctaccgaggccacgtggcgtcccggcaggttcagtcgcaggtgggtcgtgggacagtacttcactctcaccatcgagcagtccgtagaccgcccgtaagtattttggacggtttattacgtcgtcagcacggtcgtacgcctagtcggccttctccgtacgttcgggacggacgggacagggttacgactacacgaaacgtacgtggtcggctcgctaacgacttcgtactcttacacttcctcccg

SEQ ID NO: 123814 - DNA, 575 bp, Homo sapiens
  misc_feature: GYAE6OF02HIG29.48.67.G01.1.454.CMB.1.raw
  modified_base (238)..(238): a, c, t, g, unknown or other
  misc_feature (238)..(238): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctcctctcctgcagggccagtcagcatgttancacctacttagcctggtaccaacaaaagcctggccaggcctcccagacctcctcatctatgatgcgtctaccagggccacgtggccgtcccggccaggttcaggtgccaggtcgggtctgggacagacttcactctcacatcacgtcagcctagacgcccgaagtattttgacggtttattacgtgtctagcacgtcgtcgacctaacgtgtccctcgtctaccggttcgggacggacgggacctaagggtcgacgtactacgtaaacggacgttggtacggcttacggctaacccgtagttaccgttgttacccttacttacttcccgttaccccg

SEQ ID NO: 123815 - DNA, 567 bp, Homo sapiens
  misc_feature: GYAE6OF02GMN0J.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcactacttagcctgtaccaacaaagcctggccaggctcccagactcctcatctatgatgcgtctaccgagggccacgtcggccgtcccggccaggttccaggtcgccaggtgggtctggggacagacttcactctcaccatcagcagcctaaggacgcccgtaagtattttcggacgtttattacgtgtacgagcgtagcgtgccaacgtcggacctcgtctacggttcggacggagggacctagggtacgacacgtacaaaccggtacgtggtcggcctacgccaacctagttccttacgttacctttcctacttcccgttaccccg

SEQ ID NO: 123816 - DNA, 517 bp, Homo sapiens
  misc_feature: GYAE6OF02GA33T.48.67.G01.1.454.CMB.1.raw
  modified_base (397)..(397): a, c, t, g, unknown or other
  misc_feature (397)..(397): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaaagagcctccctctcctgcagggccagtcagcatgttagcacctacttagcctggtaccaacaaaagcctggccaggctccagactcctcatctatgatgcgtctaccagggccactggcgtcccggccaggttcagtgccagtgggtctgggacagacttcactctcaccatcagcagcctagacgcccgaagtnttttgcggtttattactgtacaccagtatggtagctcacctctaacgtttcggacggagggacctaagggtggagatacaaacgactggtggctgcacatctgtctcatcctcccgctac

SEQ ID NO: 123817 - DNA, 565 bp, Homo sapiens
  misc_feature: GYAE6OF02FSTTG.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccgagggccacgtggcgtcccggccaggttcagtcgccagtggtctgggacagacttcactctcaccatcagcagcctagacgacccgtaagtacttttcggacggtttaattacgtgtcgagcagccgtgacccaacgttcggccttcgtcgtaccggttcgggacgggtacgggaccaaggtcgaaccagtaccgaaacggtacgtggtaggctaggccaccgtatccgttagttccttacgtacttccttccccg

SEQ ID NO: 123818 - DNA, 624 bp, Homo sapiens
  misc_feature: GYAE6OF02FMBS8.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctccagactcctcatctatgatgcgtctaccagggccactggccgtcccggccaggttcagtcgccgaggtcgggtcgtgggacaggtacttcgactctcacatcagcagtccctagacgcccgaagttacttttcggtcggtttaattacgtgttaccagccagtccggtagaccctaacgtcggtcccttacgtcccgtacggttccgggacgggaacgggtaaccgaaggttacgggaacgtaactacggaaaaaccgtacgtgggtacggtaccgtaccggacccgtaacccgtagtttcccgttacggttaccctttactaccgtttcccgtttaacccccg

SEQ ID NO: 123819 - DNA, 576 bp, Homo sapiens
  misc_feature: GYAE6OF02HKRAJ.48.67.G01.1.454.CMB.1.raw
  modified_base (204)..(204): a, c, t, g, unknown or other
  misc_feature (204)..(204): n is a, c, g, or t
  modified_base (374)..(374): a, c, t, g, unknown or other
  misc_feature (374)..(374): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctggtaccaacaaagcctggccaggctcccagactcctcatctatgatgcgtctaccagggccacgtggccgtcccggccaggttcagtgccaggtgggtctgggacagacttcactctcacntcagcagcctagacgccgaagtacttttgacggtttattacgtgtcagcagtcgtacgccaacgtcggccctcgttccgtacggttcgggacgggtaacgggaaccgtaagggtcgaactagttaccgaaaacgtacgttggtcggtactacggacctaccgtacgtttccgtacgtttcctttacacgttcccttacccgg

SEQ ID NO: 123820 - DNA, 566 bp, Homo sapiens
  misc_feature: GYAE6OF02HCEI8.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccggagccaccctgtccttgtctccagggcaaagagcctccctctcctgcagggccagtcagcatgttagcacctacttagcctggtaccaacaaaagcctggccaggctcccagactcctcatctatgatgccgtctaccgagggccacgtcggccgtcccggcctaggttccagtcgccaggtgggtctgggacacgacttcactctcactatcagcagcctagacgcccgaagtatttgacggtttatacgtgtcagcagcgtcgacctaacgtcggacccttctccgtacgttcgggacggtacgggaccaaggtcgaactagtacaaacggtacgtggtacgtctcgaccgacctacgttcgttcgttactttccgacttcccttccccg

SEQ ID NO: 123821 - DNA, 523 bp, Homo sapiens
  misc_feature: GYAE6OF02GMGB8.48.67.G01.1.454.CMB.1.raw
  modified_base (438)..(438): a, c, t, g, unknown or other
  misc_feature (438)..(438): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtcgccagtgggtctgggacagacttcactctcaccatcagcagcctagacgcccgaagattttgcggtttattactgtcagcagcgtgccaactcgcctntcacggttcggcggagggaccaagggtgactagtacaaacgtactggtgcgtgccaccattccgtgttccttcacttccttcccg

SEQ ID NO: 123822 - DNA, 601 bp, Homo sapiens
  misc_feature: GYAE6OF02JDWHP.48.67.G01.1.454.CMB.1.raw
  modified_base (292)..(292): a, c, t, g, unknown or other
  misc_feature (292)..(292): n is a, c, g, or t
  modified_base (575)..(575): a, c, t, g, unknown or other
  misc_feature (575)..(575): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagccctccctctcctgcagggccagtcagcatgttagcacctacttagcctggtaccaacaaaagcctggccaggctcccagactcctnatctatgatgcgtctaccgagggccacgtcggccgtcccggcctaggttccaggtcgcctaggtcgggtcgtagggacagtacttcactctacaccatcaagcacgccgtaagacgacccgtaagtagttttcggacggttttattacgtgtacacgtctacggtcgtcaccgtaacgttcggacccttacgtcccgtacgggttccgggaccgggtaacggggtaacccgaggggttacgacctaacgtaccgaaacgtacgtggtacggcttgacctactntcgttcgtacttcaccttcctacccg

SEQ ID NO: 123823 - DNA, 555 bp, Homo sapiens
  misc_feature: GYAE6OF02FWPG7.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacaaagtctccagccaccctgtccttgtctccagggcaaagagcctccctctcctgcagggccagtcaacatgttagcacctacttagcctggtaccaacaaaagcctggccaggctcccagactcctcatctatgatgcgtctaccaggccactggccgtcccggcaggttcagtgccagtggtctgggacagctttcactctcaccatcagccagcctagacgcccgaagtacttttggcggtttattacgtgtcagtcagcgtcgccaactcggcctctcgacgttcgggcggtagggaccgtaagggtcgacagtaccgaaacgactggtacggctacggccaaccctagttccgtggttccttaccgtacgtcccttccccgacctac

SEQ ID NO: 123824 - DNA, 768 bp, Homo sapiens
  misc_feature: GYAE6OF02ID6AN.48.67.G01.1.454.CMB.1.raw
tcagagtatacatacacgaccggtgctcgatttagagtatacatatgggtttggggaggactgctcagttaggacccagagggaaccatggaacgcccagccagcttctcttcctcctgctactctggctcccagcagccaaccggagaaattagtgcttgacacagtctccagccaccctgtccttgtctccagggacaagacgcccttcctctcctgcacggtccagtccagactatcgtacgcaccttacttacgccttacggtacctaaacgaaaacgccgtacggaccaagggcctcccggaacgaccgttcctaccaagttcctatacgtacgtacgtccgtaccgttaccggaccggacctacggtccggacccggttcccggactacggttccgaagtcgtaccgtaggtcgggtcgtacggggactagggtaccttacgaccgtactaccctaaccgtacgttacaacgtacctacgtaacccgttaaggacccgaaccggttaaagttacggtttttacggaccgggtttttaagtaaccgttacgttaccgtaacggtacgttacggtacgttacgacccgttaaacgtcggtacccttacggttaccgtaccggggttacggtaccgggaaccgggttaaccgtacgggtaccggtaacgtaccgttaacggaaaccggtacgtacggttaacggacgttaacgtaccgtaacgttacgttaccgttacgttacctcgtaccgtttccgttacccg

SEQ ID NO: 123825 - DNA, 729 bp, Homo sapiens
  misc_feature: GYAE6OF02HSYKV.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagcccaccctgtccttgtctccagggcaaaggacgccctccctctcctgcgagggccagtcagcatgtagcaccttacttacgcctaggtaaccaaacaaaagccctggccaggcctcccagacctcctcacttctatgtactcgtcgtaccgtaccgacgggccctaaccggttcgggcccggttccccgggaccgtacgggtttcacggtcgccgtagggtcggggtacgtaggggactacgtaccgttacaccgtcctaccaacctacgtcacgaccgacgtcccgtaaggaccgtacccggtaagtttacgttttacgggtacggttttaactaccgttcgtaccgtacgtacgtacgtccgtacgtacccgaacgttcggtacccttcgtacccgtaccgggttccggggaccggggtaacgggaacccgtaaagggtccgaacgtaccgtaaccggtaaaccggtacggttcgggtacggtacctccggtaaccctaaccgtcgtttacccgttacggtttcccttactacccgtttcccgttacccccg

SEQ ID NO: 123826 - DNA, 504 bp, Homo sapiens
  misc_feature: GYAE6OF02IISHF.48.67.G01.1.454.CMB.1.raw
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctattagcctggtaccaacaaagcctggccaggctcccagactctcatctatgatgcgtctaccaggccactggcgtcccggcaggttcagtgccagtgggtctgggacagacttcactatcacatcagcagctagcgcccgaagtntttgcgtttatactgtcagcngctgccaactggcctntcgacgttcggcggagggaccaggtcgacatacgaaacgacgtggtacgctagccacgatctgtcttctcctcccgac

SEQ ID NO: 123827 - DNA, 667 bp, Homo sapiens
  misc_feature: GYAE6OF02HQY0Z.48.67.G01.1.454.CMB.1.raw
  modified_base (204)..(204): a, c, t, g, unknown or other
  misc_feature (204)..(204): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngccctccctctcctgcagggccagtcagcatgttacgctacctactagcctaggtaccaaacaaaagcctggccaggcctcccagacctcctcatctatgatgcgtactaccgagggccacgtcggccgtcccggccgtaggttcaggtcgacccgtaggtcggggtcgtggggactacggtactttccgacttcctaccacctatccgacgaccgtacgcccgttaaggaccgtaccccggtaaagttacgtttttcgggtaaccggttttattaaccgttgttaccgaggtccgaggtccgttacgaccctaacgtcggccctttcctaccggtacggttccggggaccggggaacgggtacccggaaggtaccgggaacacgtaaccgaaacgtaccggtggtacggacgttgaccctacgtacgttcgtcgttaccttacctacgttccccgttacccg

SEQ ID NO: 123828 - DNA, 567 bp, Homo sapiens
  misc_feature: GYAE6OF02FU7KV.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccacgtggcgtcccggctaggttcagtgccaggtgggtctgggacagacttcactctcaccatcagcagcctagacgcccgaagtatttgcggtttataccgtgtccagcagtcgtcgaccaacgtcggcccttcgtccgtacggtttccgggcgggtaacgggaaccaagggtacggacacgttacgaaaacgtacgtggtacggcctcgaccacctacgtcgttacgttccttactacttcccgttaccccg

SEQ ID NO: 123829 - DNA, 602 bp, Homo sapiens
  misc_feature: GYAE6OF02I390K.48.67.G01.1.454.CMB.1.raw
  modified_base (238)..(238): a, c, t, g, unknown or other
  misc_feature (238)..(238): n is a, c, g, or t
  modified_base (390)..(390): a, c, t, g, unknown or other
  misc_feature (390)..(390): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagcgccctcctctcctgcagggccagtcagcatgtancacctattagcctggtaccaacaaaagcctggaccaggcctcccagacctcctacatctatcgatcgcgttctaccgaggcctacgtcggccgtcccggcacggttcagtcgccgagtcgggtctgggactagtacttcgactcgtcacctntcagcacgcctaagacgacccgtaagtcgttttcggacggtttacttacgtgttacgacgtcacggtccgtacgaccctaacggttcggacccttccgtaccgtaccgggttcggaccgggtacgggtaaccctaaggggtcacgtaataccgaaacggtacgtggtacgctacgacctaacgtctcgttcgtacctcaccgttcctacccg

SEQ ID NO: 123830 - DNA, 708 bp, Homo sapiens
  misc_feature: GYAE6OF02HLFVE.48.67.G01.1.454.CMB.1.raw
tcagagtatacatacacgaccggtgctcgatttagagtatacatattggggtttggggggaggaactgctcagttaggacccagagggaaccatggaagccccagcccagcttctcttcctcctgctactctggctcccagcagccaccggagaaattgtgctgacacagtctccagcccaccctgtccttgtctccgagggacaaaggacgtcctccctacgtcctgcgagggccagtcagcagttgtacgctactacttagcctagtaaccaaacaaagcctggacctaggcctaccccgagtacctcctacacttactaacgtgtactcggaccgtacctaaccgacggggaccctacggtccgggtacccgtaccccgggaccgttaagggttcaacggtcgaccgtaggggttcgggtcgtaggggaactacgtaccgttactaaccgttcctaacaacctataccgacgtcaacgtacctaggaaccgtacccggtaagtttacgtttcggtacggtttaactacgttgtactacgtacgagtccggtactccgtaacgttccggacctcgttacgaccggttcgggacggtaccggaacgtaagggtcgaacaacgtaccggaaacgtacgttaggtcgaccgtacggacccttaagtacgttccgttacgttccgtttaactcccgttacccgttacccg

SEQ ID NO: 123831 - DNA, 620 bp, Homo sapiens
  misc_feature: GYAE6OF02HNLZD.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagacgccctccctctcctgcagggccagtcagcatgtagcacctacttagcctggtaaccaaacaaaagcctggaccaggcctcccagacctcctcatctatgatcgcgtctaccgaggccacgtcggccgtcccggccgtaggttcagtcgccgtaggtcgggtcgtgggactagtacttcactctcacctatcagcagcctagacgccgtaagttgtttgtacggtttatacgtgtacagcagtcgtcgacccaacgtcggtcccttcgtaccgtaccggttcgggaccgggtaacgggaacccgtaagggtcggaactacgtaccgaaaacggtaccggttgggtaccggtaccgttacggaccctaaccgtcgttaccgttcggttacctttaccgtactttccccgttaccccg

SEQ ID NO: 123832 - DNA, 669 bp, Homo sapiens
  misc_feature: GYAE6OF02HEOGZ.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtacaacaaagcctggccaggcctccagacctcctcatctatgatgcgtctaccgaggccacgtcggccgtcccggcgtaggttcaggtcgccgtagggtcgggtcgtagggacacgtacttacaccttactaccaacctacgtccgaacgaccgaacggtccccttaagggacccgtaaccccggtaaaggtttacgtttttccggtaccgggtttttaatttaccgtggtacctacggcgtacggtccggacgtacccaacgttcgggcccttacgtccgtacgggttccgggacgggtaacggtaaccgtaagggtacgaactaacggtacgaaaccggtacgttcgggacggtcctacggaccctaactacgttccttacgttaccgtttctaccgttccccgttacccgg

SEQ ID NO: 123833 - DNA, 649 bp, Homo sapiens
  misc_feature: GYAE6OF02JIFGQ.48.67.G01.1.454.CMB.1.raw
  modified_base (159)..(159): a, c, t, g, unknown or other
  misc_feature (159)..(159): n is a, c, g, or t
tcagagtatacatacacgaccggtgctcgatttagagtatacatattgggtttgggggtaggaactgctcagttaggacccagagggaaccatggaagccccagcccagcttctcttcctcctgctactctggctcccagcagccaccggagaaattgngctgacacagtctccagccaccctgtccttgtcctccgagggccaaaggagccctccctctcctgccgagggccctaggtcaacgcgtatgttacgccacccttagttacgccgtagtaacccaaacgaaaacgccgtacggaccgacggcctacccgacgaacctcctctaactcctagtcgatcgcgtacctacgacgggacccacgtcggccgtcccgccgtggttacagtcgccgtaggtcggtcgtggacaggtaccttcgacctacgccgaacctatcgacgccacgcccttaaggaccgtacccggtaaagttacgtttcggtacggtttaagttaccgtagtccgtagtccacggtcgtacgacccgtacgtcgtcccgtactccgaacggttccggacgggtacggacgacggtagactacgacgaacgtacgtcggtagtcgaagccgtacacgttctacggttctacgtctcccgttcc

SEQ ID NO: 123834 - DNA, 662 bp, Homo sapiens
  misc_feature: GYAE6OF02FV2M6.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtcctccagccaccctgtccttgtctccagggcaaagacgcctccctctcctgcacgggccagtcagcatgttagcctacctacttagcctggtaccaacaaaagcctggccaggcctcccagactcctcactctatgatcgcgtcctaccgaggcccacgtcgggccgtcccggacgtaggttcagtcgccagggtcgggtcgagggacagtaccttcactcctaccgacctacgtaccagcctacgcccgtaacggaccgacccggtaaagtttcttttcggtaccggttttaataccgttcgtacgacgcgtggccgttacgaccgtaacggttccgtaccctccgtacgttaccggttaccggggcgggaacgggtaacccgtagggtacgaaccgtattaaccgaaaccggtacgttgggtcgggtacctacgacccgttaaccgacgtttccgttccgtcctttacccgtaccgttccccgttccccgg

SEQ ID NO: 123835 - DNA, 603 bp, Homo sapiens
  misc_feature: GYAE6OF02GID1M.48.67.G01.1.454.CMB.1.raw
  modified_base (209)..(209): a, c, t, g, unknown or other
  misc_feature (209)..(209): n is a, c, g, or t
  modified_base (378)..(378): a, c, t, g, unknown or other
  misc_feature (378)..(378): n is a, c, g, or t
tcagagtatacatacacgaccggtgctcgatttagagtatacatattgggtttgggggaggaactgctcagttaggacccagagggaaccatggaagccccgagcccagcttctcttcctcctgctactctggctcccagcaggccacccggagaaattcgtgctgacacagtctccagccaccctgtccttgtctccgagggcaaagngcctcctctcctgcagggccagtcagcatgtagcactacttagcctggacaacaaagcctggccaggctcccagactctcatctatgatgcgtctaccagggccactggcgtcccggcaggttcagtcgccagtcgggtctggggacagacttcactctcaccatcgancgacgcctaggaccgaccgtaagttcgtttcggtacggtttatacgtgtcgagtacgcgttacgtcgaccgtaacgtcggtcctcctcggtaccgggttcgggaccgggtaacgggaaccggaggacgggtaccaacgaccgtaaacggtaccggtaggttccggaccgttaccgaccgtacctaggttcccgttgttacctttacctacgtttcccctacccgg

SEQ ID NO: 123836 - DNA, 604 bp, Homo sapiens
  misc_feature: GYAE6OF02HX8NP.48.67.G01.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
tcagagtatacatacacgaccggtgctcgatttagagtatacatattgggtttgggggaggaactgctcagttaggacccagagggaaccatggaaaccccagcgcagcttctcttcctcctgctactctggctcccagacaccaccggagaaattgtgttgacgcagtctccaggcaccctgtctttgtctccaggggaaancgccaccctctcctgtagggccagtcagaatgttaagagccactccttagcctggtaccagacaaaaacctggccagcctcccaggctcctcatctatggtgcgtcccacaggggccactggcatcccagacaggttcagtggcaggtggtctgggacnggacttcactctcgaccatccaccagactggacncctgatgtaattttcgactagttgttttcgtgttacagctaaggttattagggtaactttcgaacccgttcggaacctacgtttaccgggaccgtaagggggtaaccctaaaggggtcggaaaacgtccgaaaacggtacctgggtacggcgtaacgacctaccgtagtaccttgtacttccgattcccttacccggcctacgttacg

SEQ ID NO: 123837 - DNA, 762 bp, Homo sapiens
  misc_feature: GYAE6OF02F41NL.48.67.G01.1.454.CMB.1.raw
  modified_base (243)..(243): a, c, t, g, unknown or other
  misc_feature (243)..(243): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagcgcctccctctccgtgcgacggccagtcagctagtgttanacctaccttacgttcgccgtacgtaacccaaaacgaaacgtccgtaggaccgacggcctaccccgagtacctcctactacttcttaacgtgtacgtcgtaccgttaccgaaccggacgggtccctacggtcgggcccggtccccggacgtacggttcaaggtccgcgtagggttcgggtacgtcggggaactacggtaccttcgtaccttccgtacctaaccgtactaccggagacgaaccgtccggtaagaacccggtaccgtaaagttttcggtttacggttacggtttttaactaccgttggtaccgaacgtcggacggttaccgtaccgaacccgttaacggtcccgttcctacccggttacgtacccgggggtttccgggacgggtaaccgggtaaacgtaaacggggttcgtaacaacggttaaccgaaaaccggttaggttcgggacgtacctaccggaccctaacggttcgttcgttaccgttcctaccgttaccgttccccgttaccccg

SEQ ID NO: 123838 - DNA, 869 bp, Homo sapiens
  misc_feature: GYAE6OF02JKTU7.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgaccacagtcctaccagccaccctgtccttgtcctccgaggcaaagcgcccttcctctcctgcgacggcctagtcgacgcgagttcggtacacctaccttacgtacgtccgtacggtaaccaaacgtaaacgtccgtacggaccgacggccctacccgaagacccgttacccgacctaacttacccgttaagtacgacgttaccggtacccgttaccgttaacccggaccgggtacccgtacggtaccgggtaccccggttaccccggaccgttaaacgggtttcccgaacggttaccggtcccggtaaagggggttccggggtttaccgggtaaggggtaccctaaacgggttaccccgtttaccgtaacccgttacccgttaacccgaaacccgtcccgttaacggaaccgtacccggtaaccgttacccggtaacggtaccgggtaaacccccggttaaaggtttaccgtttttacgggtaccgttttaacgtttaccggttacggttaccgaacgggttacgtaaccggtcggttaccgaccgttaacccggtccggttaccttacccgtcggttaccgggtccggaaccgggtacgggaaccgtaacggtacgaccgtaactacgtaaaccgtacggttagggtccgacgtaaccgtaccgtaacctcgttacgtaccgttctaccgtccttaccccgttccg

SEQ ID NO: 123839 - DNA, 773 bp, Homo sapiens
  misc_feature: GYAE6OF02JK1TF.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtcctccagggcaaagacgcctcctctcctgcagggccagtcagcatgttagcctacctattacgcctaggtaaccaaacaaacgcctaggaccacggtcctaccccgagtaccttcctacaacttcctagtcggtactcggcgttcctaaccgacggggccctacggtcgggtcccgtcccgggactacggttcacggttcgaccgtagggttcggtcgtacgggacgtaagtacttcgaacttcgtaccactataccgacgcgtaaccgtccgttaaggaccggtaaccccggtaagttaccggttttttacggtaccgggtttttaattaaccgttcggttacctaagggtaccttacgggacccgtttacggaaccccgtttaacggttcgggtaccccttacggttaccgggtaaacccgggttttccggggaacccgggggtaaacggggtaaccccgtaaaggggtacgtaaccgtaaggttaaacccgaaacgggttaccgttggtaccggtcgtaacgacccggtaactaccggtttactccgttacccgtttacctaccgtttccccgtacccgg

SEQ ID NO: 123840 - DNA, 836 bp, Homo sapiens
  misc_feature: GYAE6OF02JGCBL.48.67.G01.1.454.CMB.1.raw
  modified_base (260)..(260): a, c, t, g, unknown or other
  misc_feature (260)..(260): n is a, c, g, or t
  modified_base (620)..(620): a, c, t, g, unknown or other
  misc_feature (620)..(620): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggcctcccagcagccaccggagaattgtgctgacacgagtctccagcctaccctgtccttgtcctccgagggtacaaacgacgtcccttccctctacctcgacgacgggccagttcagctattggttacncctaccgttacgttagcctaggtaaccaaacgaaaacgtcccgttcggaccgtaacgggtccctaaccccgtacggtaacccttacccgttctaacgtttacgttaacttagtaacggtcggtacccgttactaccggaacgggtaccctacggttccgggacccgttcccgggaccgtttaacgggttcctaaacggttcgtaccccgttaagggttcgggtaccgttacggggaacctaggtaaccgtttacccactttccgtaacccgtaaccgtacgttccgaacggtacctaacgggtaaccccgttaaggaccccgtaaccggttaagtttacgttttcggtaaccgttttaanacgttacgtacgcgtaccgtacggtcgttaccgacctagggttccgaccgtttaccgccggttaacggtttaccggggacgtaaccggggttaccaacgggttacgtaacctacggttaactaaccgggcgtttcggtcccggtaataccggtaccctaacggttaacgttccggttaccgttacccgtttaccgtaccgtttcccggtaaccccg

SEQ ID NO: 123841 - DNA, 633 bp, Homo sapiens
  misc_feature: GYAE6OF02HF6C0.48.67.G01.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (548)..(548): a, c, t, g, unknown or other
  misc_feature (548)..(548): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctcagccacctgtccttgtctccagggcaaaagngcctccctctcctgcagggccagtcagcatgtancactactagcctggtaccaacaaaagcctggccaggctacccgagacctcctcatctatgatcgccgtactaccgacgggccaacgtcggccgtcccggacctaggttccagtcgccgtaggtcggggtctgggtacagtacttacactctaccaccgatacgagccacgaccgtaggtaccgacccgtaagtacgttttcgtacggttttaataccgttgtcaacgtcgaagtccgtacgaccgaacgtcggccttaccggtaccgtacggtttcgggacgggaaccgggtaccgtaaaggtccggtaanacgtaaccgaaacgtaacgtggtagggccttacggaccgtaccgtacttccgttacggttactacccgtacgttcccgtaccccg

SEQ ID NO: 123842 - DNA, 694 bp, Homo sapiens
  misc_feature: GYAE6OF02IEZ75.48.67.G01.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagcccaccctgttccttgtcctcgagggcaaagcgccctcctctccngcgaggcagtcancattgtanctacctattacgcctaggtaccaaacaaagcctaggccaggccnccagacctcctactatactactgatcggtactaccgtacgacggccacgtcggcccgtcccggccgtacggttcagtccggaccgtggtacggggtcgtacgggactacggtaccttacgtacctcctcccaaccgactcgacgtaccgtacgccgtaaaggacccgtaccggtaagttacgtttttcggtaccggttttattaaccgtgttacgacgtcgtaacggtccgtacgacctaacgttcggcccctttacgtccggtaaccgggttcggaccggggtaacggtaaccgggtaaagggtcgtaaacccaagttaccgtaacggtacgtaaccggttggtaccggtccgtacgtacccgaacgttacgttaccgttacggttccgtttacctacgttacccccg

SEQ ID NO: 123843 - DNA, 612 bp, Homo sapiens
  misc_feature: GYAE6OF02GCL85.48.67.G01.1.454.CMB.1.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
  modified_base (569)..(569): a, c, t, g, unknown or other
  misc_feature (569)..(569): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagngcctccctctcctgcagggccagtcagcatgttagcacctacttagcctaggtaccaacaaaagcctggccagggcctccccagacctcctcactctaatgatcgtcgtcctaccgacgggccacgtcggccgtccccggcctaggttcagtcgccnggtcgggtcgtggacagacttcactcctacacatcagtccagacctagacgcccggaaagttctttaggtaccgtttattactgtacctagccgagcgttcgacccgaacgttcgggtcccttcgtaccgtacggtttcggggacgggaacccggggtacaaaggggtcgaaccaacgtacgaaaacggtacgttgggaggtaccgtnacccgtacctagtctacggttctaccgtactccgttaccccgg

SEQ ID NO: 123844 - DNA, 827 bp, Homo sapiens
  misc_feature: GYAE6OF02GKPVD.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctgctcccagcagccaccggagaaattgtgctgacacagtctccagccaccctgtccttgtcctccgagggacaaagacgcccttccctcctacctcgcacgggccagtcacgctagttgttacgcctaaccttacttacgccgttacggtaacccaaactaaaaccggtccgttcggacccgaacgggtccctaccccgaacggtacccttacccttactactaccgttaagttacggtaacttcggtacccgttaccgtaacccggaccggggacccctaccggttaccgggtaccccgggttacccccggtaccggttaaccggggttttaccgaccgggttaccggaaccccggttaggggttaccgggggttaccggttaccgggggtaaccgtaaacgggttaccctttaccgaaccgtttacccgttacccgtaaccctaaccggtttacccgaacggtaaccgtaaccggtacccgtaaacggtacccgggtaaccccgttaaaggttttcggttttacggttaccggttttacttacgttcggtaacctacgcgtacgcgtaacgccgtacgtccgtctacgtaccgtacgggtcggacgggacgtacgtaggacgactacgtacgtaacgtacgtcgtcggtcctacgtaccgactcggttcctaccgttctccgtaccttccgtaccc

SEQ ID NO: 123845 - DNA, 706 bp, Homo sapiens
  misc_feature: GYAE6OF02IZKUJ.48.67.G01.1.454.CMB.1.raw
  modified_base (241)..(241): a, c, t, g, unknown or other
  misc_feature (241)..(241): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctccagcagccacggagaaattgtgctgacacagtctccagccaccctgtccttgtctccgagggcaaagcgcctccctctcctgcacgggccagtcagctatcgttancctactacttagcctagtaaccaactaaagcccgtaggcccagggcctcccacgaccttcctcgtattccgtaatgacgttggccgttactaccggacggccaacgttcgggcccggttcccggctacggtcctacggtcggcccttagggtcgggtaccgtcggggactacggactttccgacttacccgtacgacttacgcgtaacggcgtaccgtaccggtttaaggaccctaaccgggttaaacgttcgtttttaccgggtacgttttacctttacggtaccgttacggaacgtccggtacggtcgttacccggtacggtaaaccgtccgggtacccttacgccgttaaccgggtccgggacgacgggtaaccgagggttaaccgactaacgttaccaaaccggtatcgggagtccgatacccgcttaacgtcgttaccgtactcttaccgttcctacccg

SEQ ID NO: 123846 - DNA, 646 bp, Homo sapiens
  misc_feature: GYAE6OF02G7U9V.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagcgcctccctctcctgcagggccagtcagcatgtagcacctactacgcctgtaccaacaaacgcctaggccacggcctacccagacctcctcatctatgatgccgtctaccgacgggccacgtcggccgtcccggcgtacggttcacggtcgccgtaggttcggggtcgtaggggacgtacggtactttaccaccgttcctaccgtaacccagtccgagccacggtaccctaacgggaccgaccccggtaaagtttacgtttttacggtaccggttttaacttaccgttggttaccgtagtacgtacggtccgtcgaaccctacgtcggtacctccgttacgtacggttccgggacgggtaccgggaccgtaagggtcgactacgtacaaacggtacgtcggtgctcgcctacgtctcgttcgtccttctaccgttccctcccg

SEQ ID NO: 123847 - DNA, 714 bp, Homo sapiens
  misc_feature: GYAE6OF02FIDHY.48.67.G01.1.454.CMB.1.raw
  modified_base (203)..(203): a, c, t, g, unknown or other
  misc_feature (203)..(203): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgctccagggcaaagngcctccctctcctgcagggccagtcagcatgttagctacctacttagcctaggtaccaacaaagcctcggccagctcccagactcctcatcctatgatgtcgttctacccgagggccacgtcggccgttccccggcgtacggtttccacggtcgaccgtacggttcggggtacctacgggggtaacctacggtaaccctttcgacccttaccgtaccgaaccctaacgttaccgaacggttacccgacggtaccgtaaacgaccgggtacccccgaaagggttactttttacgggtacgggttttaactttaccgtggttaccgtacgacgtacggtcgtacgacccgtaaacggttcggaccccttcgtacccgtaccgggtttccgggaccgggtaacgggtaacccgtagggtaccgaacgttaacgtacgaaaccgtaacggtggtacggcctacgaccgtaacccgtattccgttcgttacgttacctccgtttcccgtacccccg

SEQ ID NO: 123848 - DNA, 601 bp, Homo sapiens
  misc_feature: GYAE6OF02IYTXY.48.67.G01.1.454.CMB.1.raw
  modified_base (284)..(284): a, c, t, g, unknown or other
  misc_feature (284)..(284): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
  modified_base (521)..(521): a, c, t, g, unknown or other
  misc_feature (521)..(521): n is a, c, g, or t
  modified_base (543)..(543): a, c, t, g, unknown or other
  misc_feature (543)..(543): n is a, c, g, or t
  modified_base (582)..(582): a, c, t, g, unknown or other
  misc_feature (582)..(582): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagccctccctctccctgccacgggccagtcagtcatgtacgcacctactagccttaggaccaacaaagcctgaccaggccnccagacctcctcactctatcgctgacctctaaccgcggcctacgtggccgtcccggcgtacggttcacggtcnccgaggtcggtcgtcggacncgtactcgacttccacgacctagtcgaagccacgtaccgtacggaacgtaccggtacgttaaggttttacgcgttttaactacgtcgtacgtagtgacgtccgtanaccacgttcgacccttntaccgtacgtcgggaaccggnggacccgtaaggtaccgacgtntaccgaacgtacgtggacgtctacgactactagtcgttntcgtactactcccgttacg

SEQ ID NO: 123849 - DNA, 674 bp, Homo sapiens
  misc_feature: GYAE6OF02IXSU3.48.67.G01.1.454.CMB.1.raw
  modified_base (307)..(307): a, c, t, g, unknown or other
  misc_feature (307)..(307): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgagggcaaagcgcctccctctcctgcacgggccagtcagcatgttagctacctactacgcctggtaaccaaacaaacgcctggaccacggcctacccagcctcctcactctangtatcgccgtacaccgacgggcctacgtcggccgtcccggcgtacggttcacggtcgccgtagggtcgggtcgtagggactacgtacttccactcctaccaccagtacacgacacgtccgtaacggaccggtaacccgtaagtttacgttttacggtaccggttttaattacgtcgtacgtagcgtacggtccgttacgaccgtaacgtcggtccttaccggtaccggtaccgggttccgggaacgggtaacgggtaccggtaaaggcgtaacctaagtaaccgaacggtacggttcgggtcggtaccgtacgaacccgtacgttacgttccgttacgttacctacgttaccgttccccgttacccg

SEQ ID NO: 123850 - DNA, 732 bp, Homo sapiens
  misc_feature: GYAE6OF02F675B.48.67.G01.1.454.CMB.1.raw
  modified_base (678)..(678): a, c, t, g, unknown or other
  misc_feature (678)..(678): n is a, c, g, or t
tcagagtatacatacacgaccggtgctcgatttagagtatacatattgggtttggggaggaactgctcagttaggaccagagggaaccatggaagcccagccagcttctcttacctctgctactcgtggctccagcagccacgagaaattgtgctgacacagtctcagccacctgtcttgtctcgagggtcaaagcgtcctccgtctacgtgcgtacggcctagtcacgcaattggtaacgcgtaaccgtacgttacgtcccgttacggtaaccaaacgaaaacgtccgtacggaccgaggcctaccccaggtaaccttcccgtacacttaccgtaagtacggtacttcgggtccgttaccgtaaccggacgggtacctaaacggtcgggtcccgttaccccggaccgtacggttcctaacggtccggacgtacggggtacggttccgttaacggggaactaacggtaaccttcgaaacttccgtacaccctaagttccgaaggtaccgtacgaccgtaggaaccgtacccgtaaagtacgttttaggaacgttttattacgtcgtcaagcgtacgtcgtacgaccgtaaccgtcggtcctacgtcgaccggttacggcgggtaaacggacgtaagggtacgaactagtaacgaaagtaccggttaaggcgttaccgnggtaacctaccggtaacgttcggtccgtttacgtcccgttacctcccgtaaccg

SEQ ID NO: 123851 - DNA, 678 bp, Homo sapiens
  misc_feature: GYAE6OF02I4Q5F.48.67.G01.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (333)..(333): a, c, t, g, unknown or other
  misc_feature (333)..(333): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccaggggcaaaagngccctccctctcctgcacgggtccaggtcancatggtancctacctacttagccttacggaccaaacgaaaaagcctacggccacggctcccagactcctcatctatgatggcgtactacgaggccncgtcgcgtccgcacggtcagtgccaggtcgggtctgggacacgtactttacgacttcgacctacgactcgtaagcgacgtaacctaacggacgaccccggtaaagttacgttttcggtacggttttaactacgttcgtacgactacgacggtccgtacgtacccgaacgttgggtaccccttacgttccggtaacccggttcggggaacgggaccggggttaaaccaagggggttccgaaacgtacttaacgtaaaacccggtaacgttgggttaccggaccgtacggacctaaccgtaaccgttcgttaacggttcctttaaccgtaccttacccgttaccccg

SEQ ID NO: 123852 - DNA, 728 bp, Homo sapiens
  misc_feature: GYAE6OF02JJ4ZO.48.67.G01.1.454.CMB.1.raw
  modified_base (69)..(69): a, c, t, g, unknown or other
  misc_feature (69)..(69): n is a, c, g, or t
  modified_base (123)..(123): a, c, t, g, unknown or other
  misc_feature (123)..(123): n is a, c, g, or t
  modified_base (142)..(142): a, c, t, g, unknown or other
  misc_feature (142)..(142): n is a, c, g, or t
  modified_base (159)..(159): a, c, t, g, unknown or other
  misc_feature (159)..(159): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (466)..(466): a, c, t, g, unknown or other
  misc_feature (466)..(466): n is a, c, g, or t
  modified_base (714)..(714): a, c, t, g, unknown or other
  misc_feature (714)..(714): n is a, c, g, or t
tcagagtatacatacacgaccggtgctcgatttagagtatacatattgggtttgggggaggaactgctnagttaggacccagagggaaccatggaagccccagcccagcttctcttcctcctnctactctggctcccagcanccaccggagtaaattgngctgacacagtctccagcccacctgtaccttgtctccgagggcaaaagcncccttcctcnccgtgccagggcctagcagtccagtgtacgccaacttacgtagcctggtaaccacgaaactcgtacgggccaggtcctacccacgacctcctactcttacacgtacgactcggacgtccttaaccggacgggttacccacggtcgggtcccggtaccccggtccgtaacggtttaccagggtccgtacggcggttgggttccaggggaacctggaaccttcgaacttccgtaccacttcgtaccganacccgtagcccgtaagacggtaaccccgaaggtttcttttacggacgtttaacgttactcggttaaccaggtcctaacggtccgttaaccgaccgttacgtcggcccttacctacggtcgggttacccgggaacgggccggtaaaccggtaacgggtccgtaacctcgttaacgtaaacccggcgtttaacgggtccggtaacgcccgtacgaacccgttcgtaacggtttccttcgtaacccgttanaccccgtttaaccg

SEQ ID NO: 123853 - DNA, 684 bp, Homo sapiens
  misc_feature: GYAE6OF02H1KV4.48.67.G01.1.454.CMB.1.raw
  modified_base (241)..(241): a, c, t, g, unknown or other
  misc_feature (241)..(241): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccacggagaattgtgctgacacagtctccagcccaccctgtccttgtcctccgagggcaaagagccctccctctcctgccagggccagtcagcatgtancacctattgctggtaaccaacaaacgcctgccagtcctcccgagactcctcatcctatgatcgtcgtcctaccgaggcctagttcggccggtcccgcgcgttcgacgttcgacccgtggtcgggtcgtagggctagtacttcgtactccgttccaaccgtactccgaacgtcgacgtacccggacggtaccgtaccccggtaagtttacggtttttccggtaacggtttttacgtaccggtttgtaacgtaccgttacgacgtccggttctaacccgaacgttccgggtaccttccggtaccgtacggggtttacccgggacggggtaaccgggcccggtaaagggtaccgacgttaacgtaccgtaaaccggtaaccggtcggtcggaccggtcgacccgtacgttcgttacgttccgttactttctaccgttccctacccg

SEQ ID NO: 123854 - DNA, 685 bp, Homo sapiens
  misc_feature: GYAE6OF02IZ3GX.48.67.G01.1.454.CMB.1.raw
  modified_base (294)..(294): a, c, t, g, unknown or other
  misc_feature (294)..(294): n is a, c, g, or t
  modified_base (650)..(650): a, c, t, g, unknown or other
  misc_feature (650)..(650): n is a, c, g, or t
tcagagtatacatacacgaccggtgctcgatttagagtatacatattgggtttgggggaggaactgctcagttaggacccagagggaaccatggaagccccagccccagcttctcttcctcctgctactctggctcccagcagccaccggagaaattgtgctgacacagtctccagcccaccctgtccttgtcctccagggcaaaagacgccctccctctcctgcgagggccagtcagcatgttagcacctactgcctgtaaccaacaaaagcctgccaggctcccagactccnatctatgatgccgtctaccagggccactcggccgtcccggacctaggtttcagtcgaccgtacggtgggtctaggggacacggtactttcaccttctaccaacctaacgttacgaacgccgtaacgacccgttaacggaacggaccccgtaaagggtttacgtttttacggttacgggttttaacctttacgtcgttaccgaagtccgtaaaggtccgtacggtacccaaaccgttcggtaccccttacgttcccgaaccggggttttcgggaccgggttaaccgggaccggtaaagggtcggaactacgacgtaaaccgtaacggttcggtacggttacctacgaccttaaccgnttaccgtttccgtacttctactttacccgttaccg

SEQ ID NO: 123855 - DNA, 652 bp, Homo sapiens
  misc_feature: GYAE6OF02JNJ7V.48.67.G01.1.454.CMB.1.raw
  modified_base (152)..(152): a, c, t, g, unknown or other
  misc_feature (152)..(152): n is a, c, g, or t
  modified_base (267)..(267): a, c, t, g, unknown or other
  misc_feature (267)..(267): n is a, c, g, or t
tcagagtatacatacacgaccggtgctcgatttagagtatacatattgggtttgggggaggaactgctctagttaggacccagagggaaccatggaagccccagcccagcttctcttcctcctgctactctggctcccagcagcccacgganaattgtgctgacacagtctcagccacctgtccttgtcctccaggacaaacgcgccctccctctccgtgcgagggcccaggtcagcagttgtagccacctactgcctagtaccaanaaacgtcgtcggccgacggcctcccgagtacctccgtacacttctagtagtactcggtccgtctaccgacggtcccagtcggtccgtaccgccgtaggtcgtacgtcgtcgtaggtcggttcgtacgggactacgtcttacgtacgtcgtacccgaacgtcgtaccgagtaccgtacggtccgtacgaccgtacccggtagttacgtttcgtacggtttactaccgtcgtccttacgaccgtacggtccgtacgtaccgaccgtcgacccgttcgtccggtacggtaccgggcggtagacccgtaggtcgacttacgtacgtaacgtcgttagtccggactccgaccgtactccgttgtccttacggtacctacgtcccgtaccg

SEQ ID NO: 123856 - DNA, 791 bp, Homo sapiens
  misc_feature: GYAE6OF02HSSQV.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaattgtgctgacacagtctccagccaccctgtccttgtctccagggcaaagacgccctccctctcctgccgagggccacgtcagcattgttacgccaccttacttacgcccttacggtaacccaaacgaaaacgccgtaggaccacggccctccccgaagtacccttccctacacttacctaagtgactggtacccgtccgtaaccgacggggtaccccacggttccgggtccccgtccccggggacctaggttaccgacggtccggaccgtagggttcgggtaccgtaggggacctaacgtacctttccgaccttcccgtcaaacccgtactaccgacgaccgtacgacccgtaaggacccggtacccgtaaaggttttagtttttccgggttaaccggtttaatttaccgttacggtacctacggtaccgtacggtcccgttaacgacccctaacgggttcccggtaccctttacccgtacggtacccggggtttccggggaaccggggaacggttaacccgaaacggggttccgaacgtaaccggtaccgtaaaacgggtccgttaggaccggttccacggtaccgttacccagtttcccgtactttccctacgtacccgttccccgtttaaccccg

SEQ ID NO: 123857 - DNA, 682 bp, Homo sapiens
  misc_feature: GYAE6OF02G9IN3.48.67.G01.1.454.CMB.1.raw
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (650)..(650): a, c, t, g, unknown or other
  misc_feature (650)..(650): n is a, c, g, or t
  modified_base (660)..(660): a, c, t, g, unknown or other
  misc_feature (660)..(660): n is a, c, g, or t
tcagagtatacatacacgaccggtgctcgatttagagtatacatattggggtttgggggaggaactgctcagttaggacccagagggaaccatggaagccccagcccagcttctcttcctcctgctactctggctcccagcagccaccggagaaattgngctgacacagtctccagcccacctgtccttgtctccagggcaaagngccctcctctcctgcagggccagtcagcatgttacgctactactagcctaggaaccaacaaagcctggaccaggcctcccagtacctcctcagttacctagtacggactcggtccgtacctaaccgtacggggcccctaacggttccgggcccgtccccgggtaccgtacggggtttccaacgggtccacccggttagggttcggggtaccgtacgggggaacctacggttacccttacgtacctccttaaccgacctacgtaccgagtaccacggtacctacggaccgtaaccggtaaagtttcgttttacggtacgttttaatccgtacgtacggacgtagcgtaccgtacgtacctacggtcgtcctacgttccgtacgggttcggacggtaggaccgtaggagtaacgactaacgaacggtacgtggtacgctagaccctntacttcggtnttaccttctacgttcccgtccg

SEQ ID NO: 123858 - DNA, 859 bp, Homo sapiens
  misc_feature: GYAE6OF02FTXZ7.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccgaggcaaagcgcctcctctcctgcagggccagtcagcagtgtacgctacctacgttacgccgttaggtaacccaaacaaaaacggtccctagggacccaacgggtccctacccccgaagtaaccctacccttaccacgttaccttaacgttacggtacttcgggtacccgttaacccgtaacccggtaacgggggtacccctaccggttaccggggccccggtttacccccgggaacccgttaaggggtttacccgacgggttaccggacccggttaagggttccgggggttaccgtacggggggaaaccctacgggttaacccttttaccgaacccgtttccgtaaccccgtaaccggtacttaccggaaccggtaccaacggttaaccccggttaacgggaaacccgggtaaccccggttaaaggtttaccgttttacggttaccggtttttaaacgtaccgttacgtacgtacgtaccggacggttccgtaccgcctaaccggttcgtccctcgttaccggtaccggttccggggaccgggtaacggtacgtaaacgggttcgaaaccttacgaacgaaccggtacgtggtaacggtcgtaaccgtacctaccggttacgttcccgttaggttacccgtttctacccgtttccccctaccgg

SEQ ID NO: 123859 - DNA, 694 bp, Homo sapiens
  misc_feature: GYAE6OF02IIIPP.48.67.G01.1.454.CMB.1.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
  modified_base (657)..(657): a, c, t, g, unknown or other
  misc_feature (657)..(657): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccgganaaattgtgctgacacagtctccagccaccctgtccttgtctccagggcaaagngccctccctctcctgcagggccagtcagcatgttagcaccttattacgccttaggtaaccaaacaaaacgcccgtacggccgaagggccctacccgaagtcctcctcgaattcctaatcgattcggacctaccgtaccgacgggtacccacgtcgggtcccgtcccggtccgtaggttcacggtcgccgtaagggtcgggtcgtagggactacgtacgtttccacgttacctaccaccgtactcgacgctacggctaacggcggtaccccgtaaaggtttacgtttttcggaaccgttttaattacgtgtacctagtccgtagtcccggttaacgccctaacgttcgggacccctttagaccggttaccgggtcgggaccgggtaacggaaccgtagggttacgaacctagtaaccgaaacggttcgtagggtcgtccgaacgacctaccgtnttaccgtcttacccttacgtcctttacccgtaccccg

SEQ ID NO: 123860 - DNA, 897 bp, Homo sapiens
  misc_feature: GYAE6OF02IS58K.48.67.G01.1.454.CMB.1.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtcctccagccaccctgtccttgtctccgagggcaaagcgcctccctntccngcaggccagtcagctatcgttagcctaccttacttagcccttacggtaaccaaacaaaacgccgtcggacctaaggcctaccccacgaccttccctacgactttacctaagtgtaattcggtaccgttacctacccggacggggtaccccgtaacgttccgggaccccggttccccgggacccgttaggggttaccgtaacgggtccggtcccgtaggggttaccggggttccgtacgggggtaacctaacgggttccttttaccgaacctttccctaacccgtaaccccgtacgttacccgaaccggtaccgtaaccggtaccccggtaaaggtaccccgggaaccccggttaaaaggtttacgttttttacggggtaaccgggtttttacctttaccggttcggttacctaaccgggtcgtacccggggtaccggttcccgacccctaaacggggtttccctaccccgtttacccgttacgggtaccccgggtttccgggggaaccgggttaaccgggggtaaaccggtacgggtaacgggtaacccctttagggtaaacccgtaaaaccggttacgggttgggttaccggggtaccttacccgggtaacctacccgggttaccgttttccgtacgggttaaccctttaccgttacccgtttccccgttacccccg

SEQ ID NO: 123861 - DNA, 645 bp, Homo sapiens
  misc_feature: GYAE6OF02GH6QK.48.67.G01.1.454.CMB.1.raw
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
  modified_base (471)..(471): a, c, t, g, unknown or other
  misc_feature (471)..(471): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagacaccaccggagaaattgtgttgacgcagtctccaggcaccctgtctttgtctccgaggggaaagcgccaccctctcctgtaggccagtcagaatgtaagncctactcctagcctggtaccagacaaaaccgtcggaccacgccctcccgaggcctcctnactcgtatggtcgccgtccaccgcgggcccacgtcggccacgtcccagactaggttcagtcggcgtaggtcggtacgtgggacgacgtacttacacgtctacacctacgtaccaacgacgtacgtcggacgtctaggtatcgttagtttcgacgttaggtttcgttttacgngttaccgtagtacgtagtttacgtacgggttactttacccgtacggttaccgtagtaccgttaccggacggaccggggtaactaagggaacgtaaagtaaccgaacgtagtcgaggtactcggacctaacgtcttacgtcttaccgtactaccgttcccgtacccactgtaccg

SEQ ID NO: 123862 - DNA, 742 bp, Homo sapiens
  misc_feature: GYAE6OF02FIT49.48.67.G01.1.454.CMB.1.raw
  modified_base (140)..(140): a, c, t, g, unknown or other
  misc_feature (140)..(140): n is a, c, g, or t
  modified_base (158)..(158): a, c, t, g, unknown or other
  misc_feature (158)..(158): n is a, c, g, or t
tcagagtatacatacacgaccggtgctcgatttagagtatacatattgggtttgggggaggaactgctcagttaggacccagagggaaccatggaagccccagccccagcttctcttcctctgctactctggcctcccancagccacggagaaattgngctgacacagtcctccagccacctgtccttgctaccgagggcaaacgcgccctccctctccgtgccgacgggccagtcagcagtgttacgcctaccttacgtacgccctaggtaacccaaacaaacgccgtcggaccgacggcctccccgagtacctccctactactccttagtcgaactcggtccttaccgtaccgacgggaccctacggtaccggcccggttccccggaccgttacggttacacggttaccgcccgttaagggtcggggttccgtacggggacctaacggtaccgtttccacggttcctaccctaccgacgtacgaaccgccgaaccgtccgtaacggacggtaaccccgtaaggtttacttttcggtaacggtttacttccgtacgtaccgacgtactaccggtccgttaccgaccgtaacgtcgttacccgttacgtccggtacggttaccgggacgggttaacggaaccgtaagggtccgaacgttacgtaccgaacgtaccggtcggtacggaccgtacgaccgtacgtacttccgttccgttactccggttacgttccccttacccg

SEQ ID NO: 123863 - DNA, 641 bp, Homo sapiens
  misc_feature: GYAE6OF02I39N9.48.67.G01.1.454.CMB.1.raw
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (422)..(422): a, c, t, g, unknown or other
  misc_feature (422)..(422): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (530)..(530): a, c, t, g, unknown or other
  misc_feature (530)..(530): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtcctccagccaccctgtcccttgtactccgagggactaaagcgccttcctctcctagcgagggccagtcngcatcgtancactatagctgtaccaacaaacgcctgaccaggtccnccctaagcctacctnacttacaactgactacgtccgtactaccgagggcccaacgtcggccgtacccgccgtaggttaccaggtcgccgtaggtcggtcgtacgggtaacagtaccgttcaacttccgtaactaaccncgttaccaagtccaacgtacccgtagaccgacccggtaaagttcgtttacggtacgtttactacgtcgtaacncgtacnggctcgtacctaaccggtcgcgttacccncgtaccggtcggacggtaacggaccaggtcgggaactacgaccgtaaaagtcgcgggttcgctacgccgttaaccacggttcctgttaccggtactacctccgttcccccg

SEQ ID NO: 123864 - DNA, 582 bp, Homo sapiens
  misc_feature: GYAE6OF02GD9IV.48.67.G01.1.454.CMB.1.raw
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (440)..(440): a, c, t, g, unknown or other
  misc_feature (440)..(440): n is a, c, g, or t
tcagagtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaaccaacaaaagcctggccaggctcccagacctccncatctatgatgcgtcacgngggccacgnggcgtcccgctaggttcagtcgccgaggtcggtcgtgggacagtacttcactctcaccgatcagcacgcctagacgacccgtaagtacttttggtacggtttattacgtgtacgagtacncgtcgtcgacctacgtcgtccttcgtccgacggttcggcgggacgggtaccgaagggtcgaactacgtacgaaacggtacgtggtacggtctacgaccgtaaccgtacttccgtgttacctttacctacttcccgtaccccg

SEQ ID NO: 123865 - DNA, 834 bp, Homo sapiens
  misc_feature: GYAE6OF02GV57C.48.67.G01.1.454.CMB.1.raw
  modified_base (217)..(217): a, c, t, g, unknown or other
  misc_feature (217)..(217): n is a, c, g, or t
tcagagtatacatacacgaccggtgctcgatttagagtatacatattgggtttgggggaggaactgctcagttaggacccagagggaaccatggaacgccccagcccagcttctcttcctcctgctacgtctggctcccagcagccgaccggaagaacttgtgctgacacgagtctccacgccaccttcgtccttgtcctccgagggacaaaggacnccctccctactccgtagcgacggaccgacgtacgacgcctagtagttaccgcctaaccgtttacgtacggtccgttacggtaaccaaaactaaaccggcgtaccggaccggacgtcctaccccgaataccgtcctacttacttccgtacgtcggtacgtcgtaccggttacctaacccgggtacgggtcccgtacggtccgggtcccggtccccgggtaccgggttaccggtcgtacggttcggaaccgttcggggtccgggttcggtacgggtacgtaccggtaccgttacgaccttaccgacctaccgtacgtacctacgacacgtacgtacggaaccggtccggtaaattacggtttacgtttaccggttagttccgtacggttacgaccgtagtcggtaccgaccgtaccgtaaccgttcggaccctttacgtccgggtttaccggtccggggtaacggttaccgggtacgggtacgggtaacgttaacgggtaacctaaccgttaaacggtaccggttcgggttccggtaaacccggtcgtaacccgttaaggttcccttaaccggtttccgtttaaccctaacggttccccggttttacccgtaaccccgg

SEQ ID NO: 123866 - DNA, 782 bp, Homo sapiens
  misc_feature: GYAE6OF02HJHAQ.48.67.G01.1.454.CMB.1.raw
tcagagtatacatacacgaccggtgctcgatttagagtatacatattgggtttgggggaggaactgctcagttaggacccagagggaaccatggaagccccagcccagcttctcttcctcctgctactctggctcccagcacgccaccggagaattgtgctgacacagtctccagcccaccctgtccttgtcctaccgacgggacaaacggcgtccctacccgtctccgtcgcgacgggcctacggtcacgtcagttacgtacgaccgtaacctacgttacgtaccgtacgtaaccaaaacaaacggtccgtacggaccgtacggtccgtaccccgaacgtaaccgtcctacgtaacctactacgtagtacttcggtccgtaacgtaccggacggacctaccggtcgggcccgtacccggaccgtacggtcacggtacgccggtaggtccggtagtacggacgtaacggtctacgtaccgtcacctaaccgtacgtacgacgtaccgacgtacggtaacgaccggtaaccggttaactttaggttttaccggttacgtttaacttacggtcgtaacgttaccggtacgtacggtacgtaccgtaaccgtccggtccgtccgtaccgtaccgtccgggttaccggggaccgggttaaggaacccgtaagggaccgtaaccgtaggtaacccgaaacggtccggtaacggtaccgggaccgtaaccgtacccgtattaccggttccgtaccgttacccgtttaacgtcctaccccggttacccg

SEQ ID NO: 123867 - DNA, 786 bp, Homo sapiens
  misc_feature: GYAE6OF02IMYD3.48.67.G01.1.454.CMB.1.raw
  modified_base (162)..(162): a, c, t, g, unknown or other
  misc_feature (162)..(162): n is a, c, g, or t
  modified_base (241)..(241): a, c, t, g, unknown or other
  misc_feature (241)..(241): n is a, c, g, or t
tcagagtatacatacacgaccggtgctcgatttagagtatacatattgggtttgggggaggaactgctcagttaggacccagagggaaccatggaagccccagccccagcttctcttcctcctgcctactctggctcccagacagccaccggagaaattgtnctgacacagtctccagcccacctgtccttgtctccgagggacaaagcgtccctccctctccgtcgcgcggccagtcganctagttcgttacgcctaccttaccgtacgaccgttacggtaaacccaaaacgaaaaccgtccgtccggaccgacggacccctacccgaacgttcctaccctacctacttacgttactggaacgtcgtccgtaccgtaaccggcggaccccttcgtccggtccccgggtaccccgacgttaccgtcggaccgttcgcgttagggttcggtaccgtaggtaccgtaacgtctacctaccttaccgtacacctacgtaccgcggaaccgtaccgtccggtaaccgaccggtaccgtaacggttacgtttacggttacgtttacgttaccgtacgtctacgacgtcgtcccgtcgtaaaaaaccgtcgtaccgttaccgtaccgttaccgtacggttcgggtaccgggaaccggtaaccggtaaacggtccgtaacgtaaccgttaaccgtaaaccggttacggtaacggttaccgtaccggtaccgttaccctaccgttacgttccgttaccgttcccgttaaccgttaccgttaccccgttaccccg

SEQ ID NO: 123868 - DNA, 530 bp, Homo sapiens
  misc_feature: GYAE6OF01B3KTJ.10.9.A09.1.454.CMB.1.raw
  modified_base (409)..(409): a, c, t, g, unknown or other
  misc_feature (409)..(409): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttccaccttcagtagctacggcatgcacgtgggtcccgccaaactccgaggcaagggattgggagtggggtgctagttgttcatcgtgagggcaggtgttcaagtggtatgctgacgcgtagacggcgatcacatctcagagacacnccagacacaatgtattcgactagaacagtactaagtcctgacggacgacggtgtatactagtcgtacggaaggggacggggaaccgaggacgggagttaccgagttactccgttgcgtcgg

SEQ ID NO: 123869 - DNA, 604 bp, Homo sapiens
  misc_feature: GYAE6OF01BBDH7.10.9.A09.1.454.CMB.1.raw
  modified_base (203)..(203): a, c, t, g, unknown or other
  misc_feature (203)..(203): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgttggcgcttgagctgtaccaacacaaacctggccaggctcccaggccccctcatctatggtgcactccaacgagggcccacgtggcactcccagccaggttcaggtggcgaggtgggtagtgggacagtacttcactctcaccatcatcagccgtggacgtcctagaagattgttgctaagttttattacgtgttaccaactacttaccggtacgacggttcgggacccggttcccgggggtacccttaccggtttcccgggcccgttacggggaaccctaaagggtacgggtaacgtaacgtaacgaaaccggtaacgtcggtacggtccgtcgaccctaccgtacttccgttcggttccttcgtacccg

SEQ ID NO: 123870 - DNA, 557 bp, Homo sapiens
  misc_feature: GYAE6OF01ARJ8A.10.9.A09.1.454.CMB.1.raw
  modified_base (202)..(202): a, c, t, g, unknown or other
  misc_feature (202)..(202): n is a, c, g, or t
  modified_base (399)..(399): a, c, t, g, unknown or other
  misc_feature (399)..(399): n is a, c, g, or t
  modified_base (445)..(445): a, c, t, g, unknown or other
  misc_feature (445)..(445): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttggcgtccttcgtaagctggtaccaacacaaacctggccaggcctcccacggccccctcatctatcggtgcatccaacgagggcccacgtggcactccccagcctaggttcaggtggcaggtgggtatgggacagacttcgactctcaccatcatcagcctgganccgtagaagtatgttgactagtttatactgtacaactatcgtacgngtcgccgtcggggtcctacgttccggccgtagggacctaaggtcggacgtacgtaaccgaaacgtagtcggtcggcgtacgacaaccgtataccgttcgttccttcgtaccg

SEQ ID NO: 123871 - DNA, 639 bp, Homo sapiens
  misc_feature: GYAE6OF01BML8Q.10.9.A09.1.454.CMB.1.raw
  modified_base (204)..(204): a, c, t, g, unknown or other
  misc_feature (204)..(204): n is a, c, g, or t
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
tcagcatagtagtgcacgaccggtgctcgatttagcgagacgcgcaggggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagatgtgcncttgagctgtaccaacacaacctggccaggcctcccacggccccctnatctatggtcgcactcccgaacgngggcccacgtcggccactccccagcctagggttccaggtggactagggtcgggtatcggggaactaggtaccttcactcctaccacctatctactccgacgtcccgtaggacgtaccgtaggaaagtagttggttagtacgttaagttttacttacgttacgtactaactacgttaccgtaccgtacggttccgggccccggttccgggggtacccttaccgggtttcccgggaccccggttacgggaacccgtaaaggtcgggaagtacgtaccgaaacggtacgtaggtcggacgtcggacctactacgtcgtcgttctcgtaccg

SEQ ID NO: 123872 - DNA, 519 bp, Homo sapiens
  misc_feature: GYAE6OF01ERJHV.10.9.A09.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (483)..(483): a, c, t, g, unknown or other
  misc_feature (483)..(483): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccacggagagattgtgttgacacagtctccagccaccctgtctttgtctccaggggaaanagccaccctctcctgcagggccagtcagaatgttggcgccttcgtaagctggtaccaacacaacctggccaggctccaggcccctnatctatggtgacataccaacgacgggccacgtggcaactcccagcctaggttcaggtcgcaggtgggtagtgggacagactcactctcaccatcatcacgtcctggacgcctagacgatgtgacgtatttattactgtacaacactcgtacgagtcggccgtcggggcctacgttcgccgtggaaccaagtgaganacgaacgtatggtgctgacctacatctcgtctgtac

SEQ ID NO: 123873 - DNA, 550 bp, Homo sapiens
  misc_feature: GYAE6OF01AVFFP.10.9.A09.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (402)..(402): a, c, t, g, unknown or other
  misc_feature (402)..(402): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaaanagccaccctctcctgcagggccagtcagaatgttggcgccttgtaagctggtaccaacacaaacctggccaggctcccaggcccctnatctatggtgcatccaacngggccacgtggcactccccagcctaggttcaggtggcaggtgggtatgggacaggtacttcactctcacatcatcagcctggacgctgaagntgttgctagtttatactgtacaactactcgtacgtagtcggcccggtccggggtcctacgtttccggcccgtacgggaaccgtaaggtcggagtacgtacgaaacgtacgttggtcggctcgacctacacttcctcgttcttcgtacc

SEQ ID NO: 123874 - DNA, 730 bp, Homo sapiens
  misc_feature: GYAE6OF01BZFNW.10.9.A09.1.454.CMB.1.raw
  modified_base (275)..(275): a, c, t, g, unknown or other
  misc_feature (275)..(275): n is a, c, g, or t
  modified_base (328)..(328): a, c, t, g, unknown or other
  misc_feature (328)..(328): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtggggagtcacagagactctcctgtgcagccctgtgggttccaccttnagtagctacggcatgcacgtcgggtcccaccaaactccgaaggaccgaagggnttgggaggtggggtggactaggtttcgttcagtcgtggagggtctaggttgttacaagttgggtatggtcgtggaccggtcggtagggaacgggtccgtacgttaccacctactccctaccgaagaacgaacccaaccgtaccgaaacggaaacctaacgtaagttacgttaacgtttaccggaaccgttaacgaaaccgtacggtaacccgttaacggtacccgtaagggaaccgggtaaccggtaacgggttacgttaacgttaaccgttaacgttaacggggtaaaccgggtaaaggggggaaccggggggtaaacccgaacgggggtaaccgggttaaccgttaacccggtaaacggtttacccgttacccggtttacggtaaccgggttacccgggg

SEQ ID NO: 123875 - DNA, 568 bp, Homo sapiens
  misc_feature: GYAE6OF01BUSC2.10.9.A09.1.454.CMB.1.raw
  modified_base (173)..(173): a, c, t, g, unknown or other
  misc_feature (173)..(173): n is a, c, g, or t
  modified_base (276)..(276): a, c, t, g, unknown or other
  misc_feature (276)..(276): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctcttttaagngtgtccagtgtcaagtgcaactggtgagtcgtgggggagcgtagtccagcctgggagtcaacagagactctcctgtgcagcctctgggttccaccttcagtanctacggcatcgcacgtggggtcccaccaaaactccgaggcaaggggtattgggagtgggtggctagttgtttcatcgtggaggggctaaggttgttacaagtgggtatgctggaccgtcgtagaacggccgattccacatctacagacacaactacagaacanaatntattgacagaacacgtacctaagtcctagaggacacgggtatacttactacgttaggtacggaagggacgggggaaccagggtccgggtaacgttaccgaacgttactaccgtttcgacggtcgg

SEQ ID NO: 123876 - DNA, 839 bp, Homo sapiens
  misc_feature: GYAE6OF01E340N.10.9.A09.1.454.CMB.1.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgacaacgtggtggagtcggtgggggagcgtagtccagccgtgggagtcacgagacgactctccgtgtgcacgccttcgtcggttccaccttcgagtacgcgtacggcagtcgccgacgtcgggtacccaccaaactccgaggacgaagggtnttgggnggttgggtgcgtaggtttcgttacagttcgagggagggtactaggtttcgttacgaagttgggtatcgggtacgtaggtaccggtacccgggttagggaacggggtacccgttaattaccccgaaccccgtaacgtttaccccgtaacccgaacggaaaccggtaaaccccgtaacccgttaacccggaaaacggtaaacctaaaccgtaaggtttacgtttaaacggtttaccgggtaacccgtaacggtaaacccggtaaccggttaacccgttaaacgggttacccggttacgggaaccgggtaacccgggttaacggggttaacgttaaccgttaaaccgttaaccggttaacggggtaaaaccggggtaaacggggggtaaccggggggaaacccgtacggggtaacccggggttaaacgttaacccggttaaacgggtttaaccccgttttcccgggttttacgggaacccgggtttccgggg

SEQ ID NO: 123877 - DNA, 575 bp, Homo sapiens
  misc_feature: GYAE6OF01BE95F.10.9.A09.1.454.CMB.1.raw
  modified_base (172)..(172): a, c, t, g, unknown or other
  misc_feature (172)..(172): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctctttaagngtgtccagtgtcaagtgcaactggtggagtctggggggagcgtagtccagccgtgggaggtcacagagactctcctgtgcagcctctcgggttcaccgttcagtagctacggcatgcacgtggccnccaaactcgaggcaagggnttgggagtgggtgctagttgttcatcgtggaggcagtgttcaagtgtatgctgacgccgtagacggcgatcacatctcgagacgaaccaactacccgaaggaaccaacaagtagtaacgtttacgggaaccttacgaaactacgtacctaagtccgtaggtaacgaccgacgggtagtagtacgtacgtaggttaacggaagggtagggggaacccaggcgggacgttaccgaacgttactccgtttggacggtcggg

SEQ ID NO: 123878 - DNA, 787 bp, Homo sapiens
  misc_feature: GYAE6OF01AGQRX.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcaccatggagtttggctgaactgggttttcctcgttgcttcttttaagaggtgtccagtgtcaagtgcaactggtggagtcgtgggggagcgtagtccagccgtgggaggtcacgagagactctcctgtcgcagtccctgttcgggttccaccttcgaggttacgcgttacggcaagtcgacgtacggtcgggtaccccaccaaaaccgtcccgaagggccaaaggggtacttgggagttggggtcgcttaggttctttaccgagttccgtagggacgggctaagggttgttacgaagttggtattcggtacgtagtaccggtccggtaaggaacgggtccgtagttaccaacctcgtacctaccgaagacgtaaaccaaccgtaccgaaacggaacctaaacgtaacgtttacggttaacgttaacgggaacccgttaacggtaaccgtaaccggttaacccgtaacggttacccggtaaggaaccgggttaaccgtaacccggggttagttaaaccgtttaacggtaacccggttacgggtaaacccgggggtaaacggggaaccggggggtaaacccgtacgggggtaccgggttaaaccgttaccccgtaaacggtttacccgtttacccggtttacgggtacccggttaacccggggg

SEQ ID NO: 123879 - DNA, 581 bp, Homo sapiens
  misc_feature: GYAE6OF01EKUL0.10.9.A09.1.454.CMB.1.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (430)..(431): a, c, t, g, unknown or other
  misc_feature (430)..(431): n is a, c, g, or t
  modified_base (447)..(447): a, c, t, g, unknown or other
  misc_feature (447)..(447): n is a, c, g, or t
  modified_base (549)..(549): a, c, t, g, unknown or other
  misc_feature (549)..(549): n is a, c, g, or t
  modified_base (571)..(571): a, c, t, g, unknown or other
  misc_feature (571)..(571): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgcccaccctctcctgcgaggccagtcagaatgtgcgcttgaanctggtaccaacacaaacctggaccaggcctccgacggcccctacattctagtggtcncaactaccaacgacgggccacgtgaccactcccagccgtaggtcaggtgcgaggttgggtagcgggaacacgtacttacacctcaccactatcatcacgtccnggtcaccgtagaatagttgttnnttacgtttatacgttnaactaacagttaccgtacggacggttgggccccggtaccggggtcccttacggttccggaccgtacgggaaccaagtcggaagtacacgtaaacgtagtcgngaccgtgacctacgtctacgtntccttatccg

SEQ ID NO: 123880 - DNA, 811 bp, Homo sapiens
  misc_feature: GYAE6OF01DBNFE.10.9.A09.1.454.CMB.1.raw
  modified_base (176)..(176): a, c, t, g, unknown or other
  misc_feature (176)..(176): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgcttacttttaagnggtgtccagtgtcaagtgcaacgtggtggagtcggtgggggagcgtagtccagccgtgggagtccagagagacctctcctgtcgctacgcccttcgttcgggttcctacccgttcgaaggttacgccgtaacgggcagttcggacctaccggtcggggtacccaacccgaaaaccgtcccggaagggacgtaaaggggtagtttaggggagttggggtcggtacgttaggttttcggtttacagttccgtagggagggtctaggttcgtttacgaaggtttggtatggacgtggaccggtccgggttagggaacgggtaccgtacttaccaaccgtacttacctaccgaagaacgaaccaaccgtaccgaacggaaacctaacgtaagtttacggttaacgtttacggaacccgttaacgaaccgtaaccggtacccgttaaacggtacccggtaggtaaccgggtaccggtaacggggttaacgttaacgttaaccgttaacggtaacgggttaaaccggggaaaacggggggtaacggggggtaaacccgaacggggtacccggggttaaacggtttaccccggtaaaacggtttacccgtttaccggtttacggtacccgggttaccggggg

SEQ ID NO: 123881 - DNA, 966 bp, Homo sapiens
  misc_feature: GYAE6OF01A7TZN.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacgttgggttttcctcgttgcttcttttaaggagtgtccagtgtcaagtgacaacgtggtggaggtcggtgggggagcgtagtccaggccgtgggaggtcacgagacgacctccccgtggtcgcgacggtccttcggttcgggtttaccctacccgtttacgtaacggttacgtaccgtaccggggactacgttcggaccccgttaacggttccggggtaccccgtaacctaaaaccgtcccggaaagggtaccggtaaagggggtacggtttggggaacgggtttgggggtacgggttaccgttaagggtttttccgtttacgtaacggttcgggttaggggtaaccgggggtcttaacgggtttacgttttaaccgaaaaggggttttcggtttaacggtccggttacccggttacggggtaaacccggtcccggggtttaaaggggaacccgggggttccccttaagtttaccccggaaccttaacgttaccccggttaacccggaaacggtaacgtaaaaccccgtaaacccggttaacccgtaaacggggtaaaccctaaaccgttaaggttttaccggttaacggttttaaccggaaccccttaagggaaaacccgttaccggtacccggtttaaaaccggtcggttaaccgggaacggttaaccgggttacggttaacgttacgttaaaccggtcgttaaacgggggtaaacgggaaacggggtacgggggaacccgttacggggacgttaacgggttaacccgtaggtttaaccccggtttcggttacggacccggggtttcgaacccgggggg

SEQ ID NO: 123882 - DNA, 703 bp, Homo sapiens
  misc_feature: GYAE6OF01DB2NC.10.9.A09.1.454.CMB.1.raw
  modified_base (210)..(210): a, c, t, g, unknown or other
  misc_feature (210)..(210): n is a, c, g, or t
tcagcatagtagtgcacgaccggtgctcgatttagcgagacgcgcagggggaggaactgctcagttaggacccagagggaccatggaagcccagctcagcttctcttcctcctgctactctggctccctagtttcagactaccaccggagagtattgtgttgacactagtcctccacgcctaccttgttctttgtctaccgaagggaaancgcccaccctctcctgcgacggccagtcaagtaattgtcggcctcgttagactcgtagtaaccaacaaccaaccgtcggaccacggcctaccgacgtcccctatactcgtacgtggtacactaaccgtaccgaacgaccggtacctacgtcggacctacctacccgacgtaccgtacggtcgtacggtcgacgtagggtcgggtacgtacgggactacgtaccttactaccgttccacgtaacctacttacgaacgtcgacgtccgttagggacttacggtaagtagttaactggttcgtactttaggtttaacctgacttacgactacgtaccggtacgtacggtccgggtacccggtccggggtaccttaccggttccgggtacccgtaacggtaacgtaaacgggttctaaacggtaacgtacccgaaaacggttcgtaggtccggtacgacaacccgtacttcttcggtaaccttcgttacttaacccg

SEQ ID NO: 123883 - DNA, 978 bp, Homo sapiens
  misc_feature: GYAE6OF01BWR10.10.9.A09.1.454.CMB.1.raw
  modified_base (183)..(183): a, c, t, g, unknown or other
  misc_feature (183)..(183): n is a, c, g, or t
  modified_base (271)..(271): a, c, t, g, unknown or other
  misc_feature (271)..(271): n is a, c, g, or t
tcagcatagtagtgcacgaccggtgctcgatttagcgagacgcgcgagggggctcgtgggagaggagcccagcactagaagtcggcggtgtttccattcggtgatcagcactgaacacagaggactcaccagtggagtttgggctagtaacttgggttttcctcgttgcttacgttttaaggnggttcgtaccgagttgtacaagtcgacaacgttgggtggagtcggtgggggacgtcgtagtccgaggccgtgggacgtacacgagacnccttctcgtggtacgcgtacggtccttcgttcgggttacctacgtttacgaagttacgtccgtaacgggactaagttccggacctccggttacgggtacccgaaccctaaaccggtccgaacgggtaccgtaagggtacgttggggtaggtcggggtacgtacggttaggttttacgttacgtacgttacggttacgggacgggtacgttacggtttaggttaaccgtaaggttcgggtttagtaccggttacgtaccggggtaacccgggttaccgggtttaacgggaaacccggggttaccggttaaccgtttaacccgaaccccggttaacgtttacccccggtaaaccggttaaacgggaaacccgttaaaccccggttaaccgtaaacccggaaacgggtaaacctaaaccggtttaacggtttaaccggtttaacgggtttaaccgaacccggttaaacggaaacccggttaacggtaaccccgggttaaacgttaccgggttacggaaaccggggttacccgttaacggggtaaaaccgtttaaccggttaaccgtaaacggttaaccgggggtaaaccgggggtaaagggggtaacccgggggtaaacgtaccggggtaaacccgggttaaccgtttaaaccccggtaacggtttaaccccggtttcgggtttaaaccggtcccggggttaaacccggg

SEQ ID NO: 123884 - DNA, 771 bp, Homo sapiens
  misc_feature: GYAE6OF01A65G3.10.9.A09.1.454.CMB.1.raw
  modified_base (175)..(175): a, c, t, g, unknown or other
  misc_feature (175)..(175): n is a, c, g, or t
  modified_base (249)..(249): a, c, t, g, unknown or other
  misc_feature (249)..(249): n is a, c, g, or t
tcagcatagtagtgcacgaccggtgctcgatttagcgagacgcgcgagggggctctgggagaggagcccagcactagaagtcggcggtgtttccattcggtgatcagcactgaacacagaggactcaccatggagtttgggctgaacgttggttttcctgttgctacttttaagnggtgtccagtgtcaagtgactaacgtggtggagtcggtgggggagcgtagtccgagccgtgggacgtcacgagngactcgtccgtgtgcgagtcctcgttcggttccaccgttgagtcgccaacggcctagtcgcaccgtcgggacccgtaccaaccgtccgaggacgaggtagtggaggtgggtcgtacgtagttcgttacacgtgaggacggctaaggttcgtacgtaagttggttacgtcggtactcggtaccgggtaccggtagggtaaccgggcccgttacgttaccgaccccgttaacttcccctaaccggtaacgaaccgggtaaacccctaccggttaacccgaaaccggtaaacctacgttaaacgtcgggttttaaacttccggggtaacccttaacggaacccgttaaccgaccgtttaacggtaccgttaggaaccggtaaccgacgttaacttaccgtaaacgttacccgtaaagggtacggaaaccggtaaagggggggtaaccgggtaacccgaggggtaaacccggttaccgggtaaaccccggtaaggttcccgtttacggttcccgggttaacccggg

SEQ ID NO: 123885 - DNA, 903 bp, Homo sapiens
  misc_feature: GYAE6OF01AM7ZN.10.9.A09.1.454.CMB.1.raw
  modified_base (188)..(188): a, c, t, g, unknown or other
  misc_feature (188)..(188): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacgttgggttttcctcgttgcttcttttaagaggttgtccagtntcaagtgacaagtggtggagtcgtgggggagcgtagtccaggtccgtgggagtcacgagacgtactctaccgtgtcgaccgacgtccgttcggttacgggttacctaccgtttacgaacggttaccgtacccggttaccgggactacgttaccggtaccgtaccgggtttaccggggtacccctaaacccgtaaaaccgttcccggaagggtaaccggtaaggggttaacgtttcggggaggttacggggtagtaccgtttaggttttccgtttaccgaggttccgtagggacgggtacttacggtttacgttaacgaaggtttcgggttagcggtacgttacggaccggtaccgggtaggaccggttcccgtaacttcccgaaccgttactaccccgttaacgaacgggtaacctaaacccggtaccttaacccggaaccgtaaaccgtaacgttaacggtttacggtttaacgttaccggtaaccgtaacgaaccgttaacccgtaaccgttaaccggtaccgtacgggaaacggttacccggtacgggttaaccttaacggttaaaccgttaagggttaaaccgggtaaccggggttaaacgggggaaccgggggttaacctaaccggggggttaacgtttaacccggttaaacccgttaaaccgggtttacctttaaccccgggttagggttaaacccgggttcccggggg

SEQ ID NO: 123886 - DNA, 744 bp, Homo sapiens
  misc_feature: GYAE6OF01BXY9W.10.9.A09.1.454.CMB.1.raw
  modified_base (175)..(175): a, c, t, g, unknown or other
  misc_feature (175)..(175): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtggtggagtcgtgggggagcgtagtccagccgtgggacgtcacaggacgtactctccgtgtcgccacgtcctcgttcggttacctacccttgaaggtacgtccgtaacggctacgtcgacctaccggtccgggtacccgaacccaaaccgtccggagggacggtaaggggttagttagggtacggtggggtacgtcgtttacggttttcgtttacacgttccgggtagggtacgggtacgttaggtttcggttaacgtaaggttcggttaacgtcggtacggtaccgggaaccggtccgggtaaggggaacccgggtaccttacttacccgaacctacgttcccgtaaccgaagtaaccgaaaccctaaccgtaccgaaacggaaacctacgttaagttcgtttaacgttaccggactaacgtaaccgacgtaccgtacgtacgtacggaacggtaccgtacggttatacgtacgtacggtagggaacggaaggggacggggaccagggtaccgtacgtacgtacgttccgttcgtggccgtcggg

SEQ ID NO: 123887 - DNA, 853 bp, Homo sapiens
  misc_feature: GYAE6OF01DGAGN.10.9.A09.1.454.CMB.1.raw
  modified_base (199)..(199): a, c, t, g, unknown or other
  misc_feature (199)..(199): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctccagtttcagataccacggagagatttgtgttgacacagtctcagccacctgtctttgtctccgagggaaancgccacctctcctgcgacgggccagtacagtaatgttggccgtccgttacgtaacgtcgtacggttaaccaaacctaacctaaaaccgtcggacccgacgggtcccttaccccgacggtccccccttactaacgttaccgttaagttcggggtactacgtaaccgttacccgaaaccggtaaccggggccctaacggttcgggacctaccgtacccccgaacggcccgtaacgggtttcgaacgggttcggtaccgtaaggggttcggggtaacgttacgggggaaacctagggtaccctttaccgacctttaccaccgtaacctactaccgtaagttccgaaccgggtcccgtaaggggtaccggtcccgttaaagggtaacggttaacgtttgggttaccgttacgtttaacgtttttaactacgtacgttaacctaacgtacgttaccggtaaccgggtggtaccgggtaccccgggttaccggggtacccttacccgggtttacccgggtacccggttacggggaaaacccgtaaaagggttccgggacttaacccggttaacgtaaaaaccgggttcggttacggtacgggtacctacggtaacccgtaccgttactttccggttaacgttccgtttaacctaccccgg

SEQ ID NO: 123888 - DNA, 878 bp, Homo sapiens
  misc_feature: GYAE6OF01ESB79.10.9.A09.1.454.CMB.1.raw
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
  modified_base (570)..(570): a, c, t, g, unknown or other
  misc_feature (570)..(570): n is a, c, g, or t
tcagcatagtagtgcacgaccggtgctcgatttagcgagacgcgcaggggggaggaactgctcagttaggacccagagggaaccatggagccccagctcagcttctcttcctcctgctactctggcctcccagttttcagataccaccggagagattgtgttagacacagtctccagcccacccttgtctttgtctccgaggggaancgccaccctctcctgcagggccagtcagtaaatnttgacctaacctaacttagccttaggtactacgaaacaaaacgccgtacggaccacggtcctaccccgacgtacctcccctctactctaccgttcggttacgcctaacgtccgttttcccggaacggggggtcccaaccgttcggggttggttaccccccgaaggtcccccgtaaaggggttttcccgtaaaggtttcgggggtaccgtaaacggggtttacggggggggtttaccctttaacggggggtaaaaaccccgttaacgggaaacggttttttaccccgtaaacccgtttaacccgttaacccgtaaaaccccgttaaaccnccgtttacccgtaaccgggtacccggggtaccccgttaccggtaccgtaacggtttaaccgtttacggtaaacggttaaacgttttttacggtttacgttaacgttttaacgtttaccgttacggttacgtaacggtacgttaacggtttaacgtttaaacgttacggttacgtttacgggttttacgtttacgttaaccgtttaccgggtacccgtacgggttaaccgttaaacggttaggtacgtttacgtaagtacggtaacgttcgtacggtcgtacgtccgtaccctacgttcgttcgttccg

SEQ ID NO: 123889 - DNA, 903 bp, Homo sapiens
  misc_feature: GYAE6OF01B7H8G.10.9.A09.1.454.CMB.1.raw
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
tcagcatagtagtgcacgaccggtgctcgatttagcgagacgcgcagggggctctgggagaggagcccagcactagaagtcggcggtgtttccattcggtgatcagcactgaacacagacggactcaccatggagtttgggctgaacttgggttttccncgttgcttcttttaagnggtgtccagtgtacaagtgctaacgtggtggagtcgtgggggagcgtagtccgagccgtggggagtcacgagagacttctccgtggtcgactacgccgttcgttcggggttacctaccgtttacgaacggttacggtaccgttaaccgggctaacgttcggaccgtaaccggtttcggggggtaccccctaaccccgaaaaaccggttccccgaacggggtaaccggaaagggggttactttagggggaagggttgggggtcgggacctttaggggtttttcttttaccgaagtttccggtaggggtacggggtacttagggtttacggtttacgtaaagttcgggtaagtcggtcgttacgggaccggtccgggtaggggtaaccgggtacccggtacttaccgtaccgtacgttacccgtaccggaaggtacgtaaaccgtaaccgttaccggaaacggtaaaccgtaaaccgttaagttacggtttaacggtttaaccggaaccgttacggtaaaccgtacggttaacccgtttaacgggtaccgttaaggaaccgggtacggttaacggggttagttaaaccgttaccggtaaacggttaacgggtaaacggggtaacggggggtaaaccgggggaaacccgtaacgggggtaaccggggttaccgttaaacccggtaacggtttaaccgtttccggtttaaccgggacggtttacccggggg

SEQ ID NO: 123890 - DNA, 820 bp, Homo sapiens
  misc_feature: GYAE6OF01DZOR7.10.9.A09.1.454.CMB.1.raw
  modified_base (177)..(177): a, c, t, g, unknown or other
  misc_feature (177)..(177): n is a, c, g, or t
  modified_base (315)..(315): a, c, t, g, unknown or other
  misc_feature (315)..(315): n is a, c, g, or t
tcagcatagtagtgcacgaccggtgctcgatttagcgagacgcgcgaggggggctctgggagaggagcccagcactagaagtcggcggtgtttccattcggtgatcagcactgaacacagaggactcaccatggagtttgggctgaacttgggttttcctcgttgcttcttttaagnggttgtccagtgtcaagtgacaacgtggtggaggtcgtgggggaggtcgtagtccagtccgtggggacggtcacgagacgtacctcgtcctggtcgcacgtcccttcgtcgggttaccaccttagagtacgctacggnagtcgcctacgtcggtacccgaccaaaacgtccggaaggaccgtaaagggtgttagggagggttcgggtggtaccgtaggttttcgtttcgtaacgttccggttagggaacggggtccgtaggtttacggtttaacgaaggtttcggggttaagttcgggtaccgttaaccggggtaaccgggtaccccggggttaagggtaaccggggttacccgtaactttacccgaaccctacgttaccccgtaccgaaacggtaaccgtaaaccctaaccgtaaccgaaacggaacctaaattaacgtttacgttaacgttaaccggtacctaaggtaaaccgtacgtaccggttaacgtccgttaagggaaccggtaccggtaacgggttacgtaacgttaacctaacggttaaggaaaccggggtaaaggggaaccgggggtaaccaagggggtaccggtaacggttaccgaacggtttaccgttaccggttaggtcgggtacccgggg

SEQ ID NO: 123891 - DNA, 905 bp, Homo sapiens
  misc_feature: GYAE6OF01EMGFK.10.9.A09.1.454.CMB.1.raw
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctaccgaggggaaagacgccacctctcctgcagggccagtcagatgttgcgtacttcgaagctaggtaccaacacaaacctggaccaggcctcccgacggcccctcgactctaagtcggtgcctaactacccgaaacgacggggtacccacgtgggaccaacgtaccccgagtacccgaggttccgaggtcggactaagggtcgggggtaatacgggggacctaacgggtacctttaccaaccgttccttaccggaaaccctgttaccccgaaacttaccgtaacggacccccgttaagggggtaacctacccgggtaacggtaaaacggtacggtttacgggttttacgggttaccgtttaaacggttttttaaacgtttaacccgtttaacggttaacccggtaaacgttaacccgggtttaaccccgggttaaccccggttaaccggggttacccgggggttcccccgggtttaccccccggggggggttaaccccgtttaaccccggttttttaccccgggggaccccccggtttaacggggggtaaaccccggtaaaaacggggttaacggggtaaaccggtaaacggttaaacccggtaaaaacccgggttaaaccggttacgggtttaccggggtacccgttagggtaaccccgtaacccgttaacgtttacccggtttcggtttacccgttacccgtttaaaccccgg

SEQ ID NO: 123892 - DNA, 1078 bp, Homo sapiens
  misc_feature: GYAE6OF01DR1OU.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggacctcaacctagtgggtagtttgggctaggtaacgttcgggtttttccctcggttgtcctttacgttttaaggacgggttcgtcccgtaaggttcgtaccgtaaagtcgtacctaaacggttgggtggaacggttcgggtaggggggacgtcgtaacgtccgaggtccggtgggacgtacaacgagtacgtaccttccgtccgtaggtcgaccgtacggtcccttcggttcgggttccctaacccgttcggtaacggttcgtaccgttaccgggactacggttccggtacccgtaccgggttccccggggttaaccccgaaccccgttaaaaccgtacccgggaacgggtaaccgggtaaaaggggtttcgttaagggggtacgggttccgggggttaggtacccggtttagggtttttacgttaccgttacgtttaccggtaggggttaccggggttacccttaaggggtttccgtttaaaggtaaaccgggttgggtttcgtaccggttaccgttaccgggtaaccggggttacccggttaacggggaaccggggtacccttaacgttaaccccgtacccggttaccttaccccggaaagtaacccggtaaacgaaacccccgttaccggtaaacccggtaaaccggaaacctaaacggtttaagttaccggtttaaccgggtttaaccggaaacccgttaacgtaacccggttaacccggttaaccgttaacccggttaaccgggtacggtaaaaccggggtccgttaaaccggggttaccgttaaaagttacccgggttaaacggggtaaaccggggtaaacggggtaaaacgggggggtaaacccgggggtaaaccggtacgggggttaacccgggttaacccgtttaaacgggttaaacccccgtttacggtttccccgggtaaacgggttccccggttaacccggggggg

SEQ ID NO: 123893 - DNA, 814 bp, Homo sapiens
  misc_feature: GYAE6OF01C21GA.10.9.A09.1.454.CMB.1.raw
  modified_base (223)..(223): a, c, t, g, unknown or other
  misc_feature (223)..(223): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggcctccctagtttcagactaaccaccgggagagtattgtgttacgacactacgtcctccacgcccacccttgttctttgtcctccggaaggggaaaacncgcccaccctctcgtgacgacggcctagtcgaagtatcggttcggcgtaccttacggaacgtcgtacggtaaacccaaccgtaaacctaaccgtcgacccgtaacggtccctacccgaccggacccccttagacttaccgtatacgtacttacggtacctccggaccgggcccggtacccgtacgtaccggtccccgtacccacggaccgttacgggttacgagtacggtcgtaggtcgttacgggtccggtacggtacgtacgtacccttacctacgtacccgtaacctaccgtaagtacccgcgtaccgtaccgtacccgtaacggtaccggtaccgtaaggttacgtttaacggtttttacggttacggttttaaactcggttaacgtacgtacggactaccgggtcgtcgtaccgtacgttccggttacccgtttccggttacccgtttcccggttacccggtacccgggtacggtaaccgtaaaggtacggtacttaaccggtaaaccgttaacggtacgttccgggtacgtacccgttacgaccgtaaccttacttaccggtttcttacccgttcgttaaccccg

SEQ ID NO: 123894 - DNA, 697 bp, Homo sapiens
  misc_feature: GYAE6OF01DFOPH.10.9.A09.1.454.CMB.1.raw
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccagtgggtagtttgggcttgtaacgttcgggtttttcctcggtttgtcttacgttttaaggaggttcgtcctagttgtacaaagttcgacctaagttgggtgggagttcgggtaggggggacggtcggttacgtccgacggtccgtagggggacgtcgacgaggacgtaccttctccgttggacgcgacgtccgttcgttcgggttacctacccgtttgaagtcgtccgtacggcagtcgcgtacgtcggacccaccaactccgaggacgaaggtgtagggngtcgggntacgtattgttacngttcgaggtggcttaggttacgttaacgagtttggtagtcgcgtggtccggtacggtacgaacggtcctatccgaactctctcgaaacgactaccacgtaccaaagactaactaagttcgttacgttacggactacgtaacctacgttaccgtacgtcgtaggaacggtcgtacgttagtaacctcgttaggaacggtaacgggaaggggtacgggacacggggtacgttacgttaacgtagtttccgtacgttcggtcggtccggg

SEQ ID NO: 123895 - DNA, 530 bp, Homo sapiens
  misc_feature: GYAE6OF02I8P2M.10.9.A09.1.454.CMB.1.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (386)..(386): a, c, t, g, unknown or other
  misc_feature (386)..(386): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccnccaaactccaggcaagggnttgggagtgggtgctagttgttcatctggagggcagtgtcaatggtatgctgacgcgtgaggcgatcacntctcagacgacactccagaacacaatgtattggactgaacagacctaagtcctagacggacgacgggtgtatactagtggtaacggaagggagggggaaccgaggacgggacgttaccgaaggttaccgtcgttagacgttcgg

SEQ ID NO: 123896 - DNA, 505 bp, Homo sapiens
  misc_feature: GYAE6OF02HSM3C.10.9.A09.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgaagctggtaccaacacaaacctggccaggctccaggcccctnatctatggtgcatccaacagggccactggcatcccagccaggttcagtggcagtgggtatgggacagacttcactctcacatcatcagcctggagcctgaagtatgttgctagtttattactgtacaacntacgtacgngtcggccgtccggggcctcgttcgcccgtggaccgaagtggagatacgaacgaacgtgtgctgcacatctcgtctctac

SEQ ID NO: 123897 - DNA, 504 bp, Homo sapiens
  misc_feature: GYAE6OF02H08J1.10.9.A09.1.454.CMB.1.raw
  modified_base (202)..(202): a, c, t, g, unknown or other
  misc_feature (202)..(202): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttaattactgtacaactatacgtacgagtggccgtccggggccacgttcgcctggaccaagtgagagtacaaacgactgtgctgcaccatctntctntac

SEQ ID NO: 123898 - DNA, 566 bp, Homo sapiens
  misc_feature: GYAE6OF02H7WW8.10.9.A09.1.454.CMB.1.raw
  modified_base (240)..(240): a, c, t, g, unknown or other
  misc_feature (240)..(240): n is a, c, g, or t
  modified_base (290)..(290): a, c, t, g, unknown or other
  misc_feature (290)..(290): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcnccttgtaagctggtaccaacacaaacctggccaggctcccaggccccctnatctatggtgcatccaacagggccactggcatcccagccaggttcagtgcagtggtatgggacagacttcactctcaccatcatcagcctggancctgaagatgttgntagtttatttactgtacaaactataccgtacgtagtcgggtcccgtcccgggggcctaccgtttccgggaccccgtggggaaccctaaaggtcggagacgtaccgaaacggtaacgttggtacggtacctcggcctaaccgtacttaccgttcggttccttctaaccg

SEQ ID NO: 123899 - DNA, 551 bp, Homo sapiens
  misc_feature: GYAE6OF02I09TY.10.9.A09.1.454.CMB.1.raw
  modified_base (202)..(202): a, c, t, g, unknown or other
  misc_feature (202)..(202): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgaagctggtaccaacacaaacctggccaggctcccaggcccctcatctatggtgcatccaacacgggccactggcatcccagccaggttcagtgcaggtgggtatgggacagcttcactctcaccatcatcagcctgacgcctgaagatgtgctagtttatactgtcagtcagcgtgcctacgtttcggcggtaggttcgccgtaacgtttccggacgggtaccggaccgtaaagtacggaaggttaaccgaaacggaacgttcggtacggcgttacggaccctaccgtacttaccgtgttacccg

SEQ ID NO: 123900 - DNA, 862 bp, Homo sapiens
  misc_feature: GYAE6OF02FFD4V.10.9.A09.1.454.CMB.1.raw
tcagcatagtagtgcacgaccggtgctcgatttagcgagacgcgcgaggggctcgtgggagaggagcccagcactagaagtcggcggtgtttccattcggtgatcagcactgaacacagaggactcaccagtggtagttggctgtaacgttggtttcctcgttgtcttacgtttaaggaggtgtccaagtcgtacgaagtgacgtaacgtgggtaggacggtcggtgggggacgtcgtacgtccgaggccgtgggacgtcaacgagacgtacctccgtccgtgtcgacgtaccgtccgtcggttcggttacctaccgttacgtaacggtacgtaccgttaccggactacggtccgaccgtaccggtccggtaccccaaccgtaaaccgtcgaaggtacggtaagggtgtagggtaggttggtcgtacgttagttcgttacgagttcgtagggagtacgtagtcgtaacgtaggtcgtagtcggtacgtacggaccggtacggaacgggaccgtactaccgttaccgaaccgtacgtacccgaacgaacggtaaaccaaacccgtaacccgtaacggtaaacgtaacccgttaagtaacggttaacgtttaacggtacccgaaaccgttaacggaacccggtaacccgttaacggtttaaacccggtcccgggtaaagggaacccgtttaaccggggttaaccgttaagttaaccccggttaccgggtaaacgggttaaccgggggaaaaccgggggtaaccggggaacccgggttaaaccgtacggggttaacccgtttaacccgttacggttaaacccggtttccggttaccgggttaaccggttacccgggtacccgggg

SEQ ID NO: 123901 - DNA, 572 bp, Homo sapiens
  misc_feature: GYAE6OF02FVWKC.10.9.A09.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccattcagaatgttggcgccttcgtaagctggtaccaacacaaacctggaccaggcctacccaggccccctcactctatggtnctatccaacngggccatggcatcccagccaggttcagtcggcaggtgggtatgggacagacttcactcacaccatcatcagcctggacgcctagagtatgtgctagtttactactgtactaactatcgtacgtagtcggtccgtaccggggtacctacggttccggcccgtacgggtaaccaagggtacggacgtactaacgtaaaccggtaactcggtacggtactacggacctaccgtacgttaccgtcgttaccgttactacccg

SEQ ID NO: 123902 - DNA, 579 bp, Homo sapiens
  misc_feature: GYAE6OF02IMXHJ.10.9.A09.1.454.CMB.1.raw
  modified_base (173)..(173): a, c, t, g, unknown or other
  misc_feature (173)..(173): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggaggcgtagtccagcctgggaggtcacagagactctctgtgcagcctcgtgggttcaccttcagtagctacggcagtgcacgtcgggtcccgaccaaactccgaggacaaggggattgggaggtggggtgctaggtttgttacagttcgtaggagggctaggttcgttacaagttggtatgcgtgacgtccggtaggacgggcgtatccactatctcagacacaactccgagaacacattagtagttacgactagaacacgtactaacgtcgtagacggacgacggtatatactacgtaggtaacggaagggacgggggaacgaggacgggtacgttaccgaacgttaccgtacgttacgtacgtcgg

SEQ ID NO: 123903 - DNA, 568 bp, Homo sapiens
  misc_feature: GYAE6OF02HPYKZ.10.9.A09.1.454.CMB.1.raw
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagcctgggagtcacagagactctcctgtgcagcctcgtgggttccaccttcagtagctacggcatcgcacgtgggtcccnccaaactccgaggcgaagggattgggagtggggtgcgtagttgttcagtcgtggagggcaggtgttacaagtggtatgctggaccgccgtagacggccattcacntcncagacacactccgaagaacactaatgtattcggactagaacacgacctaagtccgtagaacggacgacgggtagtactacgtacgtaggtaacggaagggacgggggaaccgaggacgggtacgttaccgaagttaccgtcgtttacggacgttcgg

SEQ ID NO: 123904 - DNA, 578 bp, Homo sapiens
  misc_feature: GYAE6OF02I9JYN.10.9.A09.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (342)..(342): a, c, t, g, unknown or other
  misc_feature (342)..(342): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcaggccagtcagatgtgcncttganctgtaccacacaacctgccaggctcccagcccctnatctatggtgcatccaacacgggccacgtggcactcccagccaggtcagtgcagtggatgggacngactcactctcaccatcatcacgctggcgccgtagaagtatgttcgacttagtttaattcttgtacaactcgtaccgtacgagttccgggaccgtccggggtcctaccggtttccggcccgttacggaacccgtaaggttacgggacgtaacgtaccgtaaaacggtaccgttacgggtacggaccgttacggacccaccgttacgtaccgttacggtttccttacccgttaaccg

SEQ ID NO: 123905 - DNA, 776 bp, Homo sapiens
  misc_feature: GYAE6OF02GASQQ.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccgagccgtgggagtcacagagactctcctgtcgcacgtcctcgtgggttccaccgttcaggtacgcgtacggctagtcgctacgtcgggtcccaccgaaaccgtccgaggacgtaagggtacttgggaggtggggtggtaccgttaggtttcgtttcgagttccggtagggacgggtactaggtttcgttaacgtaaggttcgggttaattcggtacgtacggacccgggtacggtagggtaaccgggtaccgtaacgttacccgaaccgtacgttaccgtaccggaacggtaacgtaacccgtaaccgtaccggaaacggtaacctaacgttaaagttacgttaacggtttaccggtaaccgttacgaaaccgtacgtaaccgttaacggtaccgtacgggtaacggtaccggtaacgggtacgttaacgttaccggtaacggtaacgggtaaacggggtaacggggtaaaccgggggtaaccgtacgggtaccgggtaacgttaaccggtaaccggttaccgttaccggtttacggaccggttaccgggg

SEQ ID NO: 123906 - DNA, 619 bp, Homo sapiens
  misc_feature: GYAE6OF02F6MFQ.10.9.A09.1.454.CMB.1.raw
  modified_base (157)..(157): a, c, t, g, unknown or other
  misc_feature (157)..(157): n is a, c, g, or t
  modified_base (331)..(331): a, c, t, g, unknown or other
  misc_feature (331)..(331): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggtggagtcgtgggggagcgtagtccagcctgggagtcacgagagactctcctgtgcagcctcgtgggttcaccttcagtagctacggcagtgctacgtgggtcccgaccaaaaccgtccgaagggccaaggggnttgggagtggggtgctaggtttgtttcagttcgtggagggctaggttgttacgaaagttgggtatggctaggaccgtccggtggaacgggccgtagttccaccgtatccgaccgagacgaccacctacgaacggaacacgtaagtagttagttacggacctagaactacgtacctaacgtcctagacggacgtacgggtatacgtactacgtaggtaacggaagggtacggggaaccgaggacgggtacgttaccgtaacggttactaccgtttaggaccgttacggg

SEQ ID NO: 123907 - DNA, 729 bp, Homo sapiens
  misc_feature: GYAE6OF02ITD8R.10.9.A09.1.454.CMB.1.raw
  modified_base (485)..(485): a, c, t, g, unknown or other
  misc_feature (485)..(485): n is a, c, g, or t
tcagcatagtagtgcacgaccggtgctcgatttagcgagacgcgcagggggtagggaacgtgcgtcgagttaggacccagagggaaccatggaacgccccaggctcgagtccttctcttcctccctgctactctcggctcccagtttcagtactaccgaccgggagacgtatttggtgttgacacgagtctcccacgcctacctgttactttcgccctacgaagggaaacgcgcccaccgtctcctgcgagggcctagtacagagtcgttcggcctccttagaacgtctcggtaaccaacacgtaaccgtcggaccacggacctacccgacggaccccctacgacgtccgttagtcgggtacgtacctaacgttacccgaaaacgcgggtaccaacgtcgacctaccgtccgacggtacctaggtccaagggtccgagttaggtcggtacgtacggacgacggtactcgtacactaccgcgtacncgtactacgacgtcgacggtccgacgtacgtaagtgtcgtacgcgttaacgttactacgttacgtactaacgtacttaccgtacggtcggtacgtcccgggtaccggtacgttcccgttaccggaccggttaaccgggaacggtaacgtacggacggtaacggtaaccgaaacggtacgtccgggtaacgttccgtaccggtacgttaccgtaccgttacggttccgtaaccgtttcgaccccg

SEQ ID NO: 123908 - DNA, 674 bp, Homo sapiens
  misc_feature: GYAE6OF02GZI6P.10.9.A09.1.454.CMB.1.raw
  modified_base (175)..(175): a, c, t, g, unknown or other
  misc_feature (175)..(175): n is a, c, g, or t
  modified_base (279)..(279): a, c, t, g, unknown or other
  misc_feature (279)..(279): n is a, c, g, or t
  modified_base (340)..(340): a, c, t, g, unknown or other
  misc_feature (340)..(340): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaactggtggagtcgtgggggagcgtagtccaggccgtgggagtcacagagactctccgtgtgcagcctcgtgggttaccaccttnaagtagccgtaacggctatgccacgtcggggtcccaccaaacgtccgaaggcaaaggggtnttgggaggttggggtgctaggtttgtttacattcgtaggagggtctaggttgttacgaagttgggtatggacctaggaccgtcggtaggaacgggtccgtagttccaccgtactccgtccgagacgaccaacgtccgaagaacaactaagttagttaacgtttcgggaacctacgaacgtacgtaccgttaaacggttccgtaggaacggacgtaacgggtacttaacgtaccgttacgtacgggtaacggaaaggggtaccgggggaacgtacgggtaccgggtaacggttaccgtaaaccgttaccgttccgtttacggtcggttacccggg

SEQ ID NO: 123909 - DNA, 778 bp, Homo sapiens
  misc_feature: GYAE6OF02GV97Y.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagccgtgggaggtcacagacgactctcctgtgcagcctcgtgggttaccaccttgagtacgcgtacggcatgctacgtcgggtacccgaccctaaaaccgtccgacgggacgaaggggtacttgggaggttgggtaggccgttaaggttttcggtttacagttcggtaggaacgggtcctaaggtttcggttaacaaggttgggttatcggtaccgttggaacccggtccgggtaggaaccggggtccgtaacttcccgaacctacgttcccgtacctaaacggaacgaaccctaaaccgttacccgaaaggtaacctaacgtaagttacgttaacgtttaccggaacccttagaaaccgaccgtaccgttaaacggttcccgttaagggaaccggttaccggtaacggggttactttaacgttaccgttaggttaaccggggtaacgggtaaacggggggaccgggggtaaacccgtacggggaccggggttaacgttacccggttaaaccggttacccgttttacgggtttaccggtaaccgggttccgggg

SEQ ID NO: 123910 - DNA, 786 bp, Homo sapiens
  misc_feature: GYAE6OF02ICCWL.10.9.A09.1.454.CMB.1.raw
  modified_base (649)..(649): a, c, t, g, unknown or other
  misc_feature (649)..(649): n is a, c, g, or t
tcagcatagtagtgcacgaccggtgctcgatttagcgagacgcgcagggggctctgggagaggagcccagcactagaagtcggcggtgtttccattcggtgatcagcactgaacacagaggactcacatggagtttgggctgaacttgggttttcctcgttgcttcttttaagaggttcgtccagttgtacaagtgacaacttggtggagtcgtggggggagcgtagtccagccgtggggagtcacgagagactctctgtgactcgtctcttcggtctaccgttgacgtagtcgtacggctatcgacctacgtccgggtcccgacctaaacgtccgaggacgtaaggggtacgttgggaacggtgggggttacggccttagggttttactttcgacgtttacgtggggacggggtctaagggtttggtttaccaaaggtttgggttaactcggtacgtcggtaaccgggtccggtaaggggtacgggccgtagtacctaaccgtagttcccgtacgaaaggtaaccgaacctaaccgtaccggtaaacggtaaaccaaggttacgtacgttacgggttaaccgaacttaccggaaactaccggtaaccttaaggtaccgtacgggtaacggtaaccggtaacgggtttnttaaactaccgggttaacggtttaccggaacgggtaaaacgggggggtaccgggaaaccggtacggggtaaccgggtttaccggtaaccgggtaacggtttaaccgttaccggttttacggaacccgggtttcgggg

SEQ ID NO: 123911 - DNA, 545 bp, Homo sapiens
  misc_feature: GYAE6OF02FNBV0.10.9.A09.1.454.CMB.1.raw
  modified_base (205)..(205): a, c, t, g, unknown or other
  misc_feature (205)..(205): n is a, c, g, or t
tcagcatagtagtgcacgaccggtgctcgatttagcgagacgcgcaggggggaggaactgctcagttaggacccagagggaaccatggaagccccagctcagcttctcttcctcctgctactctggctcccagtttcagataccaccgggagagattgtgttgacacagtctccagccaccctgtctttgtctccagggggaaanagccaccctctcctgcagggccagtcagagtgttagcactaacttagtctggtaccaacagaaacctggccaggctcccaggctcctcatctatgaatgcatccacgagggccactggcatcccagcaggtctagtcggcagtgggtcgtgggacagacttcactcgtcaaccatccaccggcctacgaccctagaagtatttacgctagtttacttacttcgtctagcagcgtagctacgctcgccctcctccctctacgttcggccggtagggaccgtaggtggacggtacgacgtaaacgaacgttggtgacgtcgaccaccgacctcgtcttaccg

SEQ ID NO: 123912 - DNA, 816 bp, Homo sapiens
  misc_feature: GYAE6OF02GG06R.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcaccatggagtttggctgaacttgggttttcctcgttgcttcttttaagaggttgtccagtgtcaagtgcaacgtggtggagtcgtgggggagtcgtagtccgagccgtgggagtcacgagacgactcgtcctgtgcacgccgttcgtgggttaccaccgttcgagtacgcgtacggctacgtacgctacgtcggggtaccccgacctaaaccgtccgaagggaccgaaacgggtgttacgggaggttgggtcggacgttaggttttcggttaccagtttcgaggtacgggtcgtacggttagttacgaaggttggtagtcggacgttcggtaccgtccggtaagggtacgggtccgttaacgttccgaaccgtacgtaccgtaccgaacggtaaccgtaaccgaaccgtaccgaacggtaaacctaacgttaaacgttggtttaaccgttttaccgggaaccgttaacggaaacccgttaccgtaacccgtttaaacgtacccggttaagggtaaccgggtaaccgttaccgggttaacgttaaccgtttaccgttaacgggttaaccgggtaaccgggtaacggggttaaccggggtaacccgtaagggttacccgggttaaccggtttaaccggtaaacccggttttaccggtttaacccggttttacggtaacccgggtttcccgggg

SEQ ID NO: 123913 - DNA, 776 bp, Homo sapiens
  misc_feature: GYAE6OF02HFXWZ.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggaggcgtagtccagccgtgggagtcacgagagacctctcctgtcgcacgtccttcgtgggttccaccttcgagtacgccgtacggcagtcgctacgtcgggtcccaccctaaacctccgaggacgaagggtagttgggaggttggggtggtcttaggtttcgtttacagttcgtagggacgggtctaggtttcgttacgtaagttgggtaattggcttaggacccggttcggttagggaacggggtccctaagttacccgacccgtagttcccgtaccgaaacggtaaccaaccctaaacccggtacccgtaaaacgggtaacctaaaccgtaaagtttcggtttaaacgtttaaccgggtaaccttaacggtaaacccgtaaccgttaccgtaaccggttaccgtagggaaacgtacccggtaagggtttactaacgtttaccgtaacggttacgggtaaacgggtaaacggggggaacgggggtaaaccgtaggggtaaccggggtaacgtttaccggaaccggtttaccgttacccggttttaggacccggtttacgggg

SEQ ID NO: 123914 - DNA, 908 bp, Homo sapiens
  misc_feature: GYAE6OF02IH6N8.10.9.A09.1.454.CMB.1.raw
  modified_base (266)..(266): a, c, t, g, unknown or other
  misc_feature (266)..(266): n is a, c, g, or t
tcagcatagtagtgcacgaccggtgctcgatttagcgagacgcgcagggggctctgggagaggagcccagcactagaagtcggcggtgtttccattcggtgatcagcactgaacacagagactcaccatggagtttggctgaacttgggttttcctcgttgctcttttaagaggtgtccagtgtcaagtgctaacgtggtcggagtcgtgggggagcgtagtccaggccgtggggagtcaacgaggtacacttcttccgtgtacgnacgtcctcgttcggggttcctaccttacgacggtaacggtccgtaaccggtaccgtagttcggtaccgtaacccggttccggggttacccccgaacccgttaaaaaccccgtcccggtaacgggaaccggtaaaggggggtaacgttttacgggggtaagggtttacgggggtttcgggaccgtttaaggtttttccggttttaccgttaacgttccgttaagggcggggtaccgttaaggtttcggttaacgttaaaggttcgggttaactcgggtaacgttcggaacccggtacccggggttaacgggaaccggggtcccgttaaacgtttccccgaaaccgtaacccgtttacccgttaacccggtaaggacccgtaaaccggttaacccgttaaccggaaacggtaaaacctaacgtaaacgtttacggtttaacggttacggtaacccgtaacggaaccgtaacggtaacccgtttaaacggtccgtaacggttaaccggaacggttaccgggttaacgttaacgtaaccgttacggtaacggtaaacgggtaaacggggaacggggtaaacccgaacgggtacgggtaccgttaccggtaaacgttaccgtttacgttcccgggtacgttaccggg

SEQ ID NO: 123915 - DNA, 808 bp, Homo sapiens
  misc_feature: GYAE6OF02JP96M.10.9.A09.1.454.CMB.1.raw
tcagcatagtagtgcacgaccggtgctcgatttagcgagacgcgcagggggaggaactgctcagttaggacccagagggaaccatggaagccccagctcagcttctcttcctcctgctactctggcctccgacgtttcacgatacccgaccggagagtattggtagttgaccactagtctccacgtcccacccttgttctttcgtcgttccgaggggtaaagacgcccacccgttcctaccctgccgaacgggtccacgtacgtacggtaaacttggttacggccgtaccgttacgtaacgtccgttacggttaacccaaaccgtaaccaaaccggtcggacccgtacggtacccgtcccgacgggtcccccttacaacttaccgttaacgttcggtacgtacgtaaccgtaaccgtaacggtcggacccgtacgttacggccctaccgtaccccgaacggtccgttaacggtacgtcggtacggacgttagggtaggtaaccggttacggggaacacggttaacttcaacccgtttacgacccttacaacgtccaacgtccggtacgtccgtaggaccgtaccgtagtacgtcgttaggtcggttacttacgtttacttaacgtcgttaacgaaccgttacgtccgggttaacgcggttaccggttccggtacccgggttaaccgttcggttaccggcccgttaaaggaaccgttaacgggactaacgtaccgtaacggtaaacgtaacggttcggaaccgtcgttacccgaagacccgttcgtaccggtttctaccttcgtaaccc

SEQ ID NO: 123916 - DNA, 760 bp, Homo sapiens
  misc_feature: GYAE6OF02FKSM9.10.9.A09.1.454.CMB.1.raw
  modified_base (199)..(199): a, c, t, g, unknown or other
  misc_feature (199)..(199): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctcagccacctgtctttgctccaggggaaangccacctctcctgcagggccagtcagaatgttggcgccttcgtaagctggtaccaacacaaacctggccaggctccccaggcccctcatctatgggtcgcactacccgaacgacggggcctaacgtcggaccagtccccgaggaccctagggttcaggtcggcaggggtttgggtacgtacggggaactacggtaccttacgacttcctaccaaccctactctaacgtacgaacgcccgttagggacgtaccgtagaaacggtacgttcggttcgacgtttaacgttttaactttacgtttacggttaacccgaaacttacgtttacccggtaaccggttacggtacccgggttaccccggtacccggggggttacccgttaacccggttttcccgggtaccccgttacggggtaaacccggtaaaacggttcggggtaacggtaaccgtaaccggtaaaaaccgggttaaccggttacgggttccgggttaccgtaccggtaacccgtaacccgttaacggtttaccgtttaccgggtttacctttacccggttaacccg

SEQ ID NO: 123917 - DNA, 803 bp, Homo sapiens
  misc_feature: GYAE6OF02GRBQA.10.9.A09.1.454.CMB.1.raw
  modified_base (203)..(203): a, c, t, g, unknown or other
  misc_feature (203)..(203): n is a, c, g, or t
tcagcatagtagtgcacgaccggtgctcgatttagcgagacgcgcagggggaggaactgctcagttaggacccagagggaaccatggaagccccagctcagcttctcttcctcctgctactctggctcccagtttcagatacccaccggagagattgtgttgacacagtctccagccacctgtctttgtctccgaggggaaanacgcccaccctctcctgcagggccagtcagtaatggttcggccgtaccttcgaagtccgtacggtaacccaaacaaccaaaccgtcggacccgaggtccctaccccgaaccggtccccctacgacttccgtaacgttgggtcgtcctaactaccccgaaacggaacggggtcccctaacggtcggacctaaccgttccccgaccggacccgttaacgggttccgaaccggtggtaaccgtacggggttaggggttaacggtacggggaaccttaacggttacccttccgtaacccgtttacctacccgtaaaccctagtttacccaaggttcccaccgggtacccgttacgggaccgtacccgtaaggaacgtagtttcggtagtactttaagtttacttaccgtacgttaacaacgttacgtacggttaaccggtcggtacccgggtcccgggtacccgggggtccttaccgggtttccccgggtaccggttacgggtaaaccgaagggtcggaacgtaactaacccggaaacggtacggttcggtacgccgttcggacccttaaccggtgtttccgttacgttaccgttctaaccccg

SEQ ID NO: 123918 - DNA, 845 bp, Homo sapiens
  misc_feature: GYAE6OF02FY55T.10.9.A09.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (202)..(202): a, c, t, g, unknown or other
  misc_feature (202)..(202): n is a, c, g, or t
  modified_base (401)..(401): a, c, t, g, unknown or other
  misc_feature (401)..(401): n is a, c, g, or t
tcagcatagtagtgcacgaccggtgctcgatttagcgagacgcgcagggggctctgggagaggagcccagcactagaagtcggcggtgtttccattcggtgatcgagcactgaacacagaggactcaccatggagtttgggctgaacttgggttttccngttgcttctttaagnggtntccagtgtcaagtgcaacgttggnggagtcgtggggggagtcgtagtcccaggtccgtaggggacgtcacgagacgacttcgtcctggtcgcacgtccttcggtcgggttacctaccgtttacgaaggtacgtaccgtaccggctagtcgccgtacggtcgggtacccacctaaacgtcgaaggacgtaagggtcgttgggaggttgggagtcgttaggtttnttacagttcgaggacggtctaggttcgttacgaaggttcggtaagtcggtacgtacggaccggtacgggtagggtaacgggtaccggtacgttaccgtaacccgtaacgttacccgtaccggtaacggtaaccggtaacccgtaaacccgttaacccggaaaccggtaaaccgtaaacgttaaacgtttaacggtttaaccggtttacgggtaaacccgttaacggtaaaccggtaccggttaacccgttaaccggttaccgtaacgggtaaccggtaaccggtacgggttaacgttaaccgttaaccggttacggttaacgggtaaaccggggaaacggggttaaaccggggggtaaacccggtacggggtaaccggggttaaccgttaaccggttaaccggtttaccggtttaacccggtttacgggttaccggttaccggg

SEQ ID NO: 123919 - DNA, 713 bp, Homo sapiens
  misc_feature: GYAE6OF02F93M6.10.9.A09.1.454.CMB.1.raw
  modified_base (649)..(649): a, c, t, g, unknown or other
  misc_feature (649)..(649): n is a, c, g, or t
tcagcatagtagtgcacgaccggtgctcgatttagcgagacgcgcgagggggctctgggagaggagcccagcactagaagtcggcggtgtttccattcggtgatcagcactgaacacagaggactcaccatggagtttgggctgaacttgggttttcctcgttgtcttcttttaagaggtgtccagtgtcaagtgcaacgtggtggagtcggtgggggaggcgtagtccgagccgtgggacgtcacgagacgactcctccgtgtcgcacgtccttcgttcgggttcctaccgttcgaacggtagccgtacggctatcggcctacggtcgggtacccaccaaacctccgaggacgaagggagttgggacggtgggtagcgtagtttgttcagtcgtaggcgggtctaggttcgttagaagttggtatcgcgtggaccgtcggtaggacggcctagtccgacctctacgtaccgagtaccgaacctaaccgtaccgaacgaaccaacgttagttacgttaacggttccggaaacccttagaaaccgtaccggtaaccgttaaccggtaccgtagggaacggtaccggtaacgggtagttaaccttacgttaccggtaaggaacggggtaaagggaaccgggggtaaaccgngggtaaccgggtaaccgttaccggtaaccgttaccgtttccggtttacggtcccggttacgggg

SEQ ID NO: 123920 - DNA, 708 bp, Homo sapiens
  misc_feature: GYAE6OF02GKCCG.10.9.A09.1.454.CMB.1.raw
tcagcatagtagtgcacgaccggtgctcgatttagcgagacgcgcagggggctctgggagaggagcccagcactagaagtcggcggtgtttccattcggtgatcagcactgaacacagaggactcacctagtggagtttgggctgaacgttgggttttcctgttcgtcgttacttttaaggaggttgtcccaagttgtaccaagtcgcaacgtggtcggagttccgtagggggacgtccggtacgtccgaggccgtggggaagttcaaccggagacgaccttccgtccgtgtcgcgtacgtcctcggttaggttccaccttcgaagtacgtcgtacggctacgtcgacctacggttaccgggcctaacctaaaccgccggtaacggacgtaacgggtacggttcggtaaggttggggtacgtacgttaggtttcgttccgtactcggtaggtacggtacgtaggtttcgtaccgtaagtcggtatacgcgtacgtacgcgttagacggtactactacgtacctatccgtacgtacgactacgtacctacgaacgtactatacgttgtaacttcggaacagtacaccgtctaacgtcgtacgagtacggtaacggtataccgtacgtacggtacggaacggtaacgggacggtaaccgtcgggtaccggtacgttaccgaacgttccgtacgttacgacggttaccggg

SEQ ID NO: 123921 - DNA, 270 bp, Homo sapiens
  misc_feature: GYAE6OF01CJH5U.48.31.C09.1.454.CMB.1.raw
  modified_base (267)..(270): a, c, t, g, unknown or other
  misc_feature (267)..(270): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttcccgcatctgatatgtatactctgagcgggctggcaaggcgcatagnnnn

SEQ ID NO: 123922 - DNA, 271 bp, Homo sapiens
  misc_feature: GYAE6OF01B1SEO.48.31.C09.1.454.CMB.1.raw
  modified_base (268)..(271): a, c, t, g, unknown or other
  misc_feature (268)..(271): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttcccgccatctgatatgtatactctgagcgggctggcaaggcgcatagnnnn

SEQ ID NO: 123923 - DNA, 271 bp, Homo sapiens
  misc_feature: GYAE6OF01CXBZC.48.31.C09.1.454.CMB.1.raw
  modified_base (268)..(271): a, c, t, g, unknown or other
  misc_feature (268)..(271): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttccgccatctgatatgtatactctgagcggggctggcaaggcgcatagnnnn

SEQ ID NO: 123924 - DNA, 271 bp, Homo sapiens; identical to SEQ ID NO: 123922
  misc_feature: GYAE6OF01BTEMO.48.31.C09.1.454.CMB.1.raw
  modified_base (268)..(271): a, c, t, g, unknown or other
  misc_feature (268)..(271): n is a, c, g, or t

SEQ ID NO: 123925 - DNA, 270 bp, Homo sapiens
  misc_feature: GYAE6OF01CXZ0C.48.31.C09.1.454.CMB.1.raw
  modified_base (266)..(270): a, c, t, g, unknown or other
  misc_feature (266)..(270): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatctccgcatctgatatgtatactctgagcgggctggctaaggcgcatagnnnnn

SEQ ID NO: 123926 - DNA, 270 bp, Homo sapiens
  misc_feature: GYAE6OF01CDRCI.48.31.C09.1.454.CMB.1.raw
  modified_base (268)..(270): a, c, t, g, unknown or other
  misc_feature (268)..(270): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttcccgccatctgatatgtatactctgagcgggctggcaaggcgcatagnnn

SEQ ID NO: 123927 - DNA, 276 bp, Homo sapiens
  misc_feature: GYAE6OF01AC5NL.48.31.C09.1.454.CMB.1.raw
  modified_base (269)..(276): a, c, t, g, unknown or other
  misc_feature (269)..(276): n is a, c, g, or t
tcagagtatacatacacgaccggtgctcgatttagacgtctcatcaaggaaggaagggcaatggatccgggacagattttcggctcaccatcagcagtctacaacctgaagatttttgcaacctacttctgtcaccaggcttacaattcccctccgacgttcggccaagggaccaaggtggaagtcagacgaactgtggctgcaccatctgtcttcatcttcccgccatctgatatgtatactctgagcgggctggcaaggcgcatagnnnnnnnn

SEQ ID NO: 123928 - DNA, 292 bp, Homo sapiens
  misc_feature: GYAE6OF01CNSMO.48.31.C09.1.454.CMB.1.raw
  modified_base (245)..(245): a, c, t, g, unknown or other
  misc_feature (245)..(245): n is a, c, g, or t
  modified_base (276)..(292): a, c, t, g, unknown or other
  misc_feature (276)..(292): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttaacaactttccccctccgacgttcggaccaagggaccaaggtggaagtcagacgaactgtggctgcaccatctgtcttcatctccgcatctgatatgtatactntgagcgggtctaggcaaaggcgcaattaggnnnnnnnnnnnnnnnnn

SEQ ID NO: 123929 - DNA, 577 bp, Homo sapiens
  misc_feature: GYAE6OF01C105F.48.31.C09.1.454.CMB.1.raw
  modified_base (222)..(222): a, c, t, g, unknown or other
  misc_feature (222)..(222): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (401)..(401): a, c, t, g, unknown or other
  misc_feature (401)..(401): n is a, c, g, or t
  modified_base (462)..(462): a, c, t, g, unknown or other
  misc_feature (462)..(462): n is a, c, g, or t
tcagagtatacatacacgaccggtgctcgatttagacgtctcatcaaggaaggaagggcaatggatccgggacagatttcggctcaccatcagcagtctacaactgaagattttgcaactacttctgtcaccaggcttacaacttccctacgacgttcggaccaagggaccaaggtggaacgtcagacgactgtgctgctacgatctgtctcactcctccgntactctacgaatacgtagttaactacgtcgtacgacggcggtatacgggaccgaaacggcgtacaaattcggatcgacncgacacncngactntcgatgcgacgtcagntacagtctancanactacganactacgtagcgacgagtacgagtacgtcgactatacgactacacactanacgtacgactacgtacgactacgtacgacgtactacgtacgtactactactacgtacgtanacgtacgtacgtacgacgtacgtactacgtacgtacgtacgtacgtacgtacgtacgacgtacgtacgtagtacggtacgtacgtagtacgtacgacgtagtacgtgtacgtacg

SEQ ID NO: 123930 - DNA, 270 bp, Homo sapiens; identical to SEQ ID NO: 123921
  misc_feature: GYAE6OF02GS5LN.48.31.C09.1.454.CMB.1.raw
  modified_base (267)..(270): a, c, t, g, unknown or other
  misc_feature (267)..(270): n is a, c, g, or t

SEQ ID NO: 123931 - DNA, 272 bp, Homo sapiens
  misc_feature: GYAE6OF02GDZ32.48.31.C09.1.454.CMB.1.raw
  modified_base (269)..(272): a, c, t, g, unknown or other
  misc_feature (269)..(272): n is a, c, g, or t
tcagagtatacatacacgaccggtgctcgatttagacgtctcatcaaggaaggaagggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatccttcccgccatctgatatgtatactctgagcgggctggcaaggcgcatagnnnn

SEQ ID NO: 123932 - DNA, 170 bp, Homo sapiens
  misc_feature: GYAE6OF01CEE8Z.37.38.D05.1.454.CMB.1.raw
  modified_base (170)..(170): a, c, t, g, unknown or other
  misc_feature (170)..(170): n is a, c, g, or t
tcagtagtgtagatcacgaccggtgctcgatttagtatctgatagttgggtttgggtttggtggtctccactcccgccttgacgggctgccatctgccttccaaccccactgtcactctgttcccgccctcctcatctacactactgagcgggctggcaaggcgcatagn

SEQ ID NO: 123933 - DNA, 170 bp, Homo sapiens
  misc_feature: GYAE6OF01CM1HO.37.38.D05.1.454.CMB.1.raw
  modified_base (170)..(170): a, c, t, g, unknown or other
  misc_feature (170)..(170): n is a, c, g, or t
tcagtagtgtagatcacgaccggtgctcgatttagtatctgatagttgggtttggggttggtggtctccactcccgccttgacgggctgccatctgccttccaaccccactgtcactctgttcccaccctcctcatctacactactgagcgggctggcaaggcgcatagn

SEQ ID NO: 123934 - DNA, 170 bp, Homo sapiens
  misc_feature: GYAE6OF01DQP1C.37.38.D05.1.454.CMB.1.raw
  modified_base (169)..(170): a, c, t, g, unknown or other
  misc_feature (169)..(170): n is a, c, g, or t
tcagtagtgtagatcacgaccggtgctcgatttagtatctgatagttgggttggggttggtggtctccactcccgccttgacgggctgccatctgccttccaaccccactgtcactctgttcccgccctcctcatctacactactgagcgggctggcaaggcgcatagnn

SEQ ID NO: 123935 - DNA, 171 bp, Homo sapiens
  misc_feature: GYAE6OF01DUNYU.37.38.D05.1.454.CMB.1.raw
  modified_base (171)..(171): a, c, t, g, unknown or other
  misc_feature (171)..(171): n is a, c, g, or t
tcagtagtgtagatcacgaccggtgctcgatttagtatctgatagttgggtttggggtttggtggtctccactcccgccttgacgggctgccatctgccttccaaccccactgtcactctgttcccaccctcctcatctacactactgagcgggctggcaaggcgcatagn

SEQ ID NO: 123936 - DNA, 450 bp, Homo sapiens
  misc_feature: GYAE6OF01ASHLM.37.38.D05.1.454.CMB.1.raw
  modified_base (436)..(450): a, c, t, g, unknown or other
  misc_feature (436)..(450): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactatactgtcagacgtgggacagcaatactgcacaacaggtcttcggaactgggaccagggtcatcgtcctaggtcagcccaaggccaaccccatcgtcactctcgttcccaccctcctcatctacactactgagcggctggcaaggcgcatagnnnnnnnnnnnnnnn

SEQ ID NO: 123937 - DNA, 171 bp, Homo sapiens
  misc_feature: GYAE6OF01CTPLY.37.38.D05.1.454.CMB.1.raw
  modified_base (170)..(171): a, c, t, g, unknown or other
  misc_feature (170)..(171): n is a, c, g, or t
tcagtagtgtagatcacgaccggtgctcgatttagtatctgatagttgggtttggggttggtggtctccactcccgccttgacgggctgccatctgccttccaaccccactgtcactctgttcccaccctcctcatctacactactgagcgggctggcaaggcgcatagnn

SEQ ID NO: 123938 - DNA, 172 bp, Homo sapiens
  misc_feature: GYAE6OF01ASUKO.37.38.D05.1.454.CMB.1.raw
  modified_base (172)..(172): a, c, t, g, unknown or other
  misc_feature (172)..(172): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccgccctcctcatctacactactgagcgggctggcaaggcgcatagn

SEQ ID NO: 123939 - DNA, 177 bp, Homo sapiens
  misc_feature: GYAE6OF01B6TAV.37.38.D05.1.454.CMB.1.raw
  modified_base (170)..(177): a, c, t, g, unknown or other
  misc_feature (170)..(177): n is a, c, g, or t
tcagtagtgtagatcacgaccggtgctcgatttagtatctgatagttgggttggggtttggtggtctccactcccgccttgacgggctgccatctgccttccaaccccactgtcactctgttcccaccctcctcatctacactactgagcgggctggcaaggcgcatagnnnnnnnn

SEQ ID NO: 123940 - DNA, 456 bp, Homo sapiens
  misc_feature: GYAE6OF01DXWVD.37.38.D05.1.454.CMB.1.raw
  modified_base (443)..(456): a, c, t, g, unknown or other
  misc_feature (443)..(456): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcggacccaggctatggatgaggctgactattactgtcagacgtgggacagcaatactgcacaacaggtcttcggaactgggaccagggtcatcgtcctaggtcacgcccaaggcccaacccatcgtccacttctcgttccccaccctcctccatcctacactactgacgcggctggcaaggcacatagnnnnnnnnnnnnnn

SEQ ID NO: 123941 - DNA, 449 bp, Homo sapiens
  misc_feature: GYAE6OF01B2OLP.37.38.D05.1.454.CMB.1.raw
  modified_base (439)..(449): a, c, t, g, unknown or other
  misc_feature (439)..(449): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtgggacagcaatactgcacaacaggtcttcggaactgggaccagggtcatcgtcctaggtcagcccaaggcccaacccactgtcactctcgttcccaccctcctcatctacactactgacgcgggctggcaaggcgcatagnnnnnnnnnnn

SEQ ID NO: 123942 - DNA, 445 bp, Homo sapiens
  misc_feature: GYAE6OF01CP2GQ.37.38.D05.1.454.CMB.1.raw
  modified_base (439)..(445): a, c, t, g, unknown or other
  misc_feature (439)..(445): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagcccaaggcccaaccccactgtcactctgttcccaccctcctcatctacactactgagcgggctggcaaggcgcatagnnnnnnn

SEQ ID NO: 123943 - DNA, 172 bp, Homo sapiens
  misc_feature: GYAE6OF01AW9DL.37.38.D05.1.454.CMB.1.raw
  modified_base (172)..(172): a, c, t, g, unknown or other
  misc_feature (172)..(172): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccaccctcctcatctacactactgagcgggctggcaaggcgcatagn

SEQ ID NO: 123944 - DNA, 170 bp, Homo sapiens
  misc_feature: GYAE6OF01ETZ7H.37.38.D05.1.454.CMB.1.raw
  modified_base (170)..(170): a, c, t, g, unknown or other
  misc_feature (170)..(170): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccgcccctcatctacactactgagcgggctggcaaggcgcatagn

SEQ ID NO: 123945 - DNA, 170 bp, Homo sapiens
  misc_feature: GYAE6OF01BJDT0.37.38.D05.1.454.CMB.1.raw
tcagtagtgtagatcacgaccggtgctcgatttagtatctgatagttgggtttggggtttggtggtctccactcccgccttgacgggctgccatctgccttccaaccccactgtcactctgttcccaccctcctcatctacactactgagcgggctggcaaggcgcatag

SEQ ID NO: 123946 - DNA, 173 bp, Homo sapiens
  misc_feature: GYAE6OF01C1B1R.37.38.D05.1.454.CMB.1.raw
  modified_base (173)..(173): a, c, t, g, unknown or other
  misc_feature (173)..(173): n is a, c, g, or t
tcagtagtgtagatcacgaccggtgctcgatttagtatctgatagttgggtttgggggtttggtggtctccactcccgccttgacggggctgccatctgccttccaaccccactgtcactctgttcccgccctcctcatctacactactgagcgggctggcaaggcgcatagn

SEQ ID NO: 123947 - DNA, 180 bp, Homo sapiens
  misc_feature: GYAE6OF01B91XG.37.38.D05.1.454.CMB.1.raw
  modified_base (172)..(180): a, c, t, g, unknown or other
  misc_feature (172)..(180): n is a, c, g, or t
tcagtagtgtagatcacgaccggtgctcgatttagtatctgatagttgggtttggggtttggtggtctccactcccgccttgacggggctgccatctgccttccaaccccactgtcactctgttcccgccctcctcatctacactactgagcgggctggcaaggcgcatagnnnnnnnnn

SEQ ID NO: 123948 - DNA, 550 bp, Homo sapiens
  misc_feature: GYAE6OF01BK223.37.38.D05.1.454.CMB.1.raw
  modified_base (197)..(197): a, c, t, g, unknown or other
  misc_feature (197)..(197): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccaccatcacctgctctggagatgaattgggaaataatatgcttgctggtatcagcagaagccgggccagtcccctgtgctggtcatctatcaagataagaagcgggacctcgagggactccctaggacgcgattctctggctccaacgtccgggaacacgacgccaccctcgaccatcacgcggacccaggctagtgatgaggtctagtactattactgtacagacgtaggacagacaatactgacaacaacgacggtccttacggaacgttgggaccctaggggtccaacgttccggtaccgttacgggtaccgaacggtaccccaacgggcccctaaacccccg

SEQ ID NO: 123949 - DNA, 452 bp, Homo sapiens
  misc_feature: GYAE6OF01AU7ET.37.38.D05.1.454.CMB.1.raw
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (442)..(452): a, c, t, g, unknown or other
  misc_feature (442)..(452): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtgggacagcaatactgcacaacaggtctcggaactgggaccagggtcatcgtcctaggtcagcccaaggcccaaccccactgtccactctcgttccccaccctcctcatcctacactacngagccgggctggcaaggcncatagnnnnnnnnnnn

SEQ ID NO: 123950 - DNA, 445 bp, Homo sapiens
  misc_feature: GYAE6OF01AT3LM.37.38.D05.1.454.CMB.1.raw
  modified_base (413)..(413): a, c, t, g, unknown or other
  misc_feature (413)..(413): n is a, c, g, or t
  modified_base (437)..(445): a, c, t, g, unknown or other
  misc_feature (437)..(445): n is a, c, g, or t
tcagtagtgtagatcacgaccggtgctcgatttagtatctgatagttgggtttggccagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtctaggtcagcccaaggccaacccactgtcactctgttccccgccctcctcatctacactacngagcgggctggcaaggcgcatagnnnnnnnnn

SEQ ID NO: 123951 - DNA, 173 bp, Homo sapiens; identical to SEQ ID NO: 123946
  misc_feature: GYAE6OF01ATKF2.37.38.D05.1.454.CMB.1.raw
  modified_base (173)..(173): a, c, t, g, unknown or other
  misc_feature (173)..(173): n is a, c, g, or t

SEQ ID NO: 123952 - DNA, 496 bp, Homo sapiens
  misc_feature: GYAE6OF01EVLXV.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcggcctcgagggatccctgagcgattctctggctccaactccgggaacacacgccacctgaccatcagcggaccaggctatgatgagctgactatactgtcagacgtggacagcaatactgcacaacaggtctacggaacgtcgggaccagggtcagtcgtccgtaggcagcccaaggcccaaaccccg

SEQ ID NO: 123953 - DNA, 172 bp, Homo sapiens; identical to SEQ ID NO: 123938
  misc_feature: GYAE6OF01B3H9P.37.38.D05.1.454.CMB.1.raw
  modified_base (172)..(172): a, c, t, g, unknown or other
  misc_feature (172)..(172): n is a, c, g, or t

SEQ ID NO: 123954 - DNA, 182 bp, Homo sapiens
  misc_feature: GYAE6OF01C43LQ.37.38.D05.1.454.CMB.1.raw
  modified_base (172)..(182): a, c, t, g, unknown or other
  misc_feature (172)..(182): n is a, c, g, or t
tcagtagtgtagatcacgaccggtgctcgatttagtatctgataggttgggtttgggggttggtggtctccactcccgccttgacgggctgccatctgccttccaaccccactgtcactctgttcccgccctcctcatctacactactgagcgggctggcaaggcgcatagnnnnnnnnnnn

SEQ ID NO: 123955 - DNA, 184 bp, Homo sapiens
  misc_feature: GYAE6OF01C3311.37.38.D05.1.454.CMB.1.raw
  modified_base (172)..(184): a, c, t, g, unknown or other
  misc_feature (172)..(184): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccgccctcctcatctacactactgagcgggctggcaaggcgcatagnnnnnnnnnnnnn

SEQ ID NO: 123956 - DNA, 444 bp, Homo sapiens
  misc_feature: GYAE6OF01BVWJ3.37.38.D05.1.454.CMB.1.raw
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (435)..(444): a, c, t, g, unknown or other
  misc_feature (435)..(444): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagccgggacccaggctatggatgaggctgactatactgtcagacgtgggacagcaatactgacacaacgaggtcttcggaactgggaccagggtcatcgtcgtagtcagcccaaggcccaacccntgtcactctcgtccccncctcncactccacactacngacgcggctgacagcacatgnnnnnnnnnn

SEQ ID NO: 123957 - DNA, 172 bp, Homo sapiens
  misc_feature: GYAE6OF01DCTEP.37.38.D05.1.454.CMB.1.raw
tcagtagtgtagatcacgaccggtgctcgatttagtatctgatagttgggtttgggggtttggtggtctccactcccgccttgacggggctgccatctgccttccaaccccactgtcactctgttcccgccctcctcatctacactactgagcgggctggcaaggcgcatag

SEQ ID NO: 123958 - DNA, 457 bp, Homo sapiens
  misc_feature: GYAE6OF01CW2LX.37.38.D05.1.454.CMB.1.raw
  modified_base (440)..(440): a, c, t, g, unknown or other
  misc_feature (440)..(440): n is a, c, g, or t
  modified_base (445)..(457): a, c, t, g, unknown or other
  misc_feature (445)..(457): n is a, c, g, or t
tcagtagtgtagatcacgaccggtgctcgatttagtatctgatagttgggtttgggcagtgtccgtgtccccgggacagacagccaccatcacctgctctggagatgaattggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtgggacagcaatactgcaacaacaggtcttcggaactgggaccagggtcatcgtctaggtcagcccaaggcccaacccactgtcactctcgttccccacccttcctcactcctacactacctgacgcgggctggcaaggccganatagnnnnnnnnnnnnn

SEQ ID NO: 123959 - DNA, 445 bp, Homo sapiens
  misc_feature: GYAE6OF01C8K8R.37.38.D05.1.454.CMB.1.raw
  modified_base (399)..(399): a, c, t, g, unknown or other
  misc_feature (399)..(399): n is a, c, g, or t
  modified_base (437)..(445): a, c, t, g, unknown or other
  misc_feature (437)..(445): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgctaggtcagcccaaggcccaacccactgtcactctgttcccgccctccncatctacacactgagcgggctcggcaaggcgacatagnnnnnnnnn

SEQ ID NO: 123960 - DNA, 173 bp, Homo sapiens
  misc_feature: GYAE6OF01EEB3Q.37.38.D05.1.454.CMB.1.raw
  modified_base (172)..(173): a, c, t, g, unknown or other
  misc_feature (172)..(173): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccgccctcctcatctacactactgagcgggctggcaaggcgcatagnn

SEQ ID NO: 123961 - DNA, 453 bp, Homo sapiens
  misc_feature: GYAE6OF01B4FP4.37.38.D05.1.454.CMB.1.raw
  modified_base (443)..(453): a, c, t, g, unknown or other
  misc_feature (443)..(453): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtctcggaactgggaccagggtcatcgtctaggtcagcccaaggcccaacccactcgcacctctcgttccccgccctcctcatcctacactactgacgcgggctcggcaagggcgcatagnnnnnnnnnnn

SEQ ID NO: 123962 - DNA, 173 bp, Homo sapiens
  misc_feature: GYAE6OF01D2HNI.37.38.D05.1.454.CMB.1.raw
  modified_base (173)..(173): a, c, t, g, unknown or other
  misc_feature (173)..(173): n is a, c, g, or t
tcagtagtgtagatcacgaccggtgctcgatttagtatctgatagttgggtttgggggtttggtggtctccactcccgccttgacggggctgccatctgccttccaaccccactgtcactctgttcccaccctcctcatctacactactgagcgggctggcaaggcgcatagn

SEQ ID NO: 123963 - DNA, 180 bp, Homo sapiens
  misc_feature: GYAE6OF01CJZQ8.37.38.D05.1.454.CMB.1.raw
  modified_base (170)..(180): a, c, t, g, unknown or other
  misc_feature (170)..(180): n is a, c, g, or t
tcagtagtgtagatcacgaccggtgctcgatttagtatctgatagttgggtttgggggttgtggtctccactcccgccttgacgggctgccatctgccttccaaccccactgtcactctgttcccgccctctcatctacactactgagcgggctgggcaaggcgcatagnnnnnnnnnnn

SEQ ID NO: 123964 - DNA, 452 bp, Homo sapiens
  misc_feature: GYAE6OF01C75OR.37.38.D05.1.454.CMB.1.raw
  modified_base (320)..(320): a, c, t, g, unknown or other
  misc_feature (320)..(320): n is a, c, g, or t
  modified_base (377)..(377): a, c, t, g, unknown or other
  misc_feature (377)..(377): n is a, c, g, or t
  modified_base (438)..(438): a, c, t, g, unknown or other
  misc_feature (438)..(438): n is a, c, g, or t
  modified_base (443)..(452): a, c, t, g, unknown or other
  misc_feature (443)..(452): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatctgcacaacnggtcttcggaactgggaccagggtcatcgtcctaggtcagcccaaggcccaaccccnctgtccaccttctcgttccccgccctcctcatcctacactactgacgcggctggcaaggcncatgnnnnnnnnnn

SEQ ID NO: 123965 - DNA, 465 bp, Homo sapiens
  misc_feature: GYAE6OF01EXRTR.37.38.D05.1.454.CMB.1.raw
  modified_base (400)..(400): a, c, t, g, unknown or other
  misc_feature (400)..(400): n is a, c, g, or t
  modified_base (440)..(450): a, c, t, g, unknown or other
  misc_feature (440)..(450): n is a, c, g, or t
  modified_base (452)..(465): a, c, t, g, unknown or other
  misc_feature (452)..(465): n is a, c, g, or t
tcagtagtgtagatcacgaccggtgctcgatttagtatctgatagttgggtttgggacagtgtccgtgtccccgggacagacagccaccatcacctgctctggagatgaattgggaaataatatgcttgctggtatcagcagaagccggccagtcccctgtgctggtcatctatccaagataagaagcgggcctcagggatccctgagcgattctctggctccaactccgggaacacagccacctgaccatcagcggacccagctatggatgaggctgactatactgtcagacgtggacagcaatactgcacaacgaggtcttcggaactgggaccagggtcatcgtcctaggtcagcccaaggcccaacccactcgtcactctcgttcccacccttccncactctacactactgacgcggctggactaaggcacatagnnnnnnnnnnngnnnnnnnnnnnnnn

SEQ ID NO: 123966 - DNA, 504 bp, Homo sapiens
  misc_feature: GYAE6OF01EFOAU.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccggccagtcccctgtgctggtcatctatcaagataagaagcgggcctcagggatccctgagcgattctctggctccaactccgggaacacagccacctgaccatcagcgggacccaggctatggatgagctgactattactgtcagacgtgggacagacaatactgacacaacgaggtccttacggaacgtcgggacagggtcagtcgtccctaggtcagcccaaggcccaaaccccg

SEQ ID NO: 123967 - DNA, 449 bp, Homo sapiens
  misc_feature: GYAE6OF01BA33U.37.38.D05.1.454.CMB.1.raw
  modified_base (376)..(376): a, c, t, g, unknown or other
  misc_feature (376)..(376): n is a, c, g, or t
  modified_base (433)..(433): a, c, t, g, unknown or other
  misc_feature (433)..(433): n is a, c, g, or t
  modified_base (438)..(449): a, c, t, g, unknown or other
  misc_feature (438)..(449): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagcccaccctgaccatcagcggacccaggctatggatgaggctgactattactgtcagacgtgggacagcaatactgcacaacaggtcttcggaactgggaccagggtcatcgtctagtcagcccaaggcccaaccccnctcgtcactctcgttcccgccctcctcatcctacactactgacgcggctgcaaggcncatgnnnnnnnnnnnn

SEQ ID NO: 123968 - DNA, 497 bp, Homo sapiens
  misc_feature: GYAE6OF01AS8TV.37.38.D05.1.454.CMB.1.raw
  modified_base (441)..(441): a, c, t, g, unknown or other
  misc_feature (441)..(441): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtccccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacacnggtctcggaactgggaccagggtcagtcgtcctaggtcagcccaaggccaaccccg

SEQ ID NO: 123969 - DNA, 457 bp, Homo sapiens
  misc_feature: GYAE6OF01A1NR5.37.38.D05.1.454.CMB.1.raw
  modified_base (440)..(457): a, c, t, g, unknown or other
  misc_feature (440)..(457): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagcccaaggcccaaccccactgtcactctcgttcccgccctcctcatctacactactgacgcggctggcaaggcgcatagnnnnnnnnnnnnnnnnnn

SEQ ID NO: 123970 - DNA, 504 bp, Homo sapiens
  misc_feature: GYAE6OF01D0D7X.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccgggccagtcccctgtgctggtcatctatcaagataagaagcgggcctcgagggatccctgagcgattctctggctccaactccgggaacacagccacctgaccatcagcggacccaggctatggatgaggctgactattactgtcagacgtgggacagacaatactgcaacaacaggtcttacggaacgtgggaccagggtcagtcgtacgtagtcagcccaaggccctaaccccg

SEQ ID NO: 123971 - DNA, 555 bp, Homo sapiens
  misc_feature: GYAE6OF01BA6OE.37.38.D05.1.454.CMB.1.raw
  modified_base (403)..(403): a, c, t, g, unknown or other
  misc_feature (403)..(403): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccggccagtcccctgtgctggtcatctatcaagataagaagcgggcctacgagggactcccgtgagcgattctctggctccaacgtccgggaacacgacgcccaccctcgaccactcacgccgggaacccaggctagnggatgatgctgactattactgtcagacgtggacagactaatacctagaccaacaaacgtacggtaccgttacgggaaaccgtggggaacccgtagggtaccagttcccgttaccgtacgggtaccaaccggccccgaaacgggtaacccccc

SEQ ID NO: 123972 - DNA, 319 bp, Homo sapiens
  misc_feature: GYAE6OF01BWWWF.37.38.D05.1.454.CMB.1.raw
  modified_base (314)..(319): a, c, t, g, unknown or other
  misc_feature (314)..(319): n is a, c, g, or t
tcagtagtgtagatcacgaccggtgctcgatttagtatctgatagttgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccctggaaccagcagtgacgttggtcagcccaaggctcgccccctcggtcactctcgttcccgcctcctcatctacactactgagcgggctggcaaggcgcatagnnnnnn

SEQ ID NO: 123973 - DNA, 514 bp, Homo sapiens
  misc_feature: GYAE6OF01AVW5E.37.38.D05.1.454.CMB.1.raw
  modified_base (447)..(447): a, c, t, g, unknown or other
  misc_feature (447)..(447): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccggccagtcccctgtgctggtcatctatcaagataagaagcgggcctcgagggactccctgagcgattctctggctccaactccgggaacacacgccaccctgaccatccagcgggacccaggctagtggatgaggctgactattactgtcagcgtgggacagacaatactgacaacaacnggttactacggaacgtgggacccagggtcacgttccgtccgtagtcagcccaaaggccctaaccccg

SEQ ID NO: 123974 - DNA, 586 bp, Homo sapiens
  misc_feature: GYAE6OF01D9R0A.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaacgccgggccacgtcccctgtcgcgtggtcatctatacaagataagaaggcgggcctcgagggactcccgtggacgcgtattcctcgtcggcctaccgaaccgtcccgggaacacacgcccaccctgacccatccgacggaccgggacccaggacctagtggagtcgaggtctagtacttagttactgtacgacgacggtaggacacgacaatacgtgacacaacgtcggtaccgttacggaaccgtcggggacccgtagggtaccacgttaccggtaccgtacgggtaccgaaccgaccccgaaacgggcccctaaaccccg

SEQ ID NO: 123975 - DNA, 174 bp, Homo sapiens
  misc_feature: GYAE6OF01CASEL.37.38.D05.1.454.CMB.1.raw
  modified_base (173)..(174): a, c, t, g, unknown or other
  misc_feature (173)..(174): n is a, c, g, or t
tcagtagtgtagatcacgaccggtgctcgatttagtatctgatagttgggtttgggggtttggtggtctccactcccgccttgacggggctgccatctgccttccaaccccactgtcactctgttcccaccctcctcatctacactactgagcgggctggcaaggcgcatagnn

SEQ ID NO: 123976 - DNA, 548 bp, Homo sapiens
  misc_feature: GYAE6OF01DKYGH.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccggccagtcccctgtgctggtcatctatcaagataagaagcgggcctcgagggatccctgagcgattctctggcctccaacgtccgggaaacacgacgcccaccctgacccatcacggccgggacccaggctagtggatgaggctgacttattacgtgtacgaggacgtaggacagacaatacgagacaacacgtacggttcgttaccggacggtacgggacggtacggtacacgttccgtaccgttacgtacgaccggacccgaaccgcccctaaaccccg

SEQ ID NO: 123977 - DNA, 173 bp, Homo sapiens; identical to SEQ ID NO: 123960
  misc_feature: GYAE6OF01BIMOM.37.38.D05.1.454.CMB.1.raw
  modified_base (172)..(173): a, c, t, g, unknown or other
  misc_feature (172)..(173): n is a, c, g, or t

SEQ ID NO: 123978 - DNA, 678 bp, Homo sapiens
  misc_feature: GYAE6OF01BY4O7.37.38.D05.1.454.CMB.1.raw
tcagtagtgtagatcacgaccggtgctcgatttagtatctgatagttgggtttgggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcactgctctggagatgaattagggaaaataaatatgcttgctggtatcagcaggaacgccgggccacgtcccctgtcgctggtcatctatacaagtataagagcgggactacgagggactcccgtagacgtcgtaattcgtcgtcggacctacccgaaacgtacccgggaaacaccgaaccggcccctacccgacgacccagtaccgacggacccgggaccctagggccttaagtagggagttcgggaacgggtacttacggtaactaagtttaccgtagtaccaagggtaccggtagggaaccaaggacctaaagtaccgtacgacctaaccgaacgtaaccggttaccgttaaccggggtaaaccgttccgggggaacccggtacggggttcctaacggttccccggttaacccgtacgggttacccaacccggtacccccgaaacggggcccccctaaaacccccg

SEQ ID NO: 123979 - DNA, 494 bp, Homo sapiens
  misc_feature: GYAE6OF01BJZOB.37.38.D05.1.454.CMB.1.raw
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtccccctgtgctggtcatctatcaagataagaagcgggcctcagggatcctgagcgattctctggctccaactccgggaacacagccacctgaccatcagcggacccaggctatggatgagctgactattactgtcagacgtggacagcaatacngcacacagtctacggaacgtgggaccngggtcagtctccgtaggtcagcccaaggcccaaccccg

SEQ ID NO: 123980 - DNA, 173 bp, Homo sapiens; identical to SEQ ID NO: 123946
  misc_feature: GYAE6OF01A9CIB.37.38.D05.1.454.CMB.1.raw
  modified_base (173)..(173): a, c, t, g, unknown or other
  misc_feature (173)..(173): n is a, c, g, or t

SEQ ID NO: 123981 - DNA, 113 bp, Homo sapiens
  misc_feature: GYAE6OF01CWHQT.37.38.D05.1.454.CMB.1.raw
tcagtagtgtagatcacgaccggtgctcgatttagtatctgatagttgggtttgggctgggcctcaggaagcagcatcggaggtgcctcagccatggcatggatccccctctt

SEQ ID NO: 123982 - DNA, 569 bp, Homo sapiens
  misc_feature: GYAE6OF01EA2F7.37.38.D05.1.454.CMB.1.raw
  modified_base (412)..(412): a, c, t, g, unknown or other
  misc_feature (412)..(412): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaacgccggccacgtcccctgtcgctggtcatctatacaagataagaagcgggcctcgaggactcctagagcgtattctcgtggcctaccaacgtcccgggaaacacacgcccaccctcgaacccatccgacggccgggacccaggctagnggatggagctgactattactgtcaggtacggtagggacacggactaatacgtgaccaacgaacgtacggttaccgttacggaaccgttacgggaaccctagggtaccacgttccgtaccgtacggaccaacggacccgaaacggcccctaaaccccg

SEQ ID NO: 123983 - DNA, 611 bp, Homo sapiens
  misc_feature: GYAE6OF01DHEHR.37.38.D05.1.454.CMB.1.raw
  modified_base (504)..(504): a, c, t, g, unknown or other
  misc_feature (504)..(504): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaacgccggcacgtccctgtgctggtcatctatcaagataagaagcgggcctgagggactcccgtagacgcgtattcgtctcggcctaccgaaccgtccgggaacaccacggccccaccctcgaacccagtccgaacgggccgggaaccccagggaccttaaggtggacgttgggacggtccttgaacctttacgtttacgtggtccaaggtaccggtgggaaccaggtacaaacgttaccgngtaccaacgaacgtgggtaccgttaccgggaacgttcggggacccgtagggtcctacgtcccggttaccgtacggtaccgaacgccccgaaagccccgtaaaccccg

SEQ ID NO: 123984 - DNA, 669 bp, Homo sapiens
  misc_feature: GYAE6OF01ECNWK.37.38.D05.1.454.CMB.1.raw
  modified_base (197)..(197): a, c, t, g, unknown or other
  misc_feature (197)..(197): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccacatcacctgctctgagatgaattggaaaataaatatgcttgctggtatcagcagaacgccgggccacgtcccctgtcgcgtggtcatctatacaagagtaagaacgcgggtcctacgaggtacctccgtagacgtacgtacttctcgtcgtacctaccgaacgtaccgggaacacgtactacccacccgtacgaacctacgtacgacggccggaacccgaggtctagtaggactcggacggtctacgtaacttagttacgtgtacgacggtacggttacgggaacgacgtaacctaaacgttaccgtacgaacctaaaccgaacggtaccgggttacccggttaaacgggaacccggttacgggggtaacccggtacgggtttaccaacccggtttcccggtaccggttaaacgggaccctaaaccccgggacccgtaaaccgggaacccccctaaacccccg

SEQ ID NO: 123985 - DNA, 536 bp, Homo sapiens
  misc_feature: GYAE6OF01CX3YJ.37.38.D05.1.454.CMB.1.raw
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataatatgcttgctggtatcagcagaagccgggccagtcccctgtgctggtcatctatcaagataagaagcgggcctcagggatccctgagcgtattctctggctccaactccgggaacacagccaccctgaccatcacgcggaccngctangatgaggctgactatactgtcagacgtgggacagcaatactaggccaacaactacggtccttacggaaccgttcggggaaccctaaggggtccaacgttccggtccgtaacgggttacacggaccccaaagggccccaaaacccccg

SEQ ID NO: 123986 - DNA, 555 bp, Homo sapiens
  misc_feature: GYAE6OF01EAZYV.37.38.D05.1.454.CMB.1.raw
  modified_base (471)..(471): a, c, t, g, unknown or other
  misc_feature (471)..(471): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaacgccgggccacgtcccctgtcgcgtggtcatctatcaagataagaagcgggcctcgaggactccctgagcgtattccgtcgtcggcctaccgaaccgtacccgggaaacacgacgcccacccgtcgacccatccacggccgggacccaggctagtggatggaggtctagacttattacgtgtcaggacgtagggacagactaatcncgacaacaacgtacggttcctacggaacgtcgggacgagggtcacgtcgtaccgtaggtccacgcccgaacggccccaaccccg

SEQ ID NO: 123987 - DNA, 606 bp, Homo sapiens
  misc_feature: GYAE6OF01AB9D5.37.38.D05.1.454.CMB.1.raw
  modified_base (225)..(225): a, c, t, g, unknown or other
  misc_feature (225)..(225): n is a, c, g, or t
  modified_base (326)..(326): a, c, t, g, unknown or other
  misc_feature (326)..(326): n is a, c, g, or t
tcagtagtgtagatcacgaccggtgctcgatttagtatctgataggttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctgganatgaattgggaaataatatgcttgctggtatcagcagaagccgggccacgtccccctgtgctggtcatctatcaagataagagcgggcctcgaggatcccngagcgattctctcggcctccaacgtccgggaacacgacgcccaccctgacccatccgacggccgggacccaggctagtggatggaggtctagacttactttacgtgtaccgaggtacggtagggaaccacggaccgaaacttaccgtacgaccaaccgtaacgtacggttaccgttaccgggaaaccgttcggggaacccgtaggggtcctaacggttacccggtacccggttaacgggtccgaaccggcccccgaaacgggtccccctaaaccccccgg

SEQ ID NO: 123988 - DNA, 173 bp, Homo sapiens; identical to SEQ ID NO: 123962
  misc_feature: GYAE6OF01D1PBB.37.38.D05.1.454.CMB.1.raw
  modified_base (173)..(173): a, c, t, g, unknown or other
  misc_feature (173)..(173): n is a, c, g, or t

SEQ ID NO: 123989 - DNA, 833 bp, Homo sapiens
  misc_feature: GYAE6OF01DGY7Q.37.38.D05.1.454.CMB.1.raw
  modified_base (787)..(787): a, c, t, g, unknown or other
  misc_feature (787)..(787): n is a, c, g, or t
tcagtagtgtagatcacgaccggtgctcgatttagtatctgataggttgggtttgggcaagtcgtccgtgtccccgggacagaacagccaccgatcacctgcctctggagactgaagttcggaaataaatatgtcttgctggtagtcagcagaagtccgggcagtcccctgtcgcgtcggtctatctatacaagagtaagaagcgggcctacgagggactcccgtgaggtcgagttcctctggctaccgaaccgtccgggaacacgacgaccctaccgtcgaacctaattacgtaaaggtccggggtaaccctagggtaccgtaacgtacggggacgtacggaacggtacctaacggtactttaacgtttaacgttggtaccgtaaggtaaccgggttacgggaaccgtacggtaaccttaaagtttaaccgtacggtaaccaaaaccgtaaaccgtaacgggttaccgtttaaccggaaacggttaccggggaaacccggtaaggggttaccctaaacgttacccggttaaccggttaaacgggtaccgtaaacccggacccccggtaaaacgggtaaccccctaaaaccccccgtaagttaaccggttaccctaaaccgtttccccgtttacgggttaccccccgtaccccttacccgtaaccgtaaacgtttacccgttaaaccgtacccgtttaaaccgtcgggttaacggcccggggtaaccgtacgggtaaccgttaacggggtacctacgtaagtaccgtgtacgtactacggacactangcgtactactacgtagccgtagctcacgcacgtcgtcgtcgtcgtc

SEQ ID NO: 123990 - DNA, 551 bp, Homo sapiens
  misc_feature: GYAE6OF01ED25O.37.38.D05.1.454.CMB.1.raw
  modified_base (473)..(473): a, c, t, g, unknown or other
  misc_feature (473)..(473): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaacgccggccagtcccctgtgcgtggtcatctatcaagataagagcggacctcgagggactcccgtgacgcgtattctcgtggcctacccgaaccgtcccgggaaacaccgacgcccacccgtgaaccactccgacggccgggacccgaggctagtggatgaggctgactattactgtcagcgtagggacagacaatacgtgacacaacgnggttaccgtacggaacgtcgggaccgtagggtcacgtcgtaccgtacggtaccaacggccccaaggcccctaaacccg

SEQ ID NO: 123991 - DNA, 648 bp, Homo sapiens
  misc_feature: GYAE6OF01CSMTY.37.38.D05.1.454.CMB.1.raw
  modified_base (297)..(297): a, c, t, g, unknown or other
  misc_feature (297)..(297): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattagggaaataatatgcttgctggtatcagcagaacgccggccacgtcccctgtcgctggtcatctanacaagagtaaagagcgggcctacgagggactcccgtgagcgtattcgtcgtcggcctaccgaaccgtccgggaaacaccacgacccaccctacgacccatccgacgggacccgggaacccaggtaccttaagtacggtaagtacgggacggtccttagtaacgttaacttacgtagtaccgaagggtaaccggtagggaacctaacggtaactaaacttacgtacgaccaaaccgtaacggtacggtaccgttacgggtaaaccggtcggggaacccgtaggggtacctaacggtccgttacccgtaacgggtaccaccggaccccgaaccgggtaacccctaaacccccg

SEQ ID NO: 123992 - DNA, 460 bp, Homo sapiens
  misc_feature: GYAE6OF01BHECN.37.38.D05.1.454.CMB.1.raw
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (375)..(375): a, c, t, g, unknown or other
  misc_feature (375)..(375): n is a, c, g, or t
  modified_base (446)..(460): a, c, t, g, unknown or other
  misc_feature (446)..(460): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtggacngcaatcngcanaacnggtctcggaactgggaccaggtcagtcgtacctaggtcacgcccaaggcccaacccntcgtacactctcgtccccaccctctcactctaacacttactgacgcgggctggaccgtaaggccacatagnnnnnnnnnnnnnnn

SEQ ID NO: 123993 - DNA, 493 bp, Homo sapiens
  misc_feature: GYAE6OF01EBSXQ.37.38.D05.1.454.CMB.1.raw
  modified_base (391)..(391): a, c, t, g, unknown or other
  misc_feature (391)..(391): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcgagggactccctgagcgattctctggctccaactccgggaacacgagccaccctgaccatcagcggaccaggctanggatgagctgactatactgtacagcgtaggacagacaatctgacacaacagtctacggactgggacagggtcagtcgcgtagcagcccgaagcccaaacccg

SEQ ID NO: 123994 - DNA, 461 bp, Homo sapiens
  misc_feature: GYAE6OF01ET7DN.37.38.D05.1.454.CMB.1.raw
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (456)..(461): a, c, t, g, unknown or other
  misc_feature (456)..(461): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaaagataagaagcgggcctcagggatccctgagcgattctctggctccaactccgggaacacagccaccctgaccancagcggacccaggctatggatgaggctgactatacngtcagacgtgggacngtacaatactgacaacaactaggtcttacggaactgggaccagggtcatccgtcctagggtcacgacccaaggtcccaaacccactgcctactctcttccccaccctcctcatcctacgactactgacgcgggctggcaagggtcacaatgnnnnnn

SEQ ID NO: 123995 - DNA, 467 bp, Homo sapiens
  misc_feature: GYAE6OF01EC8GC.37.38.D05.1.454.CMB.1.raw
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (446)..(467): a, c, t, g, unknown or other
  misc_feature (446)..(467): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtgggacagcaatactgcacaacaggtcttcggaactggggaccagggtcatcgtctaggtcagcccaaggcccaacccntcgtcactctcgttccccncccttcctcactcctacactactgacgcgggctcggcaaggcgacagtagnnnnnnnnnnnnnnnnnnnnnn

SEQ ID NO: 123996 - DNA, 520 bp, Homo sapiens
  misc_feature: GYAE6OF01B6HVI.37.38.D05.1.454.CMB.1.raw
  modified_base (373)..(373): a, c, t, g, unknown or other
  misc_feature (373)..(373): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgacgcgattctctggcctccaactccgggaacacagccacctgaccanccagcggacccaggctatggatgaggctgactattacgtgtcagacgtgggacacggactaatactgaccaactaactagggttcctacgggaacgtcgggacccagggtccagtcgtctaggtcagccccaaggccctaaaccccg

SEQ ID NO: 123997 - DNA, 585 bp, Homo sapiens
  misc_feature: GYAE6OF01AMABF.37.38.D05.1.454.CMB.1.raw
  modified_base (502)..(502): a, c, t, g, unknown or other
  misc_feature (502)..(502): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaacgccggccagtcccctgtgctggtcatctatcaagataagaagccgggcctcgagggactccccgtaggacgtacgtattctcgtgggccctaccgaaccgtcccggggaaaccaccgaacgccccacccgtacgaacccactccgacggacccgggacccagggtacctagtgggactcgggacggtcctacggaacttattactgtacgaaggtcggtagggacaggaccaatacngaccacaacgtaggtccttacggacgtcgggacgagggtcacgtcgttaccgtacggccaacgcccaaggcccctaaaccccg

SEQ ID NO: 123998 - DNA, 453 bp, Homo sapiens
  misc_feature: GYAE6OF01CO9P6.37.38.D05.1.454.CMB.1.raw
  modified_base (375)..(375): a, c, t, g, unknown or other
  misc_feature (375)..(375): n is a, c, g, or t
  modified_base (438)..(453): a, c, t, g, unknown or other
  misc_feature (438)..(453): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaaactccgggaacacagccaccctgaccatcagcgggacccaggctatggatgagctgactattactgtcagacgtgggacagcaatactgacacaacaggtcttcggaactgggaccagggtcatcgctaggcagcccaaggcccaacccntcgtcactctcgtcccaccctctcatcctacactactgagcgggctggacaaggcacagtagnnnnnnnnnnnnnnnn

SEQ ID NO: 123999 - DNA, 444 bp, Homo sapiens
  misc_feature: GYAE6OF01AVOH5.37.38.D05.1.454.CMB.1.raw
  modified_base (430)..(430): a, c, t, g, unknown or other
  misc_feature (430)..(430): n is a, c, g, or t
  modified_base (436)..(444): a, c, t, g, unknown or other
  misc_feature (436)..(444): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagcccaaggccaacccactgtcactctgttcccgccctcctcatctacactactgagcgggctggcaggcncatagnnnnnnnnn

SEQ ID NO: 124000 - DNA, 174 bp, Homo sapiens; identical to SEQ ID NO: 123975
  misc_feature: GYAE6OF01CE20N.37.38.D05.1.454.CMB.1.raw
  modified_base (173)..(174): a, c, t, g, unknown or other
  misc_feature (173)..(174): n is a, c, g, or t

SEQ ID NO: 124001 - DNA, 517 bp, Homo sapiens
  misc_feature: GYAE6OF01EBKOM.37.38.D05.1.454.CMB.1.raw
  modified_base (316)..(316): a, c, t, g, unknown or other
  misc_feature (316)..(316): n is a, c, g, or t
  modified_base (495)..(517): a, c, t, g, unknown or other
  misc_feature (495)..(517): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtgggacagcaatctgaccnaacaacgtaggtacgttacggaacgtacgggaccgacgggtactactcgtaccgtacggtacgacgacccgaaccggacccaacccctactcgtacctacctccgttccgttcccccgtcccctcctctactacctacctactacgtcgacggcggcgtacggacgaacggcgcatagnnnnnnnnnnnnnnnnnnnnnnn

SEQ ID NO: 124002 - DNA, 722 bp, Homo sapiens
  misc_feature: GYAE6OF01C3PVS.37.38.D05.1.454.CMB.1.raw
  modified_base (226)..(226): a, c, t, g, unknown or other
  misc_feature (226)..(226): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccgggacagacagccaccatcacctgctctgganatagaattagggaaataatatgtcttgctggtatcagcagaacggccggccacgtcccctgtcgctggcatctatacgaagaataagaaggccggactacgaggctccgtgacgcgtacttcgtcgtcggcctacccgaacgtaccggaaacacgacgtacccacccgtacgaccactaccgacgggacccgggaacccgaggtaccttaaggtacgggtaacgtacgggtacggtaccttacggtaaccttttaacgtttacgtagggttaccgaacggggttaaccggtacggggaaacctaacggtacctaaaacgttaccgtaccgaaccgtaaaccgtaaacggtttaccggggtaacccgttaaaccggggaaaccggtaccgggggtaacccgttaacggggttaaccctaccggtttacccggtacccggttaacgggtacccaaacccggaacccccggtaaacgggtaccccccctaaaaccccgg

SEQ ID NO: 124003 - DNA, 538 bp, Homo sapiens
  misc_feature: GYAE6OF01EHX35.37.38.D05.1.454.CMB.1.raw
  modified_base (494)..(494): a, c, t, g, unknown or other
  misc_feature (494)..(494): n is a, c, g, or t
  modified_base (522)..(538): a, c, t, g, unknown or other
  misc_feature (522)..(538): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggactccctgagcgattctctggctccaactccgggaacacagcccaccctgacccatcagtcgggacccaggctatggatggaggctgactattactgtcaggacggtgggacagacaatactgacaacaacgtaggtccttacggaaccgtggggaaccctaggggtcctaacgttccggttaccctaagggtacccacggacccccgaaacgggacccccaaaccccctacgttcgtacctaccttccgttccgttcccccgtccccttccctcctactcctaccaccttacgngacggcgggctcggcgaaggcgcagtgnnnnnnnnnnnnnnnnn

SEQ ID NO: 124004 - DNA, 173 bp, Homo sapiens
  misc_feature: GYAE6OF01AKVVJ.37.38.D05.1.454.CMB.1.raw
  modified_base (172)..(173): a, c, t, g, unknown or other
  misc_feature (172)..(173): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccaccctcctcatctacactactgagcgggctggcaaggcgcatagnn

SEQ ID NO: 124005 - DNA, 463 bp, Homo sapiens
  misc_feature: GYAE6OF01CD0TA.37.38.D05.1.454.CMB.1.raw
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
  modified_base (451)..(463): a, c, t, g, unknown or other
  misc_feature (451)..(463): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctagtggatgaggctgactattactgtcaggacgtggacagcaatctgcacaacaggtcttcggaactgggaccagggtcacgtcgtcctaggtcacgacccaacggcccaaccccactcgtcacctctcgttccccgccctcctcactcctacactcngacgcggntcggcaaggcacatgncnnnnnnnnnnnnn

SEQ ID NO: 124006 - DNA, 592 bp, Homo sapiens
  misc_feature: GYAE6OF01CTB45.37.38.D05.1.454.CMB.1.raw
  modified_base (198)..(198): a, c, t, g, unknown or other
  misc_feature (198)..(198): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtgtccccggganagacagccaccatcacctgctctggagatagaattagggaaaataaatagtagcttagctggtatacagcgaagaacggccggccacgtcccctgtgctcggtcatctatacaagataagaacggcgggctacgacgggtactcccgtagacgcgtattcctgtcggcctaccgaacgtaccgggaacaccgacgacccacctacgacctacacgacggcccggaaccgagtactaggaggatggacggtctagtacttactacgtgtacaggacgtgggacaggctaagactacgacaactacgtagtccgttaacggaaccggtgggaaccgtagggtccacgttaccgtaccgtaacggacgacggtaccccaacggtaccccaaaccccg

SEQ ID NO: 124007 - DNA, 551 bp, Homo sapiens
  misc_feature: GYAE6OF01CRJTR.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataatatgcttgctggtatcagcagaagccggcagtcccctgtgctggtcatctatcaagataagaagcgggcctcgagggatcccgtgacgcgtattctctggctaccaaccgtccgggaaacacgacgacccaccctgaccatccgacggccgggaacccaggcctagtcgggatggaggtctagactattactgtacaggacgtgggaacaggctaatacctgacaacgaacgtagtccgttacggaacgtcgggaccaggggtccaagtccggtacctaaggtccagaccccgaaggcccctaaaccccg

SEQ ID NO: 124008 - DNA, 173 bp, Homo sapiens
  misc_feature: GYAE6OF01D7J6X.37.38.D05.1.454.CMB.1.raw
  modified_base (173)..(173): a, c, t, g, unknown or other
  misc_feature (173)..(173): n is a, c, g, or t
tcagtagtgtagatcacgaccggtgctcgatttagtatctgatagttgggtttggggggtttggtggtctccactcccgccttgacgggctgccatctgccttccaaccccactgtcactctgttcccaccctcctcatctacactactgagcgggctggcaaggcgcatagn

SEQ ID NO: 124009 - DNA, 577 bp, Homo sapiens
  misc_feature: GYAE6OF01BZ03M.37.38.D05.1.454.CMB.1.raw
  modified_base (411)..(411): a, c, t, g, unknown or other
  misc_feature (411)..(411): n is a, c, g, or t
  modified_base (554)..(560): a, c, t, g, unknown or other
  misc_feature (554)..(560): n is a, c, g, or t
  modified_base (562)..(577): a, c, t, g, unknown or other
  misc_feature (562)..(577): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggctcagggatccctgagcgattctctggctccaacgtccgggaaacacacgtcccacctgacccatcacggccggacccaggctagtggatgaggctgactattactgtacagacgtggacagcaaatactgacaacgaactcggtacgttacggaacgtcgggaaccacgggtcacgttcgtaccgtaggtacacggacccgaaacggcccaaacccctnttacgtccctaaccgttccttacccgttacccccctacccgttccctactaacctacccttaaccgtaccgttaacggtccggtaaccggggtcccgggtccgttaacgggaccgtaaacgggccgtacgtaaccgtagcacnnnnnnncnnnnnnnnnnnnnnnn

SEQ ID NO: 124010 - DNA, 175 bp, Homo sapiens
  misc_feature: GYAE6OF01A0JX4.37.38.D05.1.454.CMB.1.raw
  modified_base (173)..(175): a, c, t, g, unknown or other
  misc_feature (173)..(175): n is a, c, g, or t
tcagtagtgtagatcacgaccggtgctcgatttagtatctgatagttgggtttgggggtttggtggtctccactcccgccttgacggggctgccatctgccttccaaccccactgtcactctgttcccgccctcctcatctacactactgagcgggctggcaaggcgcatagnnn

SEQ ID NO: 124011 - DNA, 595 bp, Homo sapiens
  misc_feature: GYAE6OF01BYIXO.37.38.D05.1.454.CMB.1.raw
  modified_base (445)..(445): a, c, t, g, unknown or other
  misc_feature (445)..(445): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(567): a, c, t, g, unknown or other
  misc_feature (566)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (579)..(580): a, c, t, g, unknown or other
  misc_feature (579)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(594): a, c, t, g, unknown or other
  misc_feature (586)..(594): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagagcgggcctcagggactccctgagcgtatttcctcgtggccttacccgaaacgtcccgggaacacgacgcccaacccgtgaaccatccgaggccgggacccagggcctagtcggatggacggtctgacttatttactgtacagacggtgggaaccagacaaattactcggacaaccgaacgtggttaccttacggaacgttcggggacccagggtcacgttccgtaccgtagggtccaacgccccgaaacgcccaaacccngttccgactaccgtccgttccggtttccccaccctcctactaccttctaaccacgttaaccgtcggaacggccgggtactacgggaccgtaacgggccgtaccgtaagtcgnacgcncncnncncncncncgcnncncncnnnnnnnnnc

SEQ ID NO: 124012 - DNA, 680 bp, Homo sapiens
  misc_feature: GYAE6OF01DQ45E.37.38.D05.1.454.CMB.1.raw
  modified_base (197)..(197): a, c, t, g, unknown or other
  misc_feature (197)..(197): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtgcctcctatgaactgactcagccaccctcagtgtccgtcgtccccggganagacacgccaccatccacctgcctcgtggagatagaagttaggaaaataatatgtcttgctggtatcagcagacgccggccacgtcccctgtcgctcggtacatctatacgaagaataaaggacgcgggtaccctaggacgggactcccgtaggacgtaccgttacttccgtcgttacggccttaacccgaaccggttaccccgggaaacctaccgacccggacccctaacccgtacgaaccctacgtacggaccgggacccggtaacccgaggtactaacggtaggtagtacggacggtcttaacgtactttacgttacggttagtaccgaagggtaccggtacgggaactacgaactaacttacgtacgacctaacgaaaccgtacggttaccgttaaccgggaacggtcgggaaccgtcgggtacctacggttaccgtaccgtacggtaccacccgacccgaaaccggcccctaaccccg

SEQ ID NO: 124013 - DNA, 631 bp, Homo sapiens
  misc_feature: GYAE6OF01BZPA8.37.38.D05.1.454.CMB.1.raw
  modified_base (506)..(506): a, c, t, g, unknown or other
  misc_feature (506)..(506): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacagccaccatcacctgctctggagatgaattgggaaataaatatgcttgctggtatcagcaggaacggccggccacgtcccctgtcgctggtcatctatacaagaataagaaggcgggcctacgagggtactcccgtgagcgtacttcgtctcggcctacccgaacgtcccgggaaacaccgacgacccacccgtacgaacctataccgacggacccgggaacccaggcctagtcggagtggacggtcgtagtaaccttattaccgtggtacgaggtacggtagggacaggtacctaagttaccngaacccaacgtaaaccgtcggttaccgttaaccgggaaccgtacggggaaccgtacggggtaccacggttaccgtaccgttaacgggtacccaaccggaccccgaaacggccccctaaacccccg

SEQ ID NO: 124014 - DNA, 617 bp, Homo sapiens
  misc_feature: GYAE6OF01ATHNG.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtcccccgggacagacagccaccatcacctgctctggagatgaattgggaaataaatatgacttgctggtatcagcagaagccgggccagtcccctgtgctggtcagtctatacaagaataaacgaaggccgggaccttcgaggggactcccgtggagtcgattctcgtcggcctaccgaacgtacccgggaacacgacgcccaccctagaacccactacacggaccgggacccgaggccgtacgtgggacgtggacggtacgtacgaacgtttaagttacttacggttacgaaggtaaccgggttacgggaacgtacgaactaacgtacgtacgaccaacgtaacgtacgttaccgtaacggtacggtacggaccggtacggtctacgtcgttcggtacgtaccgaacgcccgaaccggcccctaacccg

SEQ ID NO: 124015 - DNA, 174 bp, Homo sapiens
  misc_feature: GYAE6OF01C53K3.37.38.D05.1.454.CMB.1.raw
  modified_base (172)..(174): a, c, t, g, unknown or other
  misc_feature (172)..(174): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccgccctcctcatctacactactgagcgggctggcaaggcgcatagnnn

SEQ ID NO: 124016 - DNA, 559 bp, Homo sapiens
  misc_feature: GYAE6OF01DB6I5.37.38.D05.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccacctcagtgtccgtgtccccggganagacagccaccatcacctgctctganatgaattgggaaaataatatgcttgctggtatcagcagaagccggcacgtcccctgtgctggtcatctatcaaagataaagaaggcggcctacgagggatcccgtgacgcgtaattccgtcgtggcctaccaacgtcccgggaaacacgacgacccaccctgaacccactccgacggaccgggacccaggtcctaagtggatggacggtctagacttaattactgtacaggacgtaggacagacaatactgacaacgaacgtacggtcgtacggaacgtcgggaacgagggtcacgtccgtacgtaggtaccacgaacccaacggccctaaaccccg

SEQ ID NO: 124017 - DNA, 706 bp, Homo sapiens
  misc_feature: GYAE6OF01CY56M.37.38.D05.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccacctcagtgtccgtgtccccggganagacagccaccatcacctgctctgganatgaattgggaaataatatgcttgctggtatcagcagaacgccgggaccacgtcccctgtcgcgtggtcatctatacaagataaggaagcgggcctacgagggactcccgtgacgcgtattccgtcgtggtcctaccgaaccgtcccgggaaacaccgacgccccaaccgtcgaaccctagtacccgaacgggcccggggaacccctaagggtccttaaggtacgggacgttaggggaacgggtaccgttaaccgaaaccgttttaacgtttaaccgtaggtttaccggaacgggtaaaccgggttacgggggaaacctaagggtacccttaaaacgttacccgttaacggaccgtaaaccgtaaaaccggtacgggttacccgttaacgggtaaaccggttcggggaaccctagggggttaccctacgttcccggtaccgtacgggtacccacggacccgaaaccgggcccctaaacccccg

SEQ ID NO: 124018 - DNA, 699 bp, Homo sapiens
  misc_feature: GYAE6OF01EVK4T.37.38.D05.1.454.CMB.1.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtcccggggacagacagccaccatcacctgctctggagatgaattgggaaataatatgcttgctggtatcagcagaagccgggccagtcccctgtncgtggtacnctatactagaagaagtaagacgggaccggtccgtacggtacggtaccgtccgtacggacgacgtacgttacctcgtcgtaccgtaacccgtaacccggtaacccggaaaccgaacgaccgaaccccgtacccgtaccgaaccgtaccgtacgaccgggacccggacccggaccgtaacgtcgagattggaacggctagacgttacgttaaccgtacggttaccgtaacggtaaccggtaggggaaccgtaagggtaccaaacgtacctaacgaccgaaccgtaaccgtaacggttaccgttaccgggaaccgttcggggtaaaccctaacgggggtcccaacggttaccggtacccgtaaccgggtacccgaacgggtacccccaaaccgggtccccgtaaacccccg

SEQ ID NO: 124019 - DNA, 601 bp, Homo sapiens
  misc_feature: GYAE6OF01AURW7.37.38.D05.1.454.CMB.1.raw
  modified_base (224)..(224): a, c, t, g, unknown or other
  misc_feature (224)..(224): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctgganatgaattaggaaataaatatgcttgctggtatcagcagaacgccggccacgtcccctgtgctggtcatctatacaaagataaggacgcggcctcgaggactccgtagagcgtattctctcggcctaccgaaccgtaccgggaacacgacgcccaaccctacgaacccataccgacggacccgggacccaggcctagaggaatggaacggcttacgaacttacttacgtcgtacgtaaggaccggtcgggaacaggtacctaaattacgtcgaaccaacgaacgtacggtcgtaaccgggaacgtcgggaacccgtagggtcctacgtccgtaccgttacggtacccgaaccggacccaaaccggcccctaaaccccg

SEQ ID NO: 124020 - DNA, 495 bp, Homo sapiens
  misc_feature: GYAE6OF01CZI8Q.37.38.D05.1.454.CMB.1.raw
  modified_base (379)..(379): a, c, t, g, unknown or other
  misc_feature (379)..(379): n is a, c, g, or t
  modified_base (472)..(495): a, c, t, g, unknown or other
  misc_feature (472)..(495): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcaggacgtgggacagcaatctgcaacaacaggtctcggaactcgggacaggtcagtcgtctaggtcacgacccgaaggacccaacccnctcgtaccacttccgttccgttaccccacccttcctactaactcctaccactacgtcgacggccgggctcgggaccaagggccataactggannnnnnnnnnnnnnnnnnnnnnnn

SEQ ID NO: 124021 - DNA, 476 bp, Homo sapiens
  misc_feature: GYAE6OF01BTZTD.37.38.D05.1.454.CMB.1.raw
  modified_base (416)..(416): a, c, t, g, unknown or other
  misc_feature (416)..(416): n is a, c, g, or t
  modified_base (456)..(456): a, c, t, g, unknown or other
  misc_feature (456)..(456): n is a, c, g, or t
  modified_base (460)..(476): a, c, t, g, unknown or other
  misc_feature (460)..(476): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagcgtgggacagcaatactgcacaacaggtctcggaactgggaccagggtcagtcgtacctaggtcacgcccaacggcccaacccctactcgtaccacctccgttcgttcccccacccttccnctactccacctactactgacgcgggctggacaaggcgacntagnnnnnnnnnnnnnnnnn

SEQ ID NO: 124022 - DNA, 650 bp, Homo sapiens
  misc_feature: GYAE6OF01AQW15.37.38.D05.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccaccatcacctgctctgganatgaattagggaaaataatatgcttgctggtatcagcagaagccggccacgtcccctgtcgctggtcatctatacaagataaagaagcggcctcgaggactcccgtgacgcgtattcgtcgtcggtcctaccgaaaccgtacccgggaaacacgtacgacccctaaccctacgaacccacgtacgacggtacccgggacccgacggtactaagttcggagttaggaacggtctaggtaacttacgttaaccgttcgtacgaaggtaccggtagggtaaccaaggtacctaaagtaccgtacgaccaaccgtaaacgtacggttaccgttaaccgggaaacgtcggggaacccgtagggtacctacgttacccggtaccgttaacggtacccgaccgaccccgaaaccgggtcccctaaaacccccg

SEQ ID NO: 124023 - DNA, 462 bp, Homo sapiens
  misc_feature: GYAE6OF01EI673.37.38.D05.1.454.CMB.1.raw
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (444)..(462): a, c, t, g, unknown or other
  misc_feature (444)..(462): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcggacccaggctatggatgaggctgactattactgtcaggacgtgggacagcaatactgcaacaacaggtcttacggaactggggaccagggtcatcgtcctaggtcagccccaaggcccaaccccactntcactctcgttcccgccctcctcatcctacnctactgacgcggctggcaaggcacatgnnnnnnnnnnnnnnnnnnn

SEQ ID NO: 124024 - DNA, 534 bp, Homo sapiens
  misc_feature: GYAE6OF01E2UP8.37.38.D05.1.454.CMB.1.raw
  modified_base (436)..(436): a, c, t, g, unknown or other
  misc_feature (436)..(436): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtccccctgtgctggtcatctatcaagataagaagcgggcctcgagggactccctgagcgattctctggcctccaactcccgggaacacacgcccaccctgaccatccaggccgggacccaggctagtggatgaggctgactatactgtcagacgtgggaacngactaatactcgaccaacaacgtaggtcctacggaacgtcgggaaccagggtcagtcgttaccgtacggtacacgccccgaacggcccctaaaccccg

SEQ ID NO: 124025 - DNA, 560 bp, Homo sapiens
  misc_feature: GYAE6OF01EUFMY.37.38.D05.1.454.CMB.1.raw
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (538)..(560): a, c, t, g, unknown or other
  misc_feature (538)..(560): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctcgaccatcagccgggacccaggctagtggatgagctgtactattactgtcagacgtggacagacaatactgaccaacaacgtacggtccttacggaaacgttcggggaaccctaggggtcaacgttccggtaccgtaagggtccacggaaccccgacgggtacccccaaccccgtacgttcgtaccctaaccgttccgtttacccgtttccccccggaccccttcccgtactacttcctaacctactaccgttggacggtccgggactcgggcaacgggcaacgngtangacnnnnnnnnnnnnnnnnnnnnnnn

SEQ ID NO: 124026 - DNA, 650 bp, Homo sapiens
  misc_feature: GYAE6OF01D8KWY.37.38.D05.1.454.CMB.1.raw
  modified_base (230)..(230): a, c, t, g, unknown or other
  misc_feature (230)..(230): n is a, c, g, or t
  modified_base (361)..(361): a, c, t, g, unknown or other
  misc_feature (361)..(361): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtcgtccgtcgtccccgggacagaccagcccaccatccacctgctctgganatgaagttgggaaaataaatatgtcttgctggtatcgagcaagaacggccggccacgtcccctgtgcgtggtcatctatacgaaagataaggacggcgggcctacgagggactccgtggacgtcgtattcncgtcggtacctaaccgtaaccgtacccgggaacaccgacgtccccaacccgtacgaacccagtcccgaacgggcccggaaccgtaggcctaaggtacggacgttaggacggtcgtagtacgttacttacgtcgtaccgaggtacggtacggaacagtacaagtactacgacctaacgaacggtacgggttccgtaacgggaccgtacggggtaaccgtcggggttacctacggttcccgacggttaacggaccgaacccggtacccgaaacccgggccccctaaacccg

SEQ ID NO: 124027 - DNA, 622 bp, Homo sapiens
  misc_feature: GYAE6OF01CRTAP.37.38.D05.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagcagccacatcacctgctctgganatgaattagggaaaataaatatgcttgctggtatcagacagaacgccgggccacgtcccctgtcgcgtggtcatctaatcaaanagtaaagaacggcggcctacgagggactcctgacgctattcnctgcctcctaacgccgggaacacgtacgacccaccgtanaccctagaccgacgggccggaacccgagtaccgtagtcggactggaacggtccttacggaactttaacgttactacggtaccaagggtaacgtacgggaaccacgggtaactaacgtaccttacggaccaaaccgtaacgtacggttaccttaacgggaaccggttcgggaccgtacgggtactacgtcccgttacgtaccggtacacggaccccgaaacggcccctaaaccccg

SEQ ID NO: 124028 - DNA, 570 bp, Homo sapiens
  misc_feature: GYAE6OF01CR7T5.37.38.D05.1.454.CMB.1.raw
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (546)..(547): a, c, t, g, unknown or other
  misc_feature (546)..(547): n is a, c, g, or t
  modified_base (549)..(556): a, c, t, g, unknown or other
  misc_feature (549)..(556): n is a, c, g, or t
  modified_base (558)..(570): a, c, t, g, unknown or other
  misc_feature (558)..(570): n is a, c, g, or t
tcagtagtgtagatcacgaccggtgctcgatttagtatctgatagttgggtttgggcagtgtccgtgtccccgggacagacagccaccatcacctgctctggagatgaattggaaaataaatatgcttgctggtatcagcagaagccgggccagtcccctgtgctggtcatctatcaaagaataaagagcgggcctcgagggactccctgagcgtattctcgtcggcctaccaaccgtaccgggaacacgacgacccacctcgaaccactcgaacggccgggaaccaggctagtggatgaggctagactattcngtcagcgtggacagctaatacngacaataacgagttccgtacggaacgtgggacctagggtcacgttccgtctacggtacaacgaccccgaaggaccccaaaccctcgtcgtaccctacttccgtacccgttccccgcccccttccgtacaaccttaccctaacctaaccgttacgtacgggaccggcgggtaccgttacggaccgtaacgggcctacgtaactaacggcannannnnnnnncnnnnnnnnnnnnn

SEQ ID NO: 124029 - DNA, 747 bp, Homo sapiens
  misc_feature: GYAE6OF01E1IXG.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagagcgggcctcgagggatcccgtgagcgatttccgtctcgggacctacccgaaccgtacccggggaaaccaaccgacggaccccaaccccgttacgaaccctaacgttacccgaaacggggcccccgggggaaacccccgaaggggtacccttaaaggtcggggtaacgttacgggaacgggtaccttacgggtaaacctttaacgtttaacttacgggttaccaacgggtaaccgggttacggggaaccgtaacggacgtaaaacttacgttaggaccctaaacccgaaacgtacggggtttaccgttaacccggggaaaccggttaccgggggtaaacccctacggggggttaccctaaacggttcccggttaacccgttacggggttaccccaaaccgggtaccccccgaaaaccgggtacccccgtaaaaccccccccgg

SEQ ID NO: 124030 - DNA, 587 bp, Homo sapiens
  misc_feature: GYAE6OF01AE52E.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtcccccgggacagacagccaccatcacctgctctggagatgaattgggaaataaatatgcttgctggtatcagcagaagccgggccacgtccccctgtcgctggtcatctatcaagataagagcgggcctcgagggactcccgtgacgcgtattcctcgtcggcctcccaacgtcccgggaacaccgacgcccacccgtgacccatccgacggccgggacccagggctagtggatggaggctgacttattactgtcgagacggtgggacagactaatcgtacgacaaccgaacgcggttccttacggggtaacgtccggggtaaccctacggggtccacggttccgtaccggttaacgggtaccaacccggaccccaaaccgggccccctaaacccccgg

SEQ ID NO: 124031 - DNA, 777 bp, Homo sapiens
  misc_feature: GYAE6OF01A996V.37.38.D05.1.454.CMB.1.raw
  modified_base (184)..(184): a, c, t, g, unknown or other
  misc_feature (184)..(184): n is a, c, g, or t
tcagtagtgtagatcacgaccggtgctcgatttagtatctgatagttgggtttggggtcgtgggcctcaggaagcagcatcggaggtgcctcagccatggcatggatccctctcttcctcggcgtccttgcttactgcacacggatccgtggccctcctatcgaactgactcacgcccaccctnagtcgtccgtcgtacccgggacacgacacgcccaccatccacctgcctcgtggacgatgaattagggaaattaaatagtgacttggacttaggtacttacaagctaacggaacggtcccgggacctaccggtcccccttaggtcgtccgttcggtaccacgttccgttaataccgaaaggtaacgttaaaacgggaacgggtccgggtacccttacgggaaggggtaccctttacccggaggaacggtcgttaacgtttccgttccggttacggaccctaacccgttaaccggtaacccgggtaacccaaacggcccgtaccccgaaccgttaccgaaccgtttacgaccgaccgggacccgggaacccgtaccgggtacttaacgggtacggaacggtacgggaccggttacgttaacggtaacctttacgtccgttaacggttacgaacgggtaccggtacgggtaccaagtaacgtaaacgtcgtaagacccgaaagtaccgacggttaccgaacggtaccggtcgggactacgggtacaccggttaccgtcgtacggacctaaccggacccgacggtccctaaacccgg

SEQ ID NO: 124032 - DNA, 243 bp, Homo sapiens
  misc_feature: GYAE6OF01DDEU7.37.38.D05.1.454.CMB.1.raw
  modified_base (185)..(185): a, c, t, g, unknown or other
  misc_feature (185)..(185): n is a, c, g, or t
  modified_base (191)..(193): a, c, t, g, unknown or other
  misc_feature (191)..(193): n is a, c, g, or t
  modified_base (195)..(243): a, c, t, g, unknown or other
  misc_feature (195)..(243): n is a, c, g, or t
tcagtagtgtagatcacgaccggtgctcgatttagtatctgatagttgggtttgggggggtttggtagggtcctaccactcccgccttggacggggctcgccatctgccttccaacccccactgtcacgtccgtcgttccccggccctctcattctacgactactggagcgggctggcaaggccncatagnnngnnnnnnnnnnnnnnnnnnnnnnnnnnnnnnnnnnnnnnnnnnnnnnnnn

SEQ ID NO: 124033 - DNA, 562 bp, Homo sapiens
  misc_feature: GYAE6OF01BTPTS.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataatatgcttgctggtatcagcagaagccggccagtcccctgtgctggtcatctatacaagataagaacgcgggcctcgagggactcccgtgacgcgtacttctctggcctccaacgtccgggaacacacgacccaccctcgaccatccacgccgggacccaggctagtggatgaggtctagacttattactgtaccagacgtagggacagctaaatcgtagacctaacgaaccgtacggttccgttacgggaacgtcgggaacccgtagggtccacgttccggtacctacgggtacaccggaccccaacggcccctaaaccccg

SEQ ID NO: 124034 - DNA, 519 bp, Homo sapiens
  misc_feature: GYAE6OF01CYW3H.37.38.D05.1.454.CMB.1.raw
  modified_base (197)..(197): a, c, t, g, unknown or other
  misc_feature (197)..(197): n is a, c, g, or t
  modified_base (414)..(414): a, c, t, g, unknown or other
  misc_feature (414)..(414): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccaccatcacctgctctggagatgaattgggaaataatatgcttgctggtatcagcagaagccgggccagtcccctgtgctggtcatctatcaagataagaagcgggcctcgagggatccctgagcgattctctggctccaacgtccgggaacacgacgcccaccctgaccatcgagcggacccaggctagtggatgagctgactattacngtacagacgtggacagacaatactgcaacaacgaggtacgttacgaacgtcgggacctagggtcacgttcgtcctacggtacagacccgaaggccctaaaccccg

SEQ ID NO: 124035 - DNA, 635 bp, Homo sapiens
  misc_feature: GYAE6OF01B3XG9.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacagccaccatccacctgctctggagatgaagttagggaaataaatatgcttgctggtatcagcagaacgccggccacgtcccctgtgcgtggtcatctatacaagataagaagcggctcgaggactccgtgacgcgtattctcgtcggcctaccgaacgtaccgggaaacacgaccgccccacccgtcgaacccagtaccgacgggacccgggaaccccagggtcctaagtgggtaacgtggacggtactagtaacttagttactgtaccgaggtaccggtacgggaactacgaactaaacttcgtacgaccaacgaacgtacgggttaccgttaccgggaaccgtcggggtaacccgtacggggttaccacgttcccggttaaccgtacgggttaccaacccggaccccgaaacgggccccctaaaacccccg

SEQ ID NO: 124036 - DNA, 479 bp, Homo sapiens
  misc_feature: GYAE6OF01C8TZR.37.38.D05.1.454.CMB.1.raw
  modified_base (239)..(239): a, c, t, g, unknown or other
  misc_feature (239)..(239): n is a, c, g, or t
  modified_base (269)..(269): a, c, t, g, unknown or other
  misc_feature (269)..(269): n is a, c, g, or t
  modified_base (378)..(378): a, c, t, g, unknown or other
  misc_feature (378)..(378): n is a, c, g, or t
  modified_base (459)..(479): a, c, t, g, unknown or other
  misc_feature (459)..(479): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctcccaactccgggaacacngccacctgaccatcagccggaccaggctanggatgaggctgactattactgtcagacgtgggacagcaatctgcacaacaggtcttcggaacgtcgggaccagggtcatcgtcctaggtcacgcccaaggccaaccccntgtccactcgtcgtccccgcccttcccgtcactcctacacctactgacgcgggctcggactaacggcgtacacgttagcannnnnnnnnnnnnnnnnnnnn

SEQ ID NO: 124037 - DNA, 663 bp, Homo sapiens
  misc_feature: GYAE6OF01CFDL9.37.38.D05.1.454.CMB.1.raw
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (347)..(347): a, c, t, g, unknown or other
  misc_feature (347)..(347): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggactccggtggcctcctatgaactgactcacgcccaccctcagtcggtcccgtcggtccccgggacacggacacgccaccactcaccgtgctcgngganagtagtaagttagggaaattaaatgtagtcttgtcgttaggtatcgagaccgaacggaacggccccgggacctacggtccccgtggtcgtcgtcggtactactactanacgaaagaacgtaaaggaacggccggtaccgtacggaacgggtactacccgtaggacgtcgtacttcgtccgtcggacccttaccgaaccgtacccggaaccaccgaccacccaccgtacgacctacgacgaccgggacccgggaccaggtcgtaggtacgacgtcgacggtctacgtacttacgtacgtgacgacggtacggacggacacgactaagtacgacacgaacctaaggtcggtaccgtacggacgtcggacgtagggtctacggttccgtacggtacgaccgaaccgcccgaaccggcccctaacccg

SEQ ID NO: 124038 - DNA, 677 bp, Homo sapiens
  misc_feature: GYAE6OF01DU6CS.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgattactgcacaggatccgtggcctcctatgaactgactcagccaccctcagtcgtccgtcgtccccgggacagacagccaccatccacctgctcgtggagatagaagttagggaaaataaatagtgtcttagctggtatcagcaagaacgccggaccacgtccctgtgcgtggtcatctatacgaagaagtaaggacgcggacctagacgggtactcccgtaggacgtcgtacttccgtcgtcgcctaccgaaccgtaccgggaacacgaccgacccgacccgtacgaacctacgtaccgaccgggacccggaaccccaggtacctaggtacggagttcgacggcttacggtaacctttaacgttaccgttaggtaccgaaggtaccgggttaagggaccacggtaaccgtaaagttcccgagaacccaaccgtaaaccggtacggttacccgtaagggaaacccgttggggaacccgtaggggtccctacggtacccgtaccggtaggtacccgaacccggtacccggaaaccgtccccctaaacccg

SEQ ID NO: 124039 - DNA, 789 bp, Homo sapiens
  misc_feature: GYAE6OF01DVY2J.37.38.D05.1.454.CMB.1.raw
  modified_base (675)..(675): a, c, t, g, unknown or other
  misc_feature (675)..(675): n is a, c, g, or t
  modified_base (708)..(708): a, c, t, g, unknown or other
  misc_feature (708)..(708): n is a, c, g, or t
  modified_base (780)..(780): a, c, t, g, unknown or other
  misc_feature (780)..(780): n is a, c, g, or t
tcagtagtgtagatcacgaccggtgctcgatttagtatctgatagttgggtttgggggctgggcctcaggaagccagcatcggaggtgcctcagccatggcatggatccctctcttcctcggctccttgcttactgcacaggactccgtcggcccttcctatacgaactgacctcacgccctaccctctagtcgtcccgtcggtcccccgggacacgaccgaccgcccaacctactccaccgtcgccgttacgtgggtaagtacgtacggtaaaagggtttaagggaaaaactttaaagttacgttcggtcccgtttcggtccgtttagggtaacttcgaacggcgaaccggaaaccgggcccccgggtaccgtaccggttcccccggttggtcggtccggttacggttaccaacgtttaccgtaactaaccgtaaacgaaggttaaaaccgggaacgggtacccggggtacccctaacggggaacgggtaccttacccgtggtaaccgtccggtttacttaccgttcggtacccgtaaccccgtaccggttaaaccgaacccgggaaccaaccgtaccgaccccgtacccgtacggaaccctcgaccggaaccggggaccccggacctaggactagacggtacgtggacgtccttaagacctttacgtacgtanacggtagacgggtagacctacgaataccgtacngaactacgaggtcgttacgacggtacgtaccggagtacgtctacgtcgttacgacgccaaccgaccgacccncccttaacg

SEQ ID NO: 124040 - DNA, 517 bp, Homo sapiens
  misc_feature: GYAE6OF01B1K0S.37.38.D05.1.454.CMB.1.raw
  modified_base (208)..(208): a, c, t, g, unknown or other
  misc_feature (208)..(208): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (487)..(487): a, c, t, g, unknown or other
  misc_feature (487)..(487): n is a, c, g, or t
  modified_base (494)..(513): a, c, t, g, unknown or other
  misc_feature (494)..(513): n is a, c, g, or t
  modified_base (515)..(517): a, c, t, g, unknown or other
  misc_feature (515)..(517): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccggccagtcccctgtgctggtcatctatcaaagataagaagcgggcctcagggatccctgancgatctctgctcaactcgggaacacagccacctgaccatcagcggaccaggctatggatgagctgactatactntcagacgtggacngacaatacngacaacaacacggttcttacggaactcgggaccagggtcatcgtcctaggccagaccccaaaggcccctaaacccactggtaccacttccgtacgttccccctaacccctccctctaacttacgaacctaccgttaaactcggaacgccggggtcctagggacccgaaacggcgacccgttanaagcaannnnnnnnnnnnnnnnnnnncnnn

SEQ ID NO: 124041 - DNA, 573 bp, Homo sapiens
  misc_feature: GYAE6OF01CW63N.37.38.D05.1.454.CMB.1.raw
  modified_base (325)..(325): a, c, t, g, unknown or other
  misc_feature (325)..(325): n is a, c, g, or t
  modified_base (547)..(547): a, c, t, g, unknown or other
  misc_feature (547)..(547): n is a, c, g, or t
  modified_base (549)..(573): a, c, t, g, unknown or other
  misc_feature (549)..(573): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccggccagtcccctgtgctggtcatctatcaagataagagcgggcctcgagggatccctgacgcgtattctctggctaccaacgtccgggaacacacgcccacctgaccatcgacgcgggaccaggctaagtggatgacggctgacttaattcgtgtcagacgtggacagacaaattacngacaacgaacgtaggttccttacggaacgtgggaacccagggtacctagtccgttacttacgggacaaccggaccccgaaacggacccctaaaccccagtttcgtaccaccctttccgtcccgggtttcccccacccctttccctactaaccttacctaaaccctaccgttaacgtcggaacgtcccggggtcttacgggaaccaaggggcccataaccggngnnnnnnnnnnnnnnnnnnnnnnnnn

SEQ ID NO: 124042 - DNA, 627 bp, Homo sapiens
  misc_feature: GYAE6OF01CB96Y.37.38.D05.1.454.CMB.1.raw
  modified_base (406)..(406): a, c, t, g, unknown or other
  misc_feature (406)..(406): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtccccctgtgctggtcatctatcaagataagaagcgggcctcgaggactcccgtgagcgtattcgtctggcctccaacgtccgggaacacgacgccctacctacgacctcgtacgacgggacccgaaccggngtacgtaggtagtagtacggagtctacgtacttacgttcgtcgtacggacggtacgggtacggaacgacgtactaacgtacgtacgaccaaacgtaacggtacggttacccggtaacggtaccgggtaccgggtaaccgtacgggttactaccgttcccggttaccggtacgggtacccgtaacccggaaccccggaacccggtaacccccctaaacccgg

SEQ ID NO: 124043 - DNA, 719 bp, Homo sapiens
  misc_feature: GYAE6OF01ENH46.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattaggaaataatatgcttgctggtatcagcagagccgggccacgtcccctgtgcgtggtcatctatacaagataagaacgcggctacgaggactcccgtagacgcgtattccgtcgtggtacctacccgaaccgtacccgggaaactaccgaacggtccccaccccgtacgacccgaacttacccgaacgggaccccggggaaccccgaggtaccgtaacggtacgggaacgttagggacgggtaccttaacgggtaacctttaacgtttacgttacggtaccgaaggtaaccgggttagggaaccgaagtaccgtaaagttaccgtacgacccaacgtaaaccggtacggttacccggttaaccgggtaaccggtaaccgggggtaacccgtaacggggttccctaaccggttcccggttaacccggttaacgggttacccgaacccgggtaacccccggtaaacccggaacccccctaaaccccccgg

SEQ ID NO: 124044 - DNA, 541 bp, Homo sapiens
  misc_feature: GYAE6OF01D2Q43.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattagggaaaataaatatgcttgctggtatcagcagaagccggccagtcccctgtgctggtcatctatcaagataaagagcggcctcgagggatccctgagcgtattctcgtggcctaccgaacgtcccgggaaacaccgacgcccaccctacgaccatccgaacgccgggacccaaggcctagtggatgacggctgaacttattacgtgtcgacggacggtgggacagacaatctgcaacaacgaggtccttacggaacgtcgggacagggtcacgtcgtacgtacgcacgaccgaaccgccctaaaccccg

SEQ ID NO: 124045 - DNA, 779 bp, Homo sapiens
  misc_feature: GYAE6OF01EL1A7.37.38.D05.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctgganatgaagttgggaaaataaatntgcttgctggtatcgagacagaacggccggaccagtcccctgtgcgtggtcatctatacgaagataagagcggcctacgacgggactccgtagacgtcgtaacgttctacgtcggtaccctaccgtaaaccggtacccgggaaacctacgaccgaccccgtaacccgtacgaaccctacgttacccgaacgggaccccggggaacccacgggtaaccttaggtacgggtaacgtagggtaacggtaccgtttaacggtaaacctttaacgtttaacgttaccggttaaccgaacgggtaaccggggttacggggtaaaccaaccggtaaaccgtaaacgtttaaccgtacggaacccgaaacccgtaaaccggtaccgggtttaaccggttaacccggggtaaaccgggttaccggggtaacccggtaacgggttaacccgtaccggttttaaccccgggtacccgtttaaacgggttacccgaaacccgggaaccccccgtaaaccgggtaacccccccttaaaacccccggg

SEQ ID NO: 124046 - DNA, 525 bp, Homo sapiens
  misc_feature: GYAE6OF01C2YHP.37.38.D05.1.454.CMB.1.raw
  modified_base (324)..(324): a, c, t, g, unknown or other
  misc_feature (324)..(324): n is a, c, g, or t
  modified_base (503)..(525): a, c, t, g, unknown or other
  misc_feature (503)..(525): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggcctccaactccgggaacacagccaccctgaccatcagccgggacccaggctatggatgaggctgactattactgtcagacgtgggacagcaatctgccacaacgnggtcttcggaacgtgggaccagggtctaagtccgtacctaggtcacgaccccgaacggccccaaccccgatcgtacctaccttccttaccggttcccccaaccccttccctctaacttccctaacctacgttacgtcggacggtccggggtactcgggacgaacgggccacgataggcnnnnnnnnnnnnnnnnnnnnnnn

SEQ ID NO: 124047 - DNA, 760 bp, Homo sapiens
  misc_feature: GYAE6OF01ERRF7.37.38.D05.1.454.CMB.1.raw
  modified_base (714)..(714): a, c, t, g, unknown or other
  misc_feature (714)..(714): n is a, c, g, or t
  modified_base (720)..(720): a, c, t, g, unknown or other
  misc_feature (720)..(720): n is a, c, g, or t
  modified_base (739)..(739): a, c, t, g, unknown or other
  misc_feature (739)..(739): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtcgtccgtcgtccccgggacagacacgacccaccgatccacctgctcgtaggacgagtacgtaagttagggaaaattaaagtagttcgtacgttgccgttaggtactaccgaaggacgtaacggaaccggtcccgggacccgtaccggttccccccgttagggttccggtaccggttcgggttaccctaacgttaccgtttaacgtaccgtaaaggtaacgttaaaacgggaacggtaccggggtaccttacgggaacgggtacctacccggtacgacggtaccgttaacgttccgttcgggtaccggtcccgttaacccgtaaaccgggttacccgggaaaccctacccgtaccggtaccccgtaacccgtaccgaccgtaccgtaccggaccggggaccggtaacccctaggtaccttacggtacggatcggaacggtacctagtaacgttacgttaccgtggtaccgacgtacgggtacggacacgtactaagtcgtaacgctacgacgtagtccgtacgagtcggtacgngtaccncgtacgttcgtacggccanccccggtaacgccccgtaacg

SEQ ID NO: 124048 - DNA, 633 bp, Homo sapiens
  misc_feature: GYAE6OF01CUEC9.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccgggacagacacgccaccatcacctgctctggagatgaattggaaaataaatatgcttgctggtatcgagcagaacgccgggcctacggtcccctgtcgctggtcatctatcaagataaggagcggctagagggtactccgtgacgcgtacttcgtcgcggcctaccgaacgtccggaacacgacgtaccccaccgtacgaaccctgaccgaacgggacccgggtaacccagggtaactacggtaggagttcggaacggttctacggaactttacgtacgtcggtacgaaggtaccggtacgggaacaggtacctaaacgtacgtacgacgtaaccaacggtccgttaccgtaacgggaaccgtcgggaaccgtacgggtaccacggttacgtaccctagggacccaaccggtaccccgaaccgtaccccgtaaaccccg

SEQ ID NO: 124049 - DNA, 688 bp, Homo sapiens
  misc_feature: GYAE6OF01C3Y3U.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtgtccccgggacagacagccaccatcacctgctctggagatagaattagggaaataatatgcttgctggtatcagcagaacgccggccacgtcccctgtcgctggtcatctatacaagataagacgcggctacgacggactccgtgacgcgtacttctcgtgcctaccaacgtaccggaaccacgaccgacccaccgtacgaaccctacgtaccggacgggacccgggacccgaggtaccgtaggtacgggtacgtacgggaacgggtctacgtaacctttacgtttaccgtggttaccgaacgggtaccgggttagggaaccgttaacgggaacctaaacgttaccgttacggaacccgtaaaccgtaacggttacggttacccgttaaacggggaaccggttaccggggaacccgttagggttaccctacggtttacccggtaccggttaacggttacccgaaccggtaacccccgaaacggtaccccctaaaaccccgg

SEQ ID NO: 124050 - DNA, 500 bp, Homo sapiens
  misc_feature: GYAE6OF01BH5K0.37.38.D05.1.454.CMB.1.raw
  modified_base (391)..(391): a, c, t, g, unknown or other
  misc_feature (391)..(391): n is a, c, g, or t
  modified_base (446)..(446): a, c, t, g, unknown or other
  misc_feature (446)..(446): n is a, c, g, or t
  modified_base (476)..(500): a, c, t, g, unknown or other
  misc_feature (476)..(500): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcaggccgggacccaggctatggatgaggctgactattactgtcaggacgtgggacagcaatactgacaacaactaggtcttacggaacgtcgggacagggtcagtcgtcctaggtcacgcccgaacggcccaaaccccncgtcgtcctaccttccgttccgttccccgcccctccgtacacttccaacactacngacggcggtctggacgaggccacagtacgnnnnnnnnnnnnnnnnnnnnnnnnn

SEQ ID NO: 124051 - DNA, 576 bp, Homo sapiens
  misc_feature: GYAE6OF01AVYQK.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtccccctgtgctggtcatctatacaagataagaagcgggcctcgagggactcccgtgagcgtattcctctcggcctaccaaccgtcccgggaacacacgcccacccctcgacccagtccacggaccgggaccccaggctagtggagtggagctagactattactgtcaggtcgtgggacagacaatactacgacaacgaacgacggttaccgttacgggaaacccggtcgggacccgtaaggggtccagttcccggtccgttaacgggtccaacggcccccgaaaggccccctaaacccccg

SEQ ID NO: 124052 - DNA, 560 bp, Homo sapiens
  misc_feature: GYAE6OF01BT91R.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaacgccggccacgtcccctgtgcgtggtcatctatacaagataagaagcggctcgaggactccgtgagcgtattctacgtcgcctaccacgtaccggaacacgacgcccacctcgaccactcgacggacccggaccgaggactagtggagtcgacggtctagacttattacgtgtacgagacggtaggacagactaatacgtcacaacgacgtacggtcctaacggacggtcgggtaccgtacgggtctacgttccgtaccgtacggccaacggcccctaacggcccctaaaccccg

SEQ ID NO: 124053 - DNA, 184 bp, Homo sapiens
  misc_feature: GYAE6OF01DHOA7.37.38.D05.1.454.CMB.1.raw
  modified_base (176)..(184): a, c, t, g, unknown or other
  misc_feature (176)..(184): n is a, c, g, or t
tcagtagtgtagatcacgaccggtgctcgatttagtatctgataggttgggtttggggggtttggtggtctccactcccgccttgacggggctgccatctgccttccaaaccccatgtcactctgttccccaccctcctcatctacactactgagcgggctggcaaggcgcatagnnnnnnnnn

SEQ ID NO: 124054 - DNA, 614 bp, Homo sapiens
  misc_feature: GYAE6OF01DARG6.37.38.D05.1.454.CMB.1.raw
  modified_base (590)..(594): a, c, t, g, unknown or other
  misc_feature (590)..(594): n is a, c, g, or t
  modified_base (596)..(608): a, c, t, g, unknown or other
  misc_feature (596)..(608): n is a, c, g, or t
  modified_base (610)..(614): a, c, t, g, unknown or other
  misc_feature (610)..(614): n is a, c, g, or t
tcagtagtgtagatcacgaccggtgctcgatttagtatctgatagttgggtttgggcagtgtccgtgtccccgggacagacagccaccatcacctgctctggagatgaattgggaaaataaatatgcttgctggtatcagcagaagccgggccagtcccctgtgctggtcatctatcaagataaagaagccgggcctcgagggactccctgagcgattctctggctccaactccgggaacacacgccaccctgaccatcagccggaccaggctatgatgaggctgactattactgtcagcggtagggacagacaatacgtgaccaacgaacgtaggttaccgttacggaaaccgttcggggaaacccgacggggttacaacgtttcccggtaccgttaaccggttcgaaccggacccccgaaaacgggtccccccaaaccccccgtactcggttaccctaccgttacccgttcccgttcccccccggtaccccctttccctaccctaacttacccttaacctaccgttaaccgttcggaccggtccggggttcctacggggaccgaaacggggtcccgtacacgttaggnnnnncnnnnnnnnnnnnnannnnn

SEQ ID NO: 124055 - DNA, 733 bp, Homo sapiens
  misc_feature: GYAE6OF01ATI8W.37.38.D05.1.454.CMB.1.raw
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctnagtgtccgtcgtccccggganagaccacgccaccatccacctgctcgtaggagagtagtaagttaggaaaattaatagtgtcttgtacgttaggtatacgagacgaaggaacggcccgggtacctacggttccccgtggtcgtaccgttcggtacacttacgtactacgaaagtaagtaaacggtaacggccgggtacctacggacgggtacctccggtagacgtcgtacttccgtcgtacgtccgtaacccgaaccggtacccggaaacctaccgaccgacccgtacccgtacgaaccctacgtacccgaacgggtaccccgggaacctaacgggtacgtacggtacgggtacgtacggacggtcgtacggtaacttacgttacgtcgtaacggacgggtaccggaacggtaccgaacgtaacctaacgttaccgacgaccgaacggtacgttacgggttaccgtaccgggtaacggccgggtaacgtacgggtactaccggttacggtacgtaccggtacccgaaccggacccgaacccgaccccgtaaccccg

SEQ ID NO: 124056 - DNA, 841 bp, Homo sapiens
  misc_feature: GYAE6OF01AR8TQ.37.38.D05.1.454.CMB.1.raw
  modified_base (708)..(708): a, c, t, g, unknown or other
  misc_feature (708)..(708): n is a, c, g, or t
tcagtagtgtagatcacgaccggtgctcgatttagtatctgatagttgggtttgggggcgtgggcctcaggaaggcagcatcggaggtgcctcgagccatggcatggatccctcttcttcctcggcgtccttgtcttactgcacgaggagtccgtcggtcccttccttagtggtaacgttacggtaacttcaacgccctaccctcgtaggtcgtccggtcggtccccgggacgtacgacgacgccaccactccaccgtcgtcctcgtaggagtagtagtaagttagggaaaacttaaagtagttcggtcgttacgtcgttaggttactacgaggtacgaacggaacgggtcccgggtaccgtaccggttccccgtacggtcgtccgttacggtacgtacgttacgtaagtacgaaaggtaacgtaaacggtaacgggacccgggaccgtacggtacgggtaccgtaccggtaggtacgtacgtacttacgtcgtacggtaccctaaccggtaaacccgtaccgggaaaccgtaaccgacccgtacccgtacccgttacgaaccctacgtacccggaacgggaccccgggaaaccgtacggaaccgttaaggtaggtaacgtacggggaacgtacgttaacgtaccgtttaacgttcgtaacgtaccggtaacggtacgggtacgaacgtacgtaacctaagttaccgngaaccgaacgtaaggttaccggtcggttaaaccgggtaacgtacgggtaacccggtagggtacccttaccggtccggttaaccggttacggacccggtaacccggaacccggtaacccgtaccccgtaacccg

SEQ ID NO: 124057 - DNA, 725 bp, Homo sapiens
  misc_feature: GYAE6OF01DW14L.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccgggacagacacgccaccatccacctgctctggagatgaattagggaaataatatgcttgctggtatcagcagaacgccggccacgtcccctgtgctggtctatctatacaagataagaagccggctacgagggactccgtgacgcgtacttcgtacgtcgacctacccgaacgtcccgggaaaccaccgtacgacccctaacccgtcgaacccgtacgtaccgaaccgggacccggggaacccctacgggtaaccttaagggtacggaacgttacgggaacgggttaccgtacggttaaccgtttaactttaaccgtcggttacggaacggtaccgggttacgggaaacctacggtaactaaaccgttacgtacgaccgaaaccgtaaccggtacggttcccggttaacccgggtaaaccgggttccggggtaaacccggtcggggttaccaaaccggtttccggttaccccgggtaacggtacccgtaacccggaaccccgtaaaccccgggacccctaaaaccccccgg

SEQ ID NO: 124058 - DNA, 674 bp, Homo sapiens
  misc_feature: GYAE6OF01DYQEG.37.38.D05.1.454.CMB.1.raw
tcagtagtgtagatcacgaccggtgctcgatttagtatctgatagttgggtttgggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacacgcccaccatccacctgctcgtggagatagtaagttaagggaaaattaaatatgtcgttgacgttaggtactcgagacgaaggaacggcccgggacctccgtcccctggtcgcgttgtcatctatacaagaataaagacggccggtctacggacggtaccttccgaggacgtacgtacttcgtcgtcggtacctacccgtaaccggaccggaaacaccgaccgacccctaaccgtacgaccctaagccggaaccgggcccggtaacccgaaggtcctaaggtggaacgtcggacggtcgtaataacttacttacgtgtaaccgaggtaacgggtaggaactacgtaactaacggttcaggaaccaaacgtacgttacggtcccgttaacggacggtaccgggtaaccgtgggtacctacggttccgtaaccgttcggaacccacggaaccccgtaccggacccctaaacccg

SEQ ID NO: 124059 - DNA, 728 bp, Homo sapiens
  misc_feature: GYAE6OF01D6JRR.37.38.D05.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccacatcacctgctctgganatgaattagggaaataaatatgtacttgctggtatcagcagaacgccggccacgtcccctgtcgcgtggtcatctatcaagataagaacgcggactacgagggctccgtagacgtcgtattacctcgtggcctaccgaaccgtcccgggaaaccaccacgacccaacccgtcgaaccaataccgaacgggacccgggaaccccaagggtcctaaggtacgggtaacgtacgggtacggtacgtacggttaacgttaacgttttaccgtacggttaccgaacgggttaaccgggttaacgggggaacctaacgggtaacctaaacgttaaccgttacgaacccgaaacctaaaccggttacgggttacccgttttaaccgggaaaccgggtttacggggaaacccgtaacgggggttcccaacggtttaccccggttaacccggttacgggtaaccccgtaacccggaaccccccggtaaaccgggaccccccctaaaacccccgg

SEQ ID NO: 124060 - DNA, 765 bp, Homo sapiens
  misc_feature: GYAE6OF01BUQVI.37.38.D05.1.454.CMB.1.raw
  modified_base (231)..(231): a, c, t, g, unknown or other
  misc_feature (231)..(231): n is a, c, g, or t
  modified_base (550)..(550): a, c, t, g, unknown or other
  misc_feature (550)..(550): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgcccaccctcagtcgtccgtcgtccccgggacagacacgccaccatccacctgctcgtgganatagaagttaggaaaattaaatatgtacttgcgttaggtatccgagccgaaggaacggcccgggacctaccgtccccgttggtcgtcgtggtactacgttactaacttacgaaagtaacgtaaaggaacggtccgggtacctacggaacgggtaccttcccgtaggacggtaccgttacgttaccgtcgttccggaccttaacccgaaaccggttacccgggaaacccaccgtaacccgtacccccgtaacccgttaccgaaccctacgtaccggaccgggaacccggggaacctacgggtactacgggtacgtaacgngggtaacggtacttaccgaacgtttacgttacgttacggacgtaacgggtcggtaacgggaaccctaaggtaaccctaaagtccgtacaacccgtaacgtaacggtccggttaccgttacgggaaccggtcgggtaaccgtagggtaccttaacgggtcccgtttaacccgaaggtccgaaccccgtaccggaaacccgtcccccgaaaaccccg

SEQ ID NO: 124061 - DNA, 629 bp, Homo sapiens
  misc_feature: GYAE6OF01AYE96.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattaggaaataaatatgcttgcgtggtatcgagcagacgccgggcacgtccctgtcgcgtggtcatctatacaagataagagcgggctcgaggactccgtagacgcgtattcctcgtcgcctaccgaacgttacccgggaaacacgacgacccaccctagacctactcgacggaccgggaccaggactaggtgtagcggtagctacgtacttaacgttacgtagtcgaaggtacggtagggaacacgtaacctaacgttacgtacgaccaaccgtaaacgtacgggttaccgtaacgggtaaccggttaccggggaaccgtacgggtcctaccggtttacccggttacccgtacgggttacccgaacgacccccgtaaaccgggtccccctaaacccccgg

SEQ ID NO: 124062 - DNA, 558 bp, Homo sapiens
  misc_feature: GYAE6OF01CYOKN.37.38.D05.1.454.CMB.1.raw
  modified_base (267)..(267): a, c, t, g, unknown or other
  misc_feature (267)..(267): n is a, c, g, or t
  modified_base (345)..(345): a, c, t, g, unknown or other
  misc_feature (345)..(345): n is a, c, g, or t
  modified_base (445)..(445): a, c, t, g, unknown or other
  misc_feature (445)..(445): n is a, c, g, or t
  modified_base (473)..(473): a, c, t, g, unknown or other
  misc_feature (473)..(473): n is a, c, g, or t
  modified_base (537)..(558): a, c, t, g, unknown or other
  misc_feature (537)..(558): n is a, c, g, or t
tcagtagtgtagatcacgaccggtgctcgatttagtatctgatagttgggtttgggcagtgtccgtgtccccgggacagacagccaccatcacctgctctggagatgaattagggaaaataaatatgcttgctggtatcagcagaagccgggccacgtccccgtgctggtcatctatcaagataaagaagcgggcctcgagggactccctgagcgattctctcggcctaccgaacgtcccgggaacacacgcccaaccctgaaccanccacggccgggacccaggctagtggatggaggctagaacttattacgtgtcgagacggtggacagaccaaaattcganacgaacaagtaggtccttacggaacgtcggggaaccctaagggcctaagtccggtaccgtaaggtaccaaccgaccccaaacggtaccccaaaacccctntacgtaccaccttcctccgttacccccnccctacctacacttcctaacgaacttagtcgacgccggtcgtaggaccgaacgcgtacaagcgnnnnnnnnnnnnnnnnnnnnnn

SEQ ID NO: 124063 - DNA, 700 bp, Homo sapiens
  misc_feature: GYAE6OF01B7S8V.37.38.D05.1.454.CMB.1.raw
  modified_base (470)..(470): a, c, t, g, unknown or other
  misc_feature (470)..(470): n is a, c, g, or t
tcagtagtgtagatcacgaccggtgctcgatttagtatctgatagttgggtttgggggctgggcctcaggaagtagcatcggaggtgcctcagccatggcatcggatccctctcttccctcggcgtccttgcttactgcacaggatccgtgcctcctatgaactgaactcacgcccaccctcacgtcgtccgtcggtcccccgggactcgacacgcccaccgattccaccgtgacctcgtggacgtagttaggaacgttagggaaacttaaacgtatgtacttggcgttggtactcgagcgtaggaacggccgggcctacgtcccccgtgtcacgtcgtacctattaccgttatacgtaaagtagtaacggacggccgggtcctacgacgggtaccttcccggtcgacgtcggtacttccgtcgtcggacctacccgaacgtaccgggaactcacgtacccctacccgtnaccgactccgaacggccggtaccgaggtacgtacgtaggcgtaggcgtacgttacgtaactttagttacctggtacacggtacggtacgacctacgaactaaccttaccgtacgtaccaaccgtaacgggtacggttaccgtaaccgggtaacgtaccgggacgtacggtaccgtacttcccggtacgtaccggtcacccggaacccaaccggtcccctaaccggtaccc

SEQ ID NO: 124064 - DNA, 651 bp, Homo sapiens
  misc_feature: GYAE6OF01BW52B.37.38.D05.1.454.CMB.1.raw
  modified_base (533)..(533): a, c, t, g, unknown or other
  misc_feature (533)..(533): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtcccgggacagacagccaccatcacctgctcgtggagtatgaagttagggaaataaatatgcttagcttggtatcagcaagacggccggccacgtcccctgtgcgtggtcatctatacgaagaataaggagtcggccgtacgaggactccgtagacgcgtattctctcgggtacctacccgaacggtacccgggaaccacgacccgaccctaccccgtacgaacccacgtaccgaacgggacccggaccccgagtaccgtaggtacggacgtagggacggtctagtaacgttaacgtttcgtacgttaccgacgggtaaccggtaggggaaccaggaaccgttaanaccgtagacctaacgaacgtaggttaccgtaacgggacggtccgggaaccgacgggtactacgtacccgggttcgtaacggtacggacccggaccctaacggaccccctaaaccccgg

SEQ ID NO: 124065 - DNA, 746 bp, Homo sapiens
  misc_feature: GYAE6OF01CL92B.37.38.D05.1.454.CMB.1.raw
  modified_base (249)..(249): a, c, t, g, unknown or other
  misc_feature (249)..(249): n is a, c, g, or t
  modified_base (713)..(713): a, c, t, g, unknown or other
  misc_feature (713)..(713): n is a, c, g, or t
  modified_base (719)..(720): a, c, t, g, unknown or other
  misc_feature (719)..(720): n is a, c, g, or t
  modified_base (725)..(725): a, c, t, g, unknown or other
  misc_feature (725)..(725): n is a, c, g, or t
  modified_base (730)..(731): a, c, t, g, unknown or other
  misc_feature (730)..(731): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
  modified_base (741)..(746): a, c, t, g, unknown or other
  misc_feature (741)..(746): n is a, c, g, or t
tcagtagtgtagatcacgaccggtgctcgatttagtatctgatagttgggtttgggcagtgtccgtgtccccgggacagacagccaccatcacctgctctggagatgaattggaaataaatatgcttgctggtatcagcagaagccggccagtcccctgtgctggtcatctatcaagataagaagcgggcctcgagggactcccgtgagcgtatttcctcgtcggcctacccgaaccgtccgggaaacncacgcccacctgaccatcgagccgggacccagggacctatacgggattgacggccttggaacctttagtttaacctcggttacgaacgggtaaccggttggggaacctaacgggacctaaaacgttacctacggtacccaaaccgtaaaaccgtacgggtttacctttaccgggaaaccgttacgggggaacccgtaaggggttacccaacgtttacccgggttacccgttaacggggtacccaaccggacccccgtaaaaccgggcccccaaaccccccgtagttaccggttaccctaaaccctttccccgtttacccggtttacccccccccggtaccccctttaccccgttaccttaaccgtttacccgtttaaacccgtaacccgtttttacccggacggaaccgggtccggggtaccgttcggggaccccgaaacgggtcccgaacaccgttagacgcncgcacnngcgcnacgcnncncncngncnnnnnn

SEQ ID NO: 124066 - DNA, 602 bp, Homo sapiens
  misc_feature: GYAE6OF01EOB9G.37.38.D05.1.454.CMB.1.raw
  modified_base (224)..(224): a, c, t, g, unknown or other
  misc_feature (224)..(224): n is a, c, g, or t
  modified_base (378)..(378): a, c, t, g, unknown or other
  misc_feature (378)..(378): n is a, c, g, or t
tcagtagtgtagatcacgaccggtgctcgatttagtatctgatagttgggtttgggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcactgctctgganatgaagttagggaaaataaatatgtcttgctggtatcagcagaacgccggcacgtccccgtgtgctggtctactctatacaagaactaaggaacggcgggacctagacggactccgagagcgtattcgtcgtacgctaccaacgtaccggaacncacgaccacctagaccatcacgggaccggaccgaggactagtggatggagctagtacttagttactgacaggtacggtacgggtaacagtacaacttacgtacgacaaccgaacgtaggttcccgtaaccgggtaacggtacgggtaaccggtagggtacctaacgttccggtacccgttacggaccgtaaccgggaccctaaccgggaacccctaaaccccgg

SEQ ID NO: 124067 - DNA, 680 bp, Homo sapiens
  misc_feature: GYAE6OF01CWSXM.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacagccaccatcacctgctctggagatgaattgggaaataaatatgcttgctggtatcagcagaacgccgggccacgtcccctgtgcctggtcatctatcaagataagagcggcctacgaggactcctgacgctattctcgtggtacctacccgtaaccgtccgggaaaccaccgaccgacccaaccccgttcgaaccctacgtccgacgggaccccgggaacccagggtactaacggtagggacgtggaacgggtcttaacgtacttaacgtttaccgtcggttacgtaacggtaaccgggtagggaaccgacgacctaaagttaccctacgaccgaaaccgtaaaccggtacggtttaccggttacccgggaaaccggtaccgggggaacccttaagggggtccctacggtttacccggttacccggtaacgggttaccacccgggtaacccccaaacggacccccctaaaacccccg

SEQ ID NO: 124068 - DNA, 633 bp, Homo sapiens
  misc_feature: GYAE6OF01C3TJL.37.38.D05.1.454.CMB.1.raw
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataatangcttgctggtatcagcagaacgccggccagtcccctgtcgctggtcatctatcaagataagaaggcgggcctcgagggntcctgagctattctctggcctaccgaacgtcccgggaaacacgacgcccaccctacgaccactccgacggccgggtaaccccaggtcctaagtgggattcggaacggtccttagaccgtttattaccgttcgtacgtacggtacggttacgggactaaggtactaaacgtcctacgaccgaaccgtaaacggtacgggttaccgttaccgggaaccgtacgggggtaacccgttaacgggtcctaacggttcccggttaccgtaacgggttaccaaccggtaaccccgaacccggccccctaaacccccgg

SEQ ID NO: 124069 - DNA, 787 bp, Homo sapiens
  misc_feature: GYAE6OF01CJTS8.37.38.D05.1.454.CMB.1.raw
  modified_base (200)..(200): a, c, t, g, unknown or other
  misc_feature (200)..(200): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtcgtccgtcgtccccggganagacacgccaccactccacctgctcgtaggagatagtaagtaggaaaataatagtggtcttgctggtatcgaagcaggaacggccgggcctacgtccccctggtcgtcgtcggtcaacgttctaatacgaaagaagtaaacggaacgggtccggggaccctacgggaacgggtacctaccccggtaggacggaccgttacgttccgtacgttcggtaccctaacccgtaacccggtaccgggaaaccaacccgtacccggacccctaaccccgttacgaacccgtaacgtcccgggaaccgggaccccggggaaccccgtacgggtactacgggttaggacgtacgggaacggtctaacggtaaccttacgtttacgtcgtacgggtaacgggtacggtacgggaacgacggtaacgaaccgtttacggaccgtaaccgaaaccggtaacgggttaccggttaccggtaacccgggtaacggtcccggggtaaaccggtcgggttaacccttaaccgggttccgttaacccggtaacggttcccggaacccggtaacccccgtaacgggaacccccctaaacccccg

SEQ ID NO: 124070 - DNA, 797 bp, Homo sapiens
  misc_feature: GYAE6OF01C4IY0.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtgtccgtcgtccccgggacagacacgccaccatcacctgctctggagatagaagttaggaaaataatatgtcttgctggtatcagcaagaacggccggaccacgtcccctgtcgcgtggcatctatacaagtataaagacggccgggacctacggacgggtacctacccgtaggtacggtacgttaactttccgttaccggtcgggtaccctaaccccggtaaacccggtaccccgggggaaaaccaacccggaacccgtaccccccgtaaccccgttacggaaacccctaccgtacccggaaccggggtaccccggggaaaccccgtacgggtaccgttaaggtacggggaacgttacgggtaacgggtaccgtttaccggtaaaccgtttaacgtttaaccgttacggtaaccggtaacgggttaaccgggtagggaaaccgtacggtaaccgtaaacgttacgtaacgacctaaacgtaaccggttaaggttaccgttaccgggtaaaccgggttaccgggaaccgttacgggtaccgttaaccggttacccggttacccggtacggtaacccgaccggtaaacccccggaccggtaacccccctaaaccccgg

SEQ ID NO: 124071 - DNA, 499 bp, Homo sapiens
  misc_feature: GYAE6OF01EK1DW.37.38.D05.1.454.CMB.1.raw
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (477)..(499): a, c, t, g, unknown or other
  misc_feature (477)..(499): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagagcgggcctcagggatccctgagcgattctcgtggcctacccaacgtccgggaacacgagcccaccctgaccatcgaggccgggacccaggctagtggatggagctagacttattactgtcagtcgtagggactaggacaatctgaccaacgaacgacggttcgttacggaacgtgggaccctaggtcacgtcgtaccaggtcacgcccaaggcccaacccntcgtcactctcgtcccctctccnctatcctacactcgtgacggcggatacggcgaacggcgactangcngnnnnnnnnnnnnnnnnnnnnnnn

SEQ ID NO: 124072 - DNA, 196 bp, Homo sapiens
  misc_feature: GYAE6OF01CU37C.37.38.D05.1.454.CMB.1.raw
  modified_base (111)..(111): a, c, t, g, unknown or other
  misc_feature (111)..(111): n is a, c, g, or t
  modified_base (166)..(166): a, c, t, g, unknown or other
  misc_feature (166)..(166): n is a, c, g, or t
  modified_base (171)..(196): a, c, t, g, unknown or other
  misc_feature (171)..(196): n is a, c, g, or t
tcagtagtgtagatcacgaccggtgctcgatttagtatctgatagttgggtttgggggtttggtggtctccactcccgcttgacgggctgccatctgccttccaacccccntgtcactctgttcccaccctcctcatctacactactgagcgggctgggcaaggcncatgnnnnnnnnnnnnnnnnnnnnnnnnnn

SEQ ID NO: 124073 - DNA, 570 bp, Homo sapiens
  misc_feature: GYAE6OF01DOV2V.37.38.D05.1.454.CMB.1.raw
  modified_base (299)..(299): a, c, t, g, unknown or other
  misc_feature (299)..(299): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (540)..(540): a, c, t, g, unknown or other
  misc_feature (540)..(540): n is a, c, g, or t
  modified_base (548)..(548): a, c, t, g, unknown or other
  misc_feature (548)..(548): n is a, c, g, or t
  modified_base (550)..(554): a, c, t, g, unknown or other
  misc_feature (550)..(554): n is a, c, g, or t
  modified_base (556)..(558): a, c, t, g, unknown or other
  misc_feature (556)..(558): n is a, c, g, or t
  modified_base (560)..(562): a, c, t, g, unknown or other
  misc_feature (560)..(562): n is a, c, g, or t
  modified_base (564)..(570): a, c, t, g, unknown or other
  misc_feature (564)..(570): n is a, c, g, or t
tcagtagtgtagatcacgaccggtgctcgatttagtatctgatagttgggtttgggcagtgtccgtgtccccgggacagacagccaccatcacctgctctggagatgaattgggaaaataaatatgcttgctggtatcagcagaagccggccagtcccctgtgctggtcatctatcaagataagaagcgggcctcgagggatcccgtgagcgattccgtcgtggctccaacctccggaaacacgagcccacctgaacctatcacgccgggaccaggctatggatgagctgactattacngtcaggacgtaggacaggctaaagtctcgacaacgaacgaacggtccgttacggaaacgtacgggaacccgagggttacctagttaccggtacctaggtccgtacgaccccgaaacggccccaaaccccgtactcggtaccacccttcctaccgtttccccnccccgttacnccgtaacttcctaaccgaacgttaccgtacggacggccgggcttcgggacgaacggcgtacactacggnatcacgcncnnnnngnnncnnntnnnnnnn

SEQ ID NO: 124074 - DNA, 173 bp, Homo sapiens
  misc_feature: GYAE6OF01CEJMF.37.38.D05.1.454.CMB.1.raw
  modified_base (172)..(173): a, c, t, g, unknown or other
  misc_feature (172)..(173): n is a, c, g, or t
tcagtagtgtagatcacgaccggtgctcgatttagtatctgatagttgggtttgggggtttggtggtctccactcccgccttgacggggctgccatctgccttccaaccccactgtcactctgttcccaccctctcatctacactactgagcgggctggcaaggcgcatagnn

SEQ ID NO: 124075 - DNA, 698 bp, Homo sapiens
  misc_feature: GYAE6OF01ENE5Y.37.38.D05.1.454.CMB.1.raw
  modified_base (178)..(178): a, c, t, g, unknown or other
  misc_feature (178)..(178): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (310)..(310): a, c, t, g, unknown or other
  misc_feature (310)..(310): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagcccaccctnagtgtccgtcgtccccggganagaccngccacatcactgctctgganatagaattagggaaaattaaatatgtacttgcgtggtatcgagcaaggacgccggccacgtcccctggtcgcgtggtacatctanacaagaactaagacggcggcctacgacgggactccgtaggacgtacgtattcctcgtcggacctaccgaaccgtaccggaaacaccgaccgaccctacccgtacgacccagtaccgtacgggacccgggaccgaggtaccgtagtcggaacgttcgggagtccgtagtaacgttacgttaacgtcgtaaccgtaaggtacgggtagggaaccaggtaacctaaacggttaccgtacggaacccgtaaccggtaaacggtaccggtttaccgtaaaccgggtaaccggggttaccggggaaccgtacgggttaccgttaccgttcccggtacggttaaccgggtacccgacccgtaaaccccgaaaccccgggcccctaaacccccggg

SEQ ID NO: 124076 - DNA, 767 bp, Homo sapiens
  misc_feature: GYAE6OF01D7RKZ.37.38.D05.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccacctcagtcgtccgtgtccccggganagacagccacatcacctgctctggagatgaattagggaaataaatntgcttgctggtancagcagaacggccggccacgtcccctgtcgcgtggtctatctatacaagataagacgcggcctacgaggtactccgtagacgtcgtacttcgtacgtggtccctaccgaacgtacccgggaaactaccgacgaccccgtaaccctacgaaccctaacgtacccggaaccggggtaccccggggaaccccctaaggggtaccttaacgggtacggggtaacgttacgggtaaccgggtccgttaacgttaaaccgtttaaccgtttaaccgttcggtaaccgtaacgggtaaccgggttacggggaacctacgtaacgtaaacgttacccgtaacgaccctaaaccgtaaaccggttacggggttacccgtttaaaccggggaaccgggttacgggggtaaaccccgttagggggttacccctaaccgggttttacccgaaccccgggtttaaacgggtacccgaaacccgggtaacccccggaaaccgggtacccccctaaaaccccccgg

SEQ ID NO: 124077 - DNA, 321 bp, Homo sapiens
  misc_feature: GYAE6OF01D0697.37.38.D05.1.454.CMB.1.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (313)..(321): a, c, t, g, unknown or other
  misc_feature (313)..(321): n is a, c, g, or t
tcagtagtgtagatcacgaccggtgctcgatttagtatctgatagttggggggtctcaggaggcagcgctctcaggacatctccaccatggcctgggctctgctgctcctcaccctcctcactcagggcacaggtcctgggcccagtctgccctgactcagcctgcctcgtgtctgggtctcctggacagtcgatcacctatcctcctgcccgtaggaaccngcaggtgacgttgcagcccaaggcctcgcccctgtcactctcgtcccncctcncatcacnctactggagcggctggacaacggcacatagnnnnnnnnn

SEQ ID NO: 124078 - DNA, 666 bp, Homo sapiens
  misc_feature: GYAE6OF01AMGSU.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacacgccaccatcacctgctctggagatgaattagggaaataaatatgcttgctggtatcagcaggaacgccgggctacgtcccctgtcgcgtggtcatctatacaagtaagtaagaacggccgggacctcgaggactccgagacgcgtatccgtcgtcggacctaccgaaccgtaccgggaaccacgaccgcccctaacccgtacgaacccagtaccgaacggacccgggtaacccgaggtacctaggtacggtaacgacggtacggtctacgttaccgttaatttaccgtcgttaaccggaacgggtaaccgggtacgggaaccgaacgtaaccgtaaacgttaccgtacgaacccgtaacgtaacgtccgggtttacgtaccgggtaaacgggtccgggaacgtacgggtacctacgtccggtaccgtacggtacccacgaccccgaacgtccccgtaacccg

SEQ ID NO: 124079 - DNA, 595 bp, Homo sapiens
  misc_feature: GYAE6OF01ARJP2.37.38.D05.1.454.CMB.1.raw
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(574): a, c, t, g, unknown or other
  misc_feature (572)..(574): n is a, c, g, or t
  modified_base (576)..(579): a, c, t, g, unknown or other
  misc_feature (576)..(579): n is a, c, g, or t
  modified_base (581)..(586): a, c, t, g, unknown or other
  misc_feature (581)..(586): n is a, c, g, or t
  modified_base (588)..(588): a, c, t, g, unknown or other
  misc_feature (588)..(588): n is a, c, g, or t
  modified_base (590)..(595): a, c, t, g, unknown or other
  misc_feature (590)..(595): n is a, c, g, or t
tcagtagtgtagatcacgaccggtgctcgatttagtatctgatagttgggtttgggcagtgtccgtgtccccgggacagacagccaccatcacctgctctggagatgaattgggaaaataaatatgcttgctggtatcagcagaagccgggccagtcccctgtgctggtcatctatcaagataaagaagcgggcctcagggactcccgtgagcgatttctcgtggcctaccaaccgtccgggaaaccacacgcccaccctgaccatcgacggccgggacccaggctagtcggatgaggctagacttattacgtgtacgagacggtgggaacagactaaatactcgacaacaacgtacggtccgttaacggaacggtcgggaccgtacgggtctacgtccgttacgtacggtccaaccggaccccgaaacggacccccaaccccgtcttcgtacctaccttccgttcccgttcccccgtaccccttcccgtactaacttccctacctaccgtaccgtcggaccggtccgggcggtacgggaccgtaacgggcgtacgaagtacgngcncnncnnncnnnncnnnnnncncnnnnnn

SEQ ID NO: 124080 - DNA, 776 bp, Homo sapiens
  misc_feature: GYAE6OF01EH378.37.38.D05.1.454.CMB.1.raw
  modified_base (745)..(745): a, c, t, g, unknown or other
  misc_feature (745)..(745): n is a, c, g, or t
  modified_base (747)..(747): a, c, t, g, unknown or other
  misc_feature (747)..(747): n is a, c, g, or t
  modified_base (749)..(749): a, c, t, g, unknown or other
  misc_feature (749)..(749): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
  modified_base (760)..(760): a, c, t, g, unknown or other
  misc_feature (760)..(760): n is a, c, g, or t
  modified_base (764)..(766): a, c, t, g, unknown or other
  misc_feature (764)..(766): n is a, c, g, or t
  modified_base (768)..(768): a, c, t, g, unknown or other
  misc_feature (768)..(768): n is a, c, g, or t
  modified_base (770)..(771): a, c, t, g, unknown or other
  misc_feature (770)..(771): n is a, c, g, or t
  modified_base (773)..(773): a, c, t, g, unknown or other
  misc_feature (773)..(773): n is a, c, g, or t
  modified_base (775)..(775): a, c, t, g, unknown or other
  misc_feature (775)..(775): n is a, c, g, or t
tcagtagtgtagatcacgaccggtgctcgatttagtatctgatagttgggtttgggcagtgtccgtgtccccgggacagacagccaccatcacctgctctggagatgaattagggaaataaatatgcttgctggtatcagcagacgccgggccagtccctgtgctgtctatctatacgaagaataagaacggccgggtcctcgacgggtactcccgtggacgcgtactttccgtcgtcggtcctaacccgaacccgtacccgggaaacctaccgaccggcccctaaccccgtacgaaccctaacgtacccgaccggggacccggggtaacccccgtacgggtaccttaacgggttacggaagttacggtacgggtaccttaacggtaacctttaacgttaccggtttcggaaccggtaagggtacccgggtagggaacctaacggaaccttaaataccgtagtacccaaacgtaacggttaacggttaccggttaaccgggaacgggtttcgggaaaccccggtaggttacctacgtacccggtttacggtacgtaccgacccgaacccggaaccgaccccctaacccgtacgtacgtacccttaccgtttcccgtacccgttaccccctacccgttaccctaaccgtaccttacccgttaacctaacccgttaaccggtccggtaccgggtccggtccgtaacgggaccgaaagggcccgtaacgtagtacgcgctagcgtacncncncncncncgctngcannncncnncngnc

SEQ ID NO: 124081 - DNA, 605 bp, Homo sapiens
  misc_feature: GYAE6OF01ASMDZ.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatccacctgctctggagatgaattgggaaataaatatgcttgctggtatcagcagaagccgggcacgtcccctgtgctggtcatctatcaagataacgagcggactcgagggactcccgtgacgcgtacttcgtctggcctccaacgtccgggaacacacgcccacccgtggaacccacgtccgaaggcccgggtacccaggtactacgtgggattcggaggtctagacgttactttacgtcgtactaggtacggtacgggaacacgtacgaacttacctgaaccaccgtaaacgacgggttaccgttaccgggaacgttcggggaaccgtacggggttctaccggttccgtaccgtaacggtaccgacgtacccccgaagggccccctaaaccccg

SEQ ID NO: 124082 - DNA, 524 bp, Homo sapiens
  misc_feature: GYAE6OF01A04WS.37.38.D05.1.454.CMB.1.raw
  modified_base (498)..(498): a, c, t, g, unknown or other
  misc_feature (498)..(498): n is a, c, g, or t
  modified_base (501)..(506): a, c, t, g, unknown or other
  misc_feature (501)..(506): n is a, c, g, or t
  modified_base (508)..(509): a, c, t, g, unknown or other
  misc_feature (508)..(509): n is a, c, g, or t
  modified_base (511)..(515): a, c, t, g, unknown or other
  misc_feature (511)..(515): n is a, c, g, or t
  modified_base (517)..(517): a, c, t, g, unknown or other
  misc_feature (517)..(517): n is a, c, g, or t
  modified_base (519)..(520): a, c, t, g, unknown or other
  misc_feature (519)..(520): n is a, c, g, or t
  modified_base (522)..(524): a, c, t, g, unknown or other
  misc_feature (522)..(524): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagccggacccaggctatggatgacgctgactattactgtcagcggtggacagacaatactgaccaacaacgacggttccgttacggaacgttcggggaaccagggtccagttccgtacctaggtcacgaccccgaaaggccccaaccccactcgtaccacgttcctccgttccccaccccgttcctacacttccgtaaccacttacgtgacggccggtctgggctaacggcgacagtagctgctncgnnnnnngnncnnnnncncnncnnn

SEQ ID NO: 124083 - DNA, 580 bp, Homo sapiens
  misc_feature: GYAE6OF01DX6YH.37.38.D05.1.454.CMB.1.raw
  modified_base (487)..(487): a, c, t, g, unknown or other
  misc_feature (487)..(487): n is a, c, g, or t
  modified_base (562)..(580): a, c, t, g, unknown or other
  misc_feature (562)..(580): n is a, c, g, or t
tcagtagtgtagatcacgaccggtgctcgatttagtatctgatagttgggtttgggcagtgtccgtgtccccgggacagacagccaccatcaccctgctctggagatgaattgggaaataaatatgcttgctggtatcagcagaagccgggccacgtcccctgtgctggtcatctatcaagataagagcgggcctcgagggactccctgagcgtacttcctcgtcggcctacccaaaccgtacccgggaacacacgcccaccctgaccatcgacggccgggacccaggtctagtggagtggacggtctagtaacctttattaccgtgtacgaggacgggtaggacagtaccaatactagaccaacgaacgtggttaccgtacggacggtacgggaccgtaggtactacgttcgtaccgtagaccaacgaccccgaaaccggccccaaccctcgttcgtacctacccgttcctcccggtttccccccncccttacgtccaaccgttcctaccgacttacgtaggaccggtcggcgtagggacccgaaggtccaacagtacgcnnnnnnnnnnnnnnnnnnn

SEQ ID NO: 124084 - DNA, 755 bp, Homo sapiens
  misc_feature: GYAE6OF01BIQPN.37.38.D05.1.454.CMB.1.raw
  modified_base (135)..(135): a, c, t, g, unknown or other
  misc_feature (135)..(135): n is a, c, g, or t
  modified_base (650)..(650): a, c, t, g, unknown or other
  misc_feature (650)..(650): n is a, c, g, or t
  modified_base (701)..(701): a, c, t, g, unknown or other
  misc_feature (701)..(701): n is a, c, g, or t
  modified_base (708)..(708): a, c, t, g, unknown or other
  misc_feature (708)..(708): n is a, c, g, or t
tcagtagtgtagatcacgaccggtgctcgatttagtatctgatagttgggtttggggctgggcctcaggaagcagcatcggaggtgcctcagccatggcatggactccctctcttcctcggcgtccttgcttacngcacgaggtactccggtcgcctcctatacgaactgactcacgccctaccctcagtcgtccggtccggtcccgggacacgaccacgcccaaccactccaccgtcgtctcgtagggaagtagtaggtaaaggttaagggtaaaattaaagttagtcgttcgttacgacgttaggttaactacgaacggacgaacggaacccgggccggtaccctacccggttcccgtggtcgtaccggtcgtaccgtactaccgtaataaccgaaaggtaacgtaacgggaccgggtccggtaccgtacggtacggtacccttacggaggtacgtcgttacttccgtcgaccgtaccctaaccggtaacccggaccggaaccacgccctacccgtaccgtacaccgttagacccgggacgggaccccgaacgtcgggtagtacgggtagaccggtagaccggttataccggttaatttacgtcgtacggaacgtacggtaacgggtggaaaccctaggtataaccgngtaccaaacggacctacgggttcgttaccggaacgtacgggccggttaacnggtaccnggttacccgacgtacggacccaacccgacccgttaaccacccgtacc

SEQ ID NO: 124085 - DNA, 634 bp, Homo sapiens
  misc_feature: GYAE6OF01B40CE.37.38.D05.1.454.CMB.1.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtgcctcctatgaactgactcacgccaccctcagtcgtccgtcgtcccgggacagacncgccacatcacctgctcgngganatagaagttaggaaataatangtctgctaggtatcagcgagaacggccggactacgtccgtgcgcgtgtcattcagtacaagtaagaacgacggcggtcctaggacgggactccgtaggacgacgtcgttcctacgcgtaccctaaccgtaaccgaccgggaaccacgaccgacccacccgtacgacacgtcgaccgggacccggaccgtaggtactacgtaggtacgtacggacgtactcgtaacttacgttacgacgtagtaccgggaggttacgggaacacggtaactaagttcgacaaccgaacgtaacgtacggttacgtaccgggaacggtcggaccgtacggttcaccgttcgtaccggttaggacccgaaccggtaacccaacgggtaccccctaaaccg

SEQ ID NO: 124086 - DNA, 782 bp, Homo sapiens
  misc_feature: GYAE6OF01EJID2.37.38.D05.1.454.CMB.1.raw
  modified_base (197)..(197): a, c, t, g, unknown or other
  misc_feature (197)..(197): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatcgtggcctcctatgaactgactcagccaccctcagtcgtccgtgtccccggganagacacgccactatcacctgctcgtaggagtatagaagttaggaaaattaaatagtgtaccgtttagaccgttagggtactacgacggacgaaggaaccggcccggggtacctaccgttcccccgttggtacggtccggtttcgggtacctaacgttaccttaagtaaccgaaaggtaaacgttaaaggaaaccggtccggggtaccctacgggaagggtacctacccgtaggacgtacgtacgtttcctacgtacggtaccctaaccgtaaccgtacccgggaaacaccgaccgtaccctaaccctacgaacctaccgtaccggaacgggtccccgggaaccgtacggtaacgtaaggttacggtaagttacgggacggtacctaggttaacttacggttactcggtacgtaacggacggttaggaaccgtagtaaccgtaagttaccgtcggaaccaaggtaccggtaacggttccgtaaacgggaccggttaagggacccgttaacgggtccgtaacggtttccggaacggttaacccggtaccgaacccgaaacccggtaacgtaaccccccgtaaacccg

SEQ ID NO: 124087 - DNA, 694 bp, Homo sapiens
  misc_feature: GYAE6OF01CY3EI.37.38.D05.1.454.CMB.1.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacacgccaccatcacctgctctggagatagaattgggaaaataatatgtcttgctggtatcagcagaagccgtcnccgtacctcccgtgcgtcgtcgtactactactatacgaagtaagtaaacggacggccggacctacggacggtacctccgtgacgtcgtacttcgcgtcgacctacccgacgtaccggaaccacgtaccgccctaccgtacgaaccctacggtccgaaccgggaccccgggaacccgtaggtccgttaaagcgggtactacgggtccggtaccttacgggtaaccttttaacgtaccggtttaaggtaccaaacggggtacggttacgggaacacggtacttaacgtacgcgaaccctaaacgtacggtacggtttacccggtaacggtaaaccgggtccggaacccgggttaggtacccttaacgttccccggtaaccgttacggtacccaacccggtacccgaaccccgtaaacccccg

SEQ ID NO: 124088 - DNA, 515 bp, Homo sapiens
  misc_feature: GYAE6OF01EWAGO.37.38.D05.1.454.CMB.1.raw
  modified_base (245)..(245): a, c, t, g, unknown or other
  misc_feature (245)..(245): n is a, c, g, or t
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (495)..(496): a, c, t, g, unknown or other
  misc_feature (495)..(496): n is a, c, g, or t
  modified_base (498)..(499): a, c, t, g, unknown or other
  misc_feature (498)..(499): n is a, c, g, or t
  modified_base (501)..(506): a, c, t, g, unknown or other
  misc_feature (501)..(506): n is a, c, g, or t
  modified_base (508)..(508): a, c, t, g, unknown or other
  misc_feature (508)..(508): n is a, c, g, or t
  modified_base (510)..(515): a, c, t, g, unknown or other
  misc_feature (510)..(515): n is a, c, g, or t
tcagtagtgtagatcacgaccggtgctcgatttagtatctgatagttgggttttggggcagtgtcccgtgtcccccggggacagacagccaccatcaccctgctctggagatgaattagggaaataaatatgcttgctggtatcagcagaagccgggccagtcccctgtgctggtcatcatcaagataagaagcgggcctcaggggatccctgagcgattctctgctccaactaccgggaacacnccgccaccctcgaccactcacgcgggacccaggctatggatgaggctacgactacttactcgtgaagacggtggggacagcaaatactgcacaaacaggtcttacggaactgggaccgagggtcatcgtcctacggtcacgcccaacggcccnaaccccacctcgtccacctcctcgttccccgncccctcctccnctactacctacctacgacggcggccgtcggacgaacggacgctacgtaagtagnncnncnnnnnncncnnnnnn

SEQ ID NO: 124089 - DNA, 746 bp, Homo sapiens
  misc_feature: GYAE6OF01DT1V4.37.38.D05.1.454.CMB.1.raw
  modified_base (117)..(117): a, c, t, g, unknown or other
  misc_feature (117)..(117): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagtagtgtagatcacgaccggtgctcgatttagtatctgatagttgggtttggggctgggcctcaggaagcagcatcggaggtgcctcagccatggcatggatccctctcttccncggcgtccttgcttactgcacaggatccgtggccctcctatcgaactgactcacgcccaccctcagtcgtccgtcggtccccgganacgacacgccaccatccacctgctctgganatagtaagtaggaaaataatagtcgtcgttgcgttagtactcgaagacgaacggaaccggccccggacctaccgtcccccgtggtcgtacggttcggtctacgttcctaacaacgtaaagtaagtaaacgggacggtccgggtacctaccggaacgggtacctcccggtaggaccgtacgttacttccgttacgccggtaccctaaccgtaacccggtacccggaaactaccgaccgtaccccaccgtaccgaactccgtacggaccgggacccggtaccgtacggtacgtaacggtcggaacgtagggccgtaaccgtcgttaaccgtttacgttaccgttacgtaccggaacggtcccgggtaaggaccctaaggtaactaaccgttacggacgaacccaaggtaccggtcggttaacccgtacgggaaaccggttcgggaacgttacggtctaccggttaccgtacggtacgtacccgaacccggacccgaaccgtaccccccgtaaccg

SEQ ID NO: 124090 - DNA, 216 bp, Homo sapiens
  misc_feature: GYAE6OF01B1LKF.37.38.D05.1.454.CMB.1.raw
  modified_base (185)..(216): a, c, t, g, unknown or other
  misc_feature (185)..(216): n is a, c, g, or t
tcagtagtgtagatcacgaccggtgctcgatttagtatctgatagttgggtttggggggtttggtgggtcctacccactccccgccttggacggggctcgccatctgccttccaacccccactgtcactctgttcccgccctcctcatccttacactactgagcgggctggcaaggccgcatagnnnnnnnnnnnnnnnnnnnnnnnnnnnnnnnn

SEQ ID NO: 124091 - DNA, 654 bp, Homo sapiens
  misc_feature: GYAE6OF01DHICL.37.38.D05.1.454.CMB.1.raw
  modified_base (179)..(179): a, c, t, g, unknown or other
  misc_feature (179)..(179): n is a, c, g, or t
  modified_base (382)..(382): a, c, t, g, unknown or other
  misc_feature (382)..(382): n is a, c, g, or t
  modified_base (553)..(553): a, c, t, g, unknown or other
  misc_feature (553)..(553): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgcccaccctnagtcgtccggtcggtccccgggacagaccacgcccaccatccacctgcctcgtggagataggtaagttaagggaaaattaatatgtcttgcgttggtactcagcgaggaacggcccgggacacgtccccgtgtcggtactggtactacttactaactacgaaagaacgtaaaggacggccgggtcctaggacgggtactccgngacgtcgtacttccgtgtcgccctaccgtaaccgtaccgggaaccaccgaccgccccaccgtcaaccgtactaccggacgggacccgggacccgtaggtactaggtacggagtcgggacgtcgtacgtactttacgttacgtacgacggtacggacggtacgacgtacganacgtctacgacacgtaacgtggttaccgtacgggaccgtacgggacgtacggtctaccgtccggtacgtacgaccaccggtaaccgacccgccctaacccg

SEQ ID NO: 124092 - DNA, 519 bp, Homo sapiens
  misc_feature: GYAE6OF01DX7U1.37.38.D05.1.454.CMB.1.raw
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (411)..(411): a, c, t, g, unknown or other
  misc_feature (411)..(411): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
  modified_base (504)..(519): a, c, t, g, unknown or other
  misc_feature (504)..(519): n is a, c, g, or t
tcagtagtgtagatcacgaccggtgctcgatttagtatctgatagttgggtttgggcagtgtccgtgtccccgggacagacagccaccatcacctgctctggagatgaattgggaaaataaatatgcttgctggtatcagcagaagccgggccagtcccctgtgctggtcatctatcaagataagaagccgggcctcgagggactccctgagcgtattctctggcctaccaaccgtccgggaacacagcccacctgaccatcgagccggaccngctagngatgagctgactattacngtacaggcgtggacagctaatacncgacaacgacgtggttctacggaacgtcgggaacctagggtcacgttccgtccgtagtccgacgacccctaacggaccccaaaccccgtntccgtaccaccttccgtacccgttccccgccccttcgactactcccgtaacnccgtacgtggcggtccggntcggacgaacgcgtacaagtgnnnnnnnnnnnnnnnn

SEQ ID NO: 124093 - DNA, 832 bp, Homo sapiens
  misc_feature: GYAE6OF01D6JN2.37.38.D05.1.454.CMB.1.raw
tcagtagtgtagatcacgaccggtgctcgatttagtatctgatagttgggtttgggcagtgtccgtgtccccgggacagacagccaccatcacctgctctggagatgaattggaaataaatatgcttgctggtatcgagcagaagccgggccagtcccctgtgctggtcatctatcaagataagaagcggcctcgagggactccctgacgtcgtattcctcgtcggccctaccgaaaccgttcccggggaaaccaaccgaaccgtcccctaaccccttcgaaccctaagttaccgaaccggacccgggggaaacccccaagggtacccgttaagtaggggtaaaccttagggaacgggtccgtttacggtaaaccttttaaacgtttaaccggttggtttaccggaaacggggtaaccgggttagggggaacccacgggtaactaaacgtttacgtacggaacctaaaccgtaaaccggttacgggttacccgttaccggtaaaccgtcgggggaaaccctaggggttcctaacgttcccggttaaccggtaacgggtcccgaaaccggtaacccccgaaaacggtacccccctaaaacccccgtacgttcgttaccccgacctttacccgttcccgtttacccccccgtaccccttcccgtacctaacgttaccccttaacccgtaaccgtttaccggtacggtaccggttccggggcccttaacgggggaccctaaacggggacctaacgtaacggttaacgtacgtcgactacgcgcgtactacgcgtcgacgacgtactacgctacgcacgtcacactcgtcgtcgtc

SEQ ID NO: 124094 - DNA, 693 bp, Homo sapiens
  misc_feature: GYAE6OF01E1A6I.37.38.D05.1.454.CMB.1.raw
  modified_base (652)..(652): a, c, t, g, unknown or other
  misc_feature (652)..(652): n is a, c, g, or t
  modified_base (656)..(656): a, c, t, g, unknown or other
  misc_feature (656)..(656): n is a, c, g, or t
  modified_base (661)..(661): a, c, t, g, unknown or other
  misc_feature (661)..(661): n is a, c, g, or t
  modified_base (664)..(664): a, c, t, g, unknown or other
  misc_feature (664)..(664): n is a, c, g, or t
  modified_base (668)..(669): a, c, t, g, unknown or other
  misc_feature (668)..(669): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
  modified_base (692)..(692): a, c, t, g, unknown or other
  misc_feature (692)..(692): n is a, c, g, or t
tcagtagtgtagatcacgaccggtgctcgatttagtatctgatagttgggtttgggcagtgtccgtgtcccccgggacagacagccaccatcacctgctctggagatgaattgggaaaataaatatgcttgctggtatcagcagaacgcccgggccacgtcccctgtgctggtcatctatcaagataagacggccggcctcgagggactcccgtgacgcgtacttcctcgtcggcctaccgaaccggtacccggaacaccgaccgccccaccctacgacccagtccgacggacccgggtacccaggtacctaggtcggatcggacgtctagtacttacttccgtgtacgacggtacggtacggaacacgaactaatccgtacgaaccaaccgtaacgtacggttccgttaaccggtaaccgtaggggacccgtagggtactacggttcccgtaccgtaggtacccaacccgaccgaacccggaccccaaccccgtgttacccgtacccttaccgttcccccgttccccgtttacccccccgtacccttaccctacgtaacctttaccccgaacccgttaccgtttaccgggcggtacccgggccgggtacgtacccgggaacgaccgggtccctaaggaccgttgatcacgntacncagcnacncgcnncncncncacgacncancncgcgng

SEQ ID NO: 124095 - DNA, 623 bp, Homo sapiens
  misc_feature: GYAE6OF01EZIB8.37.38.D05.1.454.CMB.1.raw
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (602)..(604): a, c, t, g, unknown or other
  misc_feature (602)..(604): n is a, c, g, or t
  modified_base (606)..(608): a, c, t, g, unknown or other
  misc_feature (606)..(608): n is a, c, g, or t
  modified_base (610)..(623): a, c, t, g, unknown or other
  misc_feature (610)..(623): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcggcctcagggactcctgagcgattctctggctaccgaacgtccggaacacacgccaccctagaccatccaggccgggacccaggcctagtgatggaggctagacttagttacctgtcgaggacggttgggacagacaatacctagaccaacaacgacggtcttacggaaacgtcgggacgacgggtcatccggtaccgtaggtaccacggaacccccgaaacggtcccccaaaccccgtaccgtttacgtccctaaccgttcccttaccggtttaccccccgcccctttaacccttacctaaccgtttaaccctaaaccccgtaaccgtttaaccggtacggtaaccggggccccgggttcggtacgggacccgtaaacgggcccggtaaccggtaagtcggacgtcnganagnnngnnngnnnnnnnnnnnnnn

SEQ ID NO: 124096 - DNA, 787 bp, Homo sapiens
  misc_feature: GYAE6OF01DI8NW.37.38.D05.1.454.CMB.1.raw
  modified_base (137)..(137): a, c, t, g, unknown or other
  misc_feature (137)..(137): n is a, c, g, or t
  modified_base (198)..(198): a, c, t, g, unknown or other
  misc_feature (198)..(198): n is a, c, g, or t
  modified_base (500)..(500): a, c, t, g, unknown or other
  misc_feature (500)..(500): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtcttgcttactgcanaggactccgtgcctctatgactgactcacgcccacctcagtcgtccgtcggtccccggganagaccgacgcccaacactccgaccgtgtcctacgtggaacgtagttaagtaaggttaaggaaaaattaaagttagtcggttacgtttagccgtttaggtaacttcgaacggacgaacggaaccgggccccggtacctccggttcccgttggtacgtccgtacggtctaacttacgtaataacggaagtaagtaaacggaccgggtaccggtaccgtacggaacggtcctacccggtaggtaacggtccttacgtttcccgcggttacgtacccgtaacccgtaaccggtaacccggaaaccnccgacccggtaccctaccgacaaccgtacgacggaccgggacccggaccgtacggtacttaggtacggtacgtacggacgttacgtaacgttacttacgtttacgtacgtacggtaacggtcggtaacgacgtaactacgtaactacgtaccgaaccgtaaccggtacgttaccggtaccggttaaccgggaccgggttacggaaccggttccgaaccggttaccggttaccgtaccgggtaaccgtacccggaaacccgaccccggtacccggaaccccctaaccg

SEQ ID NO: 124097 - DNA, 535 bp, Homo sapiens
  misc_feature: GYAE6OF01BP1NU.37.38.D05.1.454.CMB.1.raw
  modified_base (499)..(500): a, c, t, g, unknown or other
  misc_feature (499)..(500): n is a, c, g, or t
  modified_base (503)..(506): a, c, t, g, unknown or other
  misc_feature (503)..(506): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (533)..(535): a, c, t, g, unknown or other
  misc_feature (533)..(535): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcgagcggaccaggctatgatgaggctgactattactgtcaggacgtgggaacagacaatactgacaacaacaggtacttacggaacgtcgggaaccagggtcacgtcgtcgtaggtcacgacccaaacggcccaaaccccactcgtaccaccttcttaccgttccccacccttccctacaacttcctaaccaccttacgtaggaccggcgggtacgtacggacgtaaacgggccacaacgtagacgnnacnnnnananancanancananacanacanacnnn

SEQ ID NO: 124098 - DNA, 864 bp, Homo sapiens
  misc_feature: GYAE6OF01A02SY.37.38.D05.1.454.CMB.1.raw
  modified_base (810)..(810): a, c, t, g, unknown or other
  misc_feature (810)..(810): n is a, c, g, or t
  modified_base (821)..(821): a, c, t, g, unknown or other
  misc_feature (821)..(821): n is a, c, g, or t
  modified_base (838)..(838): a, c, t, g, unknown or other
  misc_feature (838)..(838): n is a, c, g, or t
  modified_base (853)..(853): a, c, t, g, unknown or other
  misc_feature (853)..(853): n is a, c, g, or t
  modified_base (862)..(862): a, c, t, g, unknown or other
  misc_feature (862)..(862): n is a, c, g, or t
tcagtagtgtagatcacgaccggtgctcgatttagtatctgatagttggggtttgggcagtgtccgtgtccccgggacagacagccaccatcacctgcctctggagatgaattgggaataaatatgcttgcgtggtatcagcagaacgccgggccacgtcccctgtgctggtccatctatcaagataagaggcggcctcgacggatcccgtgagtcgtattctccgtcggccttaccgaacgtcccgggaacaccgacgcccgtaccgtacgaaccctataccgaaccggtccgggtaacccgacggtacgttaacgtagggtaacgtacggacgggttcctttaaggacctttacgtttaccgttacggtaccgtaacgggtaccgggttacgggacctaaacgggtactttaacgttaacccggtacggtaaccccgtaaaaccgtaaaccggttaaccggtttaccggttaccgggtaaaccggttaccggggtaacccggttaacgggtttaaccgtaccggtttaacccgggtttaccgttaaaccgggtcccgtaaacccgggttacccccgaaaccgggtaaccccccttaaacccggttaccccgttacccggttaacccttaacccggtttccccgtttaacccccgggttaacccccttaccccccgttacccgttaaccgtactttaaaccccgggtaacccctttaaccggttaccggtaaccggtaacggtacccggggtaccctaacgggtaacccgggtacggtcccgaccgttaacgtcgaccttacggacgtnacgcgtaccgntgtacgagccgtatacncgatccgagttccanaggtctgcncg

SEQ ID NO: 124099 - DNA, 180 bp, Homo sapiens
  misc_feature: GYAE6OF01BR5O4.37.38.D05.1.454.CMB.1.raw
  modified_base (174)..(180): a, c, t, g, unknown or other
  misc_feature (174)..(180): n is a, c, g, or t
tcagtagtgtagatcacgaccggtgctcgatttagtatctgatagttgggtttgggggtttggtggtctccactcccgccttgacggggctgccatctgccttccaaccccactgtcactctcgttcccgccctcctcatctacactactgagcgggctggcaaggcgcatagnnnnnnn

SEQ ID NO: 124100 - DNA, 603 bp, Homo sapiens
  misc_feature: GYAE6OF01BFLZJ.37.38.D05.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgcccaccctcagtcgtccgtcgtccccggganagacngccaccatccacctgctcgtaggagatgaagttagggaaaataaatatgtcttgctggtatcgagacaaggaacggccgggccacggtccccctggtcgcgtcggtcatctatacgaagaataaggaacggccgggacctcgagggtacctcccgtaggacgtcgtattcctcgtacggcctaccgaacgtccgggaacacgacgcccaccgtacaccagtccgacggccggaccaggactagtacggagtacggagtctagtactacgttactcgactacggtcgtacggacacgtactactacgagaccacgtacgtaggttcctaacgggacgtcggacgtacgggtccacgtaccgtacgtacggacaaccgcccgaaccggcccctaacccg

SEQ ID NO: 124101 - DNA, 751 bp, Homo sapiens
  misc_feature: GYAE6OF01EO2MX.37.38.D05.1.454.CMB.1.raw
  modified_base (177)..(177): a, c, t, g, unknown or other
  misc_feature (177)..(177): n is a, c, g, or t
  modified_base (226)..(226): a, c, t, g, unknown or other
  misc_feature (226)..(226): n is a, c, g, or t
  modified_base (339)..(339): a, c, t, g, unknown or other
  misc_feature (339)..(339): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctnagtgtccgtcgtccccgggacagacagcccaccatcacctgctctgganatgaattagggaaaataaatatgcttgcgtgtatcagcagacgccggccacgtcccctgtcgctcggtcatctatacaaggactaagaacggcggtcctcgacgggactccgnggtacgcgtattcctacgtcggcctaccaaccgtaccgggaacaccacgtacccaccgtacgaacctatccgaaggccccgggaaccgtaggtaccgtaagtagggtaactaggggtaacgtccgttaacggtacttttaacgttaccgttagggtaaccgtaacgggtacccggggtacgggaaccggtaaccgggtaacgttaaaccgttaccgtacgaaacccggtaaaccgaaacccgggtttaccggggttccccggtttaaacgggaaacccggggtttaaccgggggaccccggtaaacggggttcccggtaacccggtttccccggtaaccgtttaacccgggtaccccggtaacccggaaacccccgggtaaaccccggttcccccccggtaaaaccccccgg

SEQ ID NO: 124102 - DNA, 837 bp, Homo sapiens
  misc_feature: GYAE6OF01E4J0P.37.38.D05.1.454.CMB.1.raw
  modified_base (215)..(215): a, c, t, g, unknown or other
  misc_feature (215)..(215): n is a, c, g, or t
tcagtagtgtagatcacgaccggtgctcgatttagtatctgatagttgggtttggggctgggcctcaggagcagcatcggaggtgcctcagcatggcatggactccctctcttccctcggcgtccttgcttactgcacaggactccgtcggcctcctagtgaactgactcaacgccctaccctcgacgttcgtccggtaccggtacccccggganagaccacgacccaaccatccacgtcgcctacggtggaagtataaggtaaagtagggtaaaaattaaatgtacgtcttacgtaccgttggttacaccgtagacggaacggtaccggccgggttacccacggttcccctaggttctcgtacggtctataccttaagaacgtaagaacgtaaagggaccgtcccggtacgacggtacggtaccgtccttaggacggtcttaaccgttcgttaccgtcgtaccgtaaacccgtacccgggtacccgaaaccgtacccgaacccgtacccctacccggttaacccgcttaaccccggtaccggtaaccggggtaaccccgggtaaccccgtaacggggtaaccgttaagggttaacgggtttacggacggtaacgggttaacccgttacgttaaccgttttaaccgtaacgggtttacggtaaaccgtaacgggtaccgggtaacgggtaaccgtaaccgtaaccgttaactaacccgtaactaaccgtaaccgtaacggtaaccggtaacccggtaacgggtacccggacggtaacgtccggtaactccgtacgttaccgtaccgacgacccgacgaacccccgacccctaacccg

SEQ ID NO: 124103 - DNA, 826 bp, Homo sapiens
  misc_feature: GYAE6OF01CPI7B.37.38.D05.1.454.CMB.1.raw
  modified_base (284)..(284): a, c, t, g, unknown or other
  misc_feature (284)..(284): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggactccgtggcctcctatgaactgactcacgcccacctcagtcgtccgtcggtcccgggacagacacgacccaccactaccacctgctcgtggaagagtagtaagttagggaaaataaattagtgtcgttgtcgtaggttaacncgaacggtacgaacggaacggtccccgggacctaccggttcccccgtaggtcggtccgttggtacctaacgttactaacgtaacgaaagtaacgtaaaacgggaacgggtcccgggtaccttacgggaacggtacccgtaccgtagaacggtcgttaacgttccgttacggtccggtaccccgtaaccggtaaaccccggtacccgggaaaccgacccgtacccggaacccctaccgaccggtaaccacgtacggacccggaccggggtaccaacgggtactttaagggacggtacggtacggtaccggtataacgttaacttaacgtttacgtaccggtaccggtaacggtacgggtaccggaagtaccgggtaactaaaccgttacgacgaacctaaacccggtacggtaaccgggtttaaccgtaaccgggtaaccggttacgggaaccggttaaccgggtccttaacccggttaccggtaccgggtaccgttacccggaacccggttaaccccggaaacccgtaacccccgtaacccg

SEQ ID NO: 124104 - DNA, 832 bp, Homo sapiens
  misc_feature: GYAE6OF01DU7EE.37.38.D05.1.454.CMB.1.raw
  modified_base (207)..(207): a, c, t, g, unknown or other
  misc_feature (207)..(207): n is a, c, g, or t
tcagtagtgtagatcacgaccggtgctcgatttagtatctgatagttgggtttggggctgggcctcaggaagcagcatcgggaggtgcctcagccatggcatggactccctctcttcctcggcgtccttgcttactgcacaggactccggtcggcctcctatcgaactgactcacgcccacctcagtcgtccgtcggtccccggganagacacgccaccatccacctcgtctcgtaggagagttaggtaaagttagggaaaataatagtgtcgttgcgttaggtatcgagtacgaaggacggcccggtaccaccggtccccgttggtcggtcgtcggttacctattacttaagtaaccgtaaaggtaacgtaaacgggaccgggtaccgggtacccgtacgggtaaccgggtaccttaaccccgtggtaaccggtacttacgtttccgtacggtaccggtaccctaacccggtaaccggtacccgggaaacctaccgtaacccgacccctacccgttacggaaccctacggtaccggaccgggtacccgggtacccggtaggtaccgtagggtagacggtcgggtacgttaccgtaagttaactttacgttacggtacggtacggaacggtaccgggtaaccgggaactaaacggggttaacctaaacttacccggaaccgacgtaaaccggtaaccggttaccgggttaacccggttacgggtaaaccgggtacccgggtaccgggttaacgggtacttacccggttaccggtaaaccgtaccggtacccggaaacccggacccccgaaacccggtaaccccgtaaccccg

SEQ ID NO: 124105 - DNA, 646 bp, Homo sapiens
  misc_feature: GYAE6OF01AKS23.37.38.D05.1.454.CMB.1.raw
  modified_base (616)..(617): a, c, t, g, unknown or other
  misc_feature (616)..(617): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (639)..(640): a, c, t, g, unknown or other
  misc_feature (639)..(640): n is a, c, g, or t
  modified_base (642)..(642): a, c, t, g, unknown or other
  misc_feature (642)..(642): n is a, c, g, or t
tcagtagtgtagatcacgaccggtgctcgatttagtatctgatagttgggtttgggcagtgtccgtgtcccggacagacagccaccatcacctgctctggagatgaattggaaataaatatgcttgctggtatcagcagaagccggccagtcccctgtgctggtcatctatcaagataagagcggcctcgagggactcccgtgagcgattcgtcgtggctaccaacgtccgggaacacacggacccaacccgtcgaaccataccgacggaccgggaccccaggcttagtcggactggaacggtcgtagtaacttactttaccgtcgttacgacggtacggtacggggaacacgactaaacgttacgttcgaacctaacgaaaccgtagggttccgttaacggaaccgttacggggaacccgtagggttacctacggttacccgtaccgtaggtaccgaaccggaccccggtaaacgaccccaaccccgtaacggttcctaccgtacctttccgtccccgttacccctaccccgttacctacgtaaccttaccgacgttacctacgtccggaaggtccggtcgtaggaccgtaacggcatacgagcgcatgactcgnnagngagnagcncnanctctcanngngtcg

SEQ ID NO: 124106 - DNA, 742 bp, Homo sapiens
  misc_feature: GYAE6OF01CLT2N.37.38.D05.1.454.CMB.1.raw
  modified_base (177)..(177): a, c, t, g, unknown or other
  misc_feature (177)..(177): n is a, c, g, or t
  modified_base (200)..(200): a, c, t, g, unknown or other
  misc_feature (200)..(200): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctnagtcgtccgtcggtccccggganacgacacgccaccatccacctgctcgtgagatacgaagttaggaaataactagtacgtacgtttcgacgttaggtactacgagacgaaggaaccggcccgggtcctacggtcccccgtggtcggtcgttacggtcaacgttcaacgtacaaagtaacgtaaaggaacgggcccggtacgtacggtaacgggacttcccgtagacgtacgtactttccgacgtaccgtacctaccgaaccgtacccggaaactcgaccgaccctaccgtacgacctacgtcgacggcccggaaccgtgtctaagtgagtcgaacgtacgtacgtaacttacgtacgtggtaaccgtacggtaccgggttaagggaaccgtagtaaccgtaacgtaccgtaccgtacaaaaccggttcggaaaccgttaccggttaaccgggaacggttaacccgggtaacccggtagggtaaccccgttaacgtcccggttaaccggttacccggtaaccgacccgtaaaccccggttacccggaaaccccttaaacccccgg

SEQ ID NO: 124107 - DNA, 584 bp, Homo sapiens
  misc_feature: GYAE6OF01DAE5R.37.38.D05.1.454.CMB.1.raw
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (335)..(335): a, c, t, g, unknown or other
  misc_feature (335)..(335): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(565): a, c, t, g, unknown or other
  misc_feature (563)..(565): n is a, c, g, or t
  modified_base (568)..(575): a, c, t, g, unknown or other
  misc_feature (568)..(575): n is a, c, g, or t
  modified_base (577)..(582): a, c, t, g, unknown or other
  misc_feature (577)..(582): n is a, c, g, or t
tcagtagtgtagatcacgaccggtgctcgatttagtatctgatagttgggtttgggcagtgtccgtgtccccgggacagacagccaccatcacctgctctggagatgaattggaaataaatatgcttgctggtatcagcagaagccgggccagtcccctgtgctggtcatctatcaagataagaagccgggcctcgagggactccctgagcgatttcctctcggcctcccaacgtccgggaaacacgacgcccacccngaacccagtcacggccgggaaccaggccttagngganggaggctgacttatactgtcagacgtggacagcaactcgnacaacgaacgtggtccttacggaacgtcgggaacgaggtctagtcgtacctaggtcgaaccgaccccgtaacggaccctaacccctgtccgttccaccttccgtttaccgtccccccgtaccccttccgtaccttaacctcccgttaacgtacccttaaccgtcgggaccgggtccgggtcgtaccgggaacgtacgggccgaccgtaacggtacgngcacncncncnnncgnnnnnnnncnnnnnngc

SEQ ID NO: 124108 - DNA, 762 bp, Homo sapiens
  misc_feature: GYAE6OF01EESDA.37.38.D05.1.454.CMB.1.raw
  modified_base (200)..(200): a, c, t, g, unknown or other
  misc_feature (200)..(200): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgcccaccctcagtgtccgtcggtccccgganacgacagcccaccatccacctgctcgtaggagatagaagttagggaaataaatatagtcttgcgtggtactcagacaggaacggccggccacgtccccgtggtcgtcgtacggtctatctatacaagataacggagccgggtcctcggaggtcctccgtagacgtcgtacttcgtcgtacgtccgtaccgaaccgtaccgggaacctacgaccgtaccctacccgacgaccctacgaccggaccgggtacccgggacccgacggtaccgtaggtacggtaacgttcgggaaccggtttacgtaccgttaactttaaggtttacccgttaggtaccggtaacgggtccggttaacgggaaccgaacggtaccttaaacgtaccggttaccgtaaaccgtaacccgggttaaaccgttaaccggggtttccggtaaacccgggttaaccggtacccgggggtaaacccggttaacgggttccgttaaccgggttcccggttaaaccgttacgggtaacccggacccccggtaaccggaacccggaccccccgttaaaacccccg

SEQ ID NO: 124109 - DNA, 764 bp, Homo sapiens
  misc_feature: GYAE6OF01CZ9HK.37.38.D05.1.454.CMB.1.raw
  modified_base (444)..(444): a, c, t, g, unknown or other
  misc_feature (444)..(444): n is a, c, g, or t
  modified_base (737)..(738): a, c, t, g, unknown or other
  misc_feature (737)..(738): n is a, c, g, or t
  modified_base (740)..(743): a, c, t, g, unknown or other
  misc_feature (740)..(743): n is a, c, g, or t
  modified_base (745)..(749): a, c, t, g, unknown or other
  misc_feature (745)..(749): n is a, c, g, or t
  modified_base (751)..(757): a, c, t, g, unknown or other
  misc_feature (751)..(757): n is a, c, g, or t
  modified_base (759)..(759): a, c, t, g, unknown or other
  misc_feature (759)..(759): n is a, c, g, or t
  modified_base (761)..(764): a, c, t, g, unknown or other
  misc_feature (761)..(764): n is a, c, g, or t
tcagtagtgtagatcacgaccggtgctcgatttagtatctgatagttgggtttgggcagtgtccgtgtccccgggacagacagccaccatcacctgctctggagatgaattagggaaaataaatatgcttgctggtatcagcagaagccggccacgtccctgtcgctggtcattctatacaaagaagtaaaggaacggccgggcctacgaagggaccttcccgagacgcgtactttccgtcgtcgtcctacccgtaaaccggtaccgggaaaccaaccaccggaccccaaccccgtacgaacccacgtccgaaccggggcccgggaaccccgagggtaccttaagggcgggtaagtaggaccggggtacttaggttaaaccctttagtttaaccgcggtttaccggaaggtaaccggcgggtaaacgacgtaacctaaattacncggaaaccaacgtaaccggtacggttacccgttaacgggaaacggtacggggtaacccgtacggggtactaaccgttccggttaaccggtaacggacccgaacccggaccccggttaaacccggaacccctaaacccctacgttacccgtacccttaacccgtcccgtttacccccccgtttaccccacccccctttaccctaactaacccctttaccgttaacccctaacggtacccgtagggtaccccgggaccggtaccggacgtacccgggaagtcccgaagtaactgnncnnnncnnnnncnnnnnnnanannnn

SEQ ID NO: 124110 - DNA, 635 bp, Homo sapiens
  misc_feature: GYAE6OF01AOD90.37.38.D05.1.454.CMB.1.raw
  modified_base (198)..(198): a, c, t, g, unknown or other
  misc_feature (198)..(198): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcatatgaactgactcagccaccctcagtgtccgtcgtccccggganagacagcccacacgtccacctgcctctggacgtagtgaagttagggaaataatagtgtacttgctaggtatcgagtcgaagacgccgggccagtccctgtcgctggttccatcgtatacgaagacgttaaacgaggtccggacctacgagggtactcccgngacgngtacgttctcgtagtcctacctaaccggtccggaacacgacgcccaaccctgaccactacgacgccgggacccaggtctaagtcggatacggacggtaccgtagtacttacgttacgtacgtacgaaccggtcgggtaggaaccaggtacctaaagtccgtagaacctaacgaacggttacgttaccgttaccgggaaccggtacggtaccggtacgtccaacggttccgtaccgtacgggtaccgaccgacccggtaacccggaaccccc

SEQ ID NO: 124111 - DNA, 729 bp, Homo sapiens
  misc_feature: GYAE6OF01ESAVA.37.38.D05.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
  modified_base (709)..(709): a, c, t, g, unknown or other
  misc_feature (709)..(709): n is a, c, g, or t
tcagtagtgtagatcacgaccggtgctcgatttagtatctgatagttgggtttggggctgggcctcaggaagcagcatcggaggtgccctcagccatggcatggatccctctcttcctcggcgtccttgcttactgcacgaggactccggtggcccttcctagtcgaactgactcacgcccaccctnacgttcgtccgtccggtaccccgganacgaccacgcccaccactccgaccgtcgcgtcgtaggactagtagtaaaggtaaggtaaaatatagtgtacgttgngttcgtacagacgacgaacggaccggcccggtacctaccggttccgttaggtcgtcgttcgtctacgttactacgaagaaagtaacgaaggccggccggtacgtacgacggtaccctcgacgtaccgtctacttccggtcgtccgtacccgtaaccgtaccggaaacccgaccgaccgaccctacccgaccgtacctaaccgacggtaacccgggcccgggaccggtaacgtgaccggttaaggcgtacggtacggacggttccgttaacgtttacttaccggtttcgttaacggaccgttaacggtccgtaaggaccgtaaccgtagtaaccgtactaccgacgtaaccggtaactacgggtaccgtacggaacggtccgtacggaccgttaggtcccttcgaccgtacgcgtaacccnccgaacccgaccctaacccg

SEQ ID NO: 124112 - DNA, 726 bp, Homo sapiens
  misc_feature: GYAE6OF01DIA3U.37.38.D05.1.454.CMB.1.raw
  modified_base (688)..(688): a, c, t, g, unknown or other
  misc_feature (688)..(688): n is a, c, g, or t
  modified_base (696)..(697): a, c, t, g, unknown or other
  misc_feature (696)..(697): n is a, c, g, or t
  modified_base (700)..(700): a, c, t, g, unknown or other
  misc_feature (700)..(700): n is a, c, g, or t
  modified_base (702)..(702): a, c, t, g, unknown or other
  misc_feature (702)..(702): n is a, c, g, or t
  modified_base (708)..(708): a, c, t, g, unknown or other
  misc_feature (708)..(708): n is a, c, g, or t
  modified_base (711)..(711): a, c, t, g, unknown or other
  misc_feature (711)..(711): n is a, c, g, or t
  modified_base (715)..(716): a, c, t, g, unknown or other
  misc_feature (715)..(716): n is a, c, g, or t
  modified_base (719)..(721): a, c, t, g, unknown or other
  misc_feature (719)..(721): n is a, c, g, or t
  modified_base (723)..(724): a, c, t, g, unknown or other
  misc_feature (723)..(724): n is a, c, g, or t
  modified_base (726)..(726): a, c, t, g, unknown or other
  misc_feature (726)..(726): n is a, c, g, or t
tcagtagtgtagatcacgaccggtgctcgatttagtatctgatagttgggtttgggcagtgtccgtgtccccgggacagacagccaccatcacctgctctggagatgaattggaaataaatatgcttgctggtatcagcagaacggccgggccacgtcccctgtgctggtcatctatcaagataagaagccgggcctcgagggactcccgtgagcgtattctcgtggcctaccgaaccgtaccggaaccacgaccgacccaccctacgaaccacgtccgaacgggcccgggaacccgaacgggtccttaagtacggacgtagggacggtaccttacggtaactttaacgtttaccttacggtaccgtacggtaacggtacgggaacgaacgtaactaaacgttaccgtaaccgaccctaaacgtaaccgtacggttaccgttccggaacggtaccgggtaccgtaggtacctacgttacgtccgttacgtacccgacgacccgtaaccgacccctaaccccgtcgtacgttcccactttccccgttccggttaccccccctcccgtttcctaaccgtacctttacccgtaaacccaaccgttacccgggttaggacccgggttacccggggtccctaaaccgggggtcccgtaaaccggggaccctttaaccgaacggtccgtagtcnctagcgcnngtnanagtcgngcncgcnntcnnncnngn

SEQ ID NO: 124113 - DNA, 838 bp, Homo sapiens
  misc_feature: GYAE6OF01DJYFT.37.38.D05.1.454.CMB.1.raw
  modified_base (146)..(146): a, c, t, g, unknown or other
  misc_feature (146)..(146): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
  modified_base (558)..(558): a, c, t, g, unknown or other
  misc_feature (558)..(558): n is a, c, g, or t
  modified_base (721)..(721): a, c, t, g, unknown or other
  misc_feature (721)..(721): n is a, c, g, or t
tcagtagtgtagatcacgaccggtgctcgatttagtatctgataggttgggtttggggctgggcctcaggaagcagcatcggaggtgcctcagccatggcagtcggactccctcttcttccgtcggtccgttccttgtccttacgngacacgaggcttccggtcgtccctcctatacggacctgacctcacgtcccaccctgacgttcggtccgtccggccccggganacgacaccgacctaccactccaccgtcncgtacggtagagagtacggttaaaggtaaggaaaattaacgttcgtcgttgttaccgtaggttacgttactaccgacgggaacgaaccggacccggccccggtaccgtccccgtccccggtttggacgttccgtacggttactacgttacgtacgaacggtaaaagaacggttaacgggaccgggtcccgtacccggaaggtacccgccgtacgtcggacttacttcgttacccggccgtccgtaacccgaaccggttaaaccccgggacctaaccgacccggtacccaccccggttaaccncgaccgtacccgaccggtacccgggacccggtaccggtacccggttacgtaacggtacgggtacgtaccggcggttaccggtacgtttaaccggttaaccttacggttacgttacgggaacgggttacggtacggaccgtacgtaacgaccgtacgaccgtanaacggttacgtaccggttaccgacggtacggtaccggtacggtaacggtcgttaccggttacggtaccgtccgtaacccggtaacccgaccccggtaaacccgtcccggtaaccccg

SEQ ID NO: 124114 - DNA, 719 bp, Homo sapiens
  misc_feature: GYAE6OF01AI1TB.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggccctcctatgaactgactcacgcccaccctcagtcgtccgtcgtcccccgggacagacacgccaccatccacctgcctcgtggagagtagtaagttagggaaaataaagtatgtacttgcgttaggtactcgagacgaggaacggcccgggacctaccggttccccttggtcgtccgttcggtacctacgttactaataacgaaagtaagtaaaggaacgggccgggtaccctacggaacgggtacctcccgtaggaccggtacgttacttccgttacgtcggtaccctacccgtaacccggtacccgggaaactaccggaccgacccctaccgtacgacccactaccggaccgggcccgggaccctaggtacttaagtcggtagtacggtcggtactacggtaaccttacgtttaccgtgtacgtacggtacgggtaccgaacgtacgtaacctattaccgtacgaccgtaacgaacggttcggtaccggttaaccggaccggtacgggtacggtcggtctaccggtcgtaccgtacggccgaccgaacccgaccgtccccgtaacccg

SEQ ID NO: 124115 - DNA, 624 bp, Homo sapiens
  misc_feature: GYAE6OF01CK44G.37.38.D05.1.454.CMB.1.raw
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (601)..(603): a, c, t, g, unknown or other
  misc_feature (601)..(603): n is a, c, g, or t
  modified_base (605)..(608): a, c, t, g, unknown or other
  misc_feature (605)..(608): n is a, c, g, or t
  modified_base (610)..(610): a, c, t, g, unknown or other
  misc_feature (610)..(610): n is a, c, g, or t
  modified_base (612)..(613): a, c, t, g, unknown or other
  misc_feature (612)..(613): n is a, c, g, or t
  modified_base (615)..(624): a, c, t, g, unknown or other
  misc_feature (615)..(624): n is a, c, g, or t
tcagtagtgtagatcacgaccggtgctcgatttagtatctgatagttgggtttgggcagtgtccgtgtccccgggacagacagccaccatcacctgctctgggagatagaattgggaaaataaatatgcttgctggtatcagcaggaacggccgggccagtcccctgtgcctggtctatctatacgaaagataaacggaaggccggcctacgagggtactcccgtagacggtccgttattcctcgtacggtccctacccgtaacgaccgggaaaacaccgaccgcccgtaccacgaacnctaccgcggaccggacccagcttagnggatgcgatgaacttattcaggtacacggacggtaggacaaggtactaacgtcgtcgaacctaacgaaccggttcggtaccgtaacggtaacggtccgggaacggtacgtccgtacgttaccgtcgttacggcgtaaacccgacccggaaccgtaaccccctaaccgtctaccgtaccctaccgttccttccccgtcccctccctcctacctactacctactacgtacgtcggacgtcggtcggtaccgacgtaacggcctactaacgngncgnannnannnnangnncnnnnnnnnnn

SEQ ID NO: 124116 - DNA, 721 bp, Homo sapiens
  misc_feature: GYAE6OF01CL2BV.37.38.D05.1.454.CMB.1.raw
  modified_base (262)..(262): a, c, t, g, unknown or other
  misc_feature (262)..(262): n is a, c, g, or t
  modified_base (461)..(461): a, c, t, g, unknown or other
  misc_feature (461)..(461): n is a, c, g, or t
tcagtagtgtagatcacgaccggtgctcgatttagtatctgatagttggggtttggggctgggcctcaggaagcagcatcggaggtgcctcagccatggcatggatccctctcttctcggctccttgcttactgcacgaggactccgtggccctctatagaactgactcacgtccaccctgagtcgtccgtcggtcccggacagacacgccctaccagtccactcgtctcggtaggatataggtaagttaaggaaataagtntgtagttcgtcgtagtactacgagaccggaggacggcccggacgtaccgtccgtagtcgacgttacgtctaacgttacgtaataacgtaaagaacgtaaacgggtccgggacggtccctaagggacgggttacctaccggcggtaacgtcttacgttcgtaaccgtccgtacctaacccgaaaccgggttaccgaaccncgtaccccgacccgtacacgtacaccgtacgaccgggaacccggtacgtacggtacgtaggtacggtaggtacggtaccgtacgttaccgggtaatttacgttaccggtacgtaaccggacgggttaacgaagggtacctacgtaaccgtaacgttacgacgtaccacggtaaccggttcgttacggaccggtaacggtcggacggacggttctccgtacgtaccgtacgaccggtacccaccgtaacgccccggtaacc

SEQ ID NO: 124117 - DNA, 791 bp, Homo sapiens
  misc_feature: GYAE6OF01C49EE.37.38.D05.1.454.CMB.1.raw
  modified_base (154)..(154): a, c, t, g, unknown or other
  misc_feature (154)..(154): n is a, c, g, or t
  modified_base (743)..(743): a, c, t, g, unknown or other
  misc_feature (743)..(743): n is a, c, g, or t
tcagtagtgtagatcacgaccggtgctcgatttagtatctgatagttggggttggggctgggcctcaggaagcagcatcggaggtcgcctcagccatggcatggactccctctacttccgcggcgtccttgcgttactgcacgaggactccggnggtccctccgtaatcggaacctggtacctcacgccctacccgtacaggtacgtcccgtaccggtccccgggaacgaccacgacccacgaatcccacgtgtacttagtacggagtactaggtaaagttaagggaaaattaaactgtacggttacttcggtacgtacggtaactcggaaggactaacgggaacgcccgggtacctaccggttccccgttagtacgtccgttaggactacgttactacaacggaagtacgtaaacgacgggcgtacgacggtacggacctcgagggtacctaggtactttccgtacgtaccggcctaaacccgaacccggtaaccgggaactaacccggaccccgtaccctaacccggtaacgtaaccgtaactaccgggaacccgggttacccggaaccggtaggtaacgttaacgggtggtaacggtaggtaccggtaactacggttacttaaccgtttacgtacggtacgtaacggtacgggtacgggaaccgtacgacgttaacacggttacgaaccgtacggtaaacgtaggttaccgtaacgggaccgttacggacggtacgtacncgttaccgtaccggtctaacgacccgtaacccgacgaccccgtaaccg

SEQ ID NO: 124118 - DNA, 761 bp, Homo sapiens
  misc_feature: GYAE6OF01BANFN.37.38.D05.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggccctcctagtgaactgactcacgccctaccctcagtcgtccgtcggtcccccggganacggacacgccaccactccacctcgctcgtagganagtagtaagttaagggaaaattaaaagtgtcgtacgttgcgttaggtactcaacgacgaaggaccggtccgggaccctaccggtcccccgtggtacggtccgttcggtactacgttactacgtaacaaggtaaactaaggacgaccggtcctaggacggtactccgtagacgtcgtacttccgtagtccggtccctaaccgtaacccggtaccggaaactacccgaacctccccgtacctacggacccttacgaccggaaccgggtacccggtacccgtagtacgtacggacggtacgtacgggacgttcggtaaccgttagttaaccgttcgtacggtaccgtaacgggtacggtaccgggaataaccggtaactacggtaactcggtaacccaaacggttaaccgttcggtaaaccggttaccgggtaaccggtcggtaacccggtacggttacacggttacccggtaacgtcccgaaccggaacccgtaacccccggaacgtcccccgtaaacccgg

SEQ ID NO: 124119 - DNA, 764 bp, Homo sapiens
  misc_feature: GYAE6OF01B30JX.37.38.D05.1.454.CMB.1.raw
  modified_base (117)..(117): a, c, t, g, unknown or other
  misc_feature (117)..(117): n is a, c, g, or t
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
tcagtagtgtagatcacgaccggtgctcgatttagtatctgatagttgggtttggggctgggcctcaggaagcagcatcggaggtgcctcagccatggcatggatccctctcttccncggcgtccttgcttactgcacgaggatccgtcggcctctatgaacctgactcagcccaccctcgngtgtccgtcggtcccggacagacncgacccaccacgtaccaccgtcgccttcgtaggagtagttacgtaaaggttaagggtaaaactaaagttagtcgtcgttacgtcgttacggtatcgaacgacgaacgggaccggaccggtcctaccggtccccgtgtacggtccgtcggtactacgttactaacgttaacgaaagaacggtaacggacgggcccggtaccgtacgacgggtactacgtcgtacggtacgtccggttaacgttccgttaccggtaccggtacccgttaccgtaaaccccggggtaacccggtaaaccgaccccgtaacgtacccccgtaaccgtacccgaacctaccggaccgaccgggacccggacccgacggtacggtacgtacggtacgtacgggccgtagttacgtaactttacgtacgtagtacggacggaacggaggacaacggtataactacgtcgaacgaaccgtaggtgtaccggtaacggtaccggtacgaccggttcgaccgtaccggtaccgttaccggtaccgaacccgtcccggaaccccgaacccgtacccccg

SEQ ID NO: 124120 - DNA, 686 bp, Homo sapiens
  misc_feature: GYAE6OF01BZ3SW.37.38.D05.1.454.CMB.1.raw
  modified_base (573)..(573): a, c, t, g, unknown or other
  misc_feature (573)..(573): n is a, c, g, or t
  modified_base (648)..(648): a, c, t, g, unknown or other
  misc_feature (648)..(648): n is a, c, g, or t
  modified_base (656)..(656): a, c, t, g, unknown or other
  misc_feature (656)..(656): n is a, c, g, or t
  modified_base (659)..(660): a, c, t, g, unknown or other
  misc_feature (659)..(660): n is a, c, g, or t
  modified_base (662)..(663): a, c, t, g, unknown or other
  misc_feature (662)..(663): n is a, c, g, or t
  modified_base (665)..(665): a, c, t, g, unknown or other
  misc_feature (665)..(665): n is a, c, g, or t
  modified_base (667)..(670): a, c, t, g, unknown or other
  misc_feature (667)..(670): n is a, c, g, or t
  modified_base (673)..(680): a, c, t, g, unknown or other
  misc_feature (673)..(680): n is a, c, g, or t
  modified_base (682)..(686): a, c, t, g, unknown or other
  misc_feature (682)..(686): n is a, c, g, or t
tcagtagtgtagatcacgaccggtgctcgatttagtatctgatagttgggtttgggcagtgtccgtgtccccggacagacagccaccagtcacctgctctggagatgaattagggaaaattaaatatgcttgctggtatcagcagaacggccggccacgtcccctgtgcgtgtcatctatcaagataagaggcggcctgaggactccgtgagcgtacttctcgcgtctaccgaacgtaccggaacacgacgaccctactacgaacctacgccgaacggcccggaaccgtaggacgtagtaggtatacggacgttctacgtaactttaactttgtacggttaccgaacggtacggtacgggaacacgtaactaaacgtttaccgacgaaccaaacgtaaccgtacggttttaccggttaacccggaacggttaacccgggaacggtaacggttaccgtacgtccggttaccggttaacgtacccgaccggaacccccgtaaccggaacccctaacccgtcggtttaccttaccccgtaccgtttccggtttcccccccggccccctttaacccncctaacttaacccttacgtaacccgtaccgtttaggaccggtccgggacggttcccgaaggaccgtacggaaccncggtaagncgnnanncncnnnncgnnnnnnnncnnnnn

SEQ ID NO: 124121 - DNA, 861 bp, Homo sapiens
  misc_feature: GYAE6OF01AU117.37.38.D05.1.454.CMB.1.raw
  modified_base (239)..(239): a, c, t, g, unknown or other
  misc_feature (239)..(239): n is a, c, g, or t
tcagtagtgtagatcacgaccggtgctcgatttagtatctgatagttgggtttgggctgggcctcaggaagcagcatcggaggtgcctcagccgatggcatggatccctctcttcctcggcgtccttgcttactgcacgaggtactccgtggccctcctatcgaactcgacctcacgcccaccctcagtcgtccgtcggtccccggagacgacgacgccaccacgtcaccgtgcttcgnggagacgttaggaacgttagggaaaataagtgtgtcgttagtcgttaggtatacgacggacgtaacggaacggccccgggccgtaccgttccccgtgggttgtccgttagggtacctaacgtttaccaagttaacgaaaaggttaagaaacggacggtacccgggtacccgtaccggtaagggtacccttaccggtacggacggttaccgttaccgttccgttaaccggcccgggttaaccctaacccggtaaacccgggtacccgaaaccccgtaacgtaacccccggaccctaaacccccgtaacgggaaacccgacccggtaacccgggaaccccggggaaccccgggtaccccggttaagttaacccgggttacggtaacggtaaagtaccggggtaacggtccgttaaccgggtttaaactttaacttccgggtcgtaaacccggtacgggaacggttacgggaaccctacgggaaccttaacggacttaccgggaacaaaccgggttacctacggggtacgtaacccggtaacgtcgggtaccccggtaaggccgttaccgtaccggtaccgtacgggacaaaccccggacccggaaacccgtccccgtaaacccg

SEQ ID NO: 124122 - DNA, 595 bp, Homo sapiens
  misc_feature: GYAE6OF01D5HN4.37.38.D05.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (351)..(351): a, c, t, g, unknown or other
  misc_feature (351)..(351): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtgtccccgganagacacgccaccatcacctgctcgnggagatagaattagggaaaataatatgcttagctggtactcgagcaggaacgccggccacgtcccctgtcgtcgtggtcatcgtatacaagataagagcggactacgaggactccgagacgcgtattcngtcgcctaccaaccggtccggaacacgaccgccctacccgtagacctacgtcgaccggtaccgggaaccctaggtactagtaggactggacggtctagtacttacttacgtgtaccgaggtacgtacgggacaagtactaacgtctacgactaacgacgtacggtccgttaacgggaaccgtacggaccgtggtacctacgttccgtaccgtacgtaccaccggaccccgagcccctaaacccg

SEQ ID NO: 124123 - DNA, 576 bp, Homo sapiens
  misc_feature: GYAE6OF01DFW03.37.38.D05.1.454.CMB.1.raw
  modified_base (272)..(272): a, c, t, g, unknown or other
  misc_feature (272)..(272): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (550)..(550): a, c, t, g, unknown or other
  misc_feature (550)..(550): n is a, c, g, or t
  modified_base (560)..(560): a, c, t, g, unknown or other
  misc_feature (560)..(560): n is a, c, g, or t
  modified_base (563)..(576): a, c, t, g, unknown or other
  misc_feature (563)..(576): n is a, c, g, or t
tcagtagtgtagatcacgaccggtgctcgatttagtatctgatagttgggtttgggcagtgtccgtgtccccgggacagacagccaccatcacctgctctggagatggtaattagggaaaataaatatgcttgctggtatcagcagaacgccgggccacgtccctgtgcgtgtcatctatacaagaataaggagccgggtcctagacgggtactcccgtaggacgtcgtacttcttcggtcggtcctacccgtaacggtaccccgggaaacnccgaccgtccccacccgtagaacctacgtaccggaacggaccccgggaccgacggtctaaggttggactaggacgtntacggtaacttattacggtnacggaggacggtacgggacaggtaactaatacgtcgaacaacgtacgacggttacgtacggacgtcggaacgtggtactacgtcggtactagaccgtaccacggacccacccaccctagtctcaccgttcctactccccaacctcactactactacactacgtcgacgcggttagcgacgnggaccagtancgnnnnnnnnnnnnnn

SEQ ID NO: 124124 - DNA, 660 bp, Homo sapiens
  misc_feature: GYAE6OF01B5GHJ.37.38.D05.1.454.CMB.1.raw
  modified_base (180)..(180): a, c, t, g, unknown or other
  misc_feature (180)..(180): n is a, c, g, or t
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
  modified_base (620)..(620): a, c, t, g, unknown or other
  misc_feature (620)..(620): n is a, c, g, or t
  modified_base (625)..(625): a, c, t, g, unknown or other
  misc_feature (625)..(625): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (640)..(640): a, c, t, g, unknown or other
  misc_feature (640)..(640): n is a, c, g, or t
  modified_base (654)..(654): a, c, t, g, unknown or other
  misc_feature (654)..(654): n is a, c, g, or t
  modified_base (659)..(659): a, c, t, g, unknown or other
  misc_feature (659)..(659): n is a, c, g, or t
tcagtagtgtagatcacgaccggtgctcgatttagtatctgatagttgggtttggcagtgtccgtgtccccgggacagacagccaccatcacctgctctggagatgaattaggaaataaatatgcttgcgtggatcagcagaaggcccgggacctacgtcccctgtcgctgtcatctaanacaagaataaaggaaggccggtacacgtagggactccgtgacgtcgtactttctacgacgtacctaccgaaaccgtacggaaccacacggccccacgacgacncacgacggaccggaaccctggactataggataggacggtctagtactaacttcngtacgtaacgacggtcgacaagtcaaatcgngtaaccaaagtaacgtggtttacccgtaagaaacgggtacgggtaccgaggtaccttcgtaccgtactaagggtaccaccggaccccgtaacggtaccccaaacccggttgtacggtaccctacgtacccgtttccgggtaccccctcccgttacctaaccgtaactttaccgaaccgtacgttaccgggtagacccggttacggcggttacggaacctacggttcgaacgtacgacctgagtccagtcagngtacnggtaacngacngtanactcagatacacanacgcna

SEQ ID NO: 124125 - DNA, 885 bp, Homo sapiens
  misc_feature: GYAE6OF01CQV24.37.38.D05.1.454.CMB.1.raw
  modified_base (231)..(231): a, c, t, g, unknown or other
  misc_feature (231)..(231): n is a, c, g, or t
tcagtagtgtagatcacgaccggtgctcgatttagtatctgataggttgggtttggggctgggcctcagggaagcagcagtcggaggtgcctcagccatggcagtcggacttccctccttcttccgtcggccgttccttcgcttctcgcacgaggtactccgtcgccttacatacgaactcgactacgacgccctacctacgtacgttcgtcccggtcggaccccgggaanacgacgacaccaccgactccaccgtcgtcgttacgaggtacgtataggtaaagtaaggtaaaattaagttcgtacgttcgttacggtacgttgtaacgacgacgtaacgacgggaccgggacccggtccccgttaaccggttcccgttggtaccggcggtttacgaccttaggttaactaccggaaaagttaaaacggaaggtaaaaccgggtccgggaacccgggtacggttaccggggaaacccgtccggttaaaccgtacggggttaactacccggtttagggttcccgttaaccgggtacccgtaacccccgttaacccggaaaaccccgggttaaccccgaaaccgaccccggttaaacccgacccccgtacgaacccgtaaccggtaaccgggtacccggtaccgggacccggtaccgtaggttaccgggaagtccgggtaaagccggtagtacgtacttaacgttcgttacgttacgaccgtagtaccgggtaagaccggtaattaccaaacggttacgaccctaaacggtacgtacccgggttaacgtaccggtaccggaacgggtacggtaagtccggttaacggttaccgacccggttacgttacggaacccgtaccggaacccacccggtaaccccgttaccg

SEQ ID NO: 124126 - DNA, 774 bp, Homo sapiens
  misc_feature: GYAE6OF01CQXXQ.37.38.D05.1.454.CMB.1.raw
  modified_base (198)..(198): a, c, t, g, unknown or other
  misc_feature (198)..(198): n is a, c, g, or t
  modified_base (320)..(320): a, c, t, g, unknown or other
  misc_feature (320)..(320): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggactccgtggcctctatgaactgactcacgccacctcagtcgtccgtcgtcccggganacgacacgccaccactccacctgtctcgtggaagactagtaagttagggaaaataatacgtgtcttgcgttaggtactacgaggaccgaacggaaccgggcccggacctaccggttcccccngggttcgtaccgttcggtactaacttaccttaagttaacgaaaacggtaacgtaaaacggaaacgggtcccgggtaccctacgggtaacgggtaaccttccgtaggaacggtacgttacttaccgtcgtaccgtaccctaaccgtaaaaccggtccggaaaaccgtaaccgacgacccctaacccgagacccgaacgtacccggaacgggacccgggaaccaagggtacctaggtacggtacgtagggaccggtattaacggtaaccttttacggttacctacggtaacgggaacggttaccggggtaacgtaccgaagggttacccaaagttcccgttaacgactaaaaccggtcgtcgggttacccgtaacgggacgtccgggtaaccgtacggtactccgggttaaccgtaccgtacggtaccctacgaaccccgtacgaccccttaaccg

SEQ ID NO: 124127 - DNA, 810 bp, Homo sapiens
  misc_feature: GYAE6OF01BW1OV.37.38.D05.1.454.CMB.1.raw
  modified_base (117)..(117): a, c, t, g, unknown or other
  misc_feature (117)..(117): n is a, c, g, or t
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
tcagtagtgtagatcacgaccggtgctcgatttagtatctgatagttgggtttggggctgggcctcaggaagcagcatcggaggtgcctcagccatggcatggatccctctcttccncggctccttgcttactgcacaggctcgtgcctctanacgactcgactcacgccctaccgtcagtcgtccgtccggtccccgganacgaccgcgacccaacctactcctaccgtcgtccgttcggtagggagtaagttaaggtaaaggttaaagggtaaaaatttaagtacgttacgttcgttaggtaccgttaggttacctacgacggtacggaacggaaccgggccccgggtaccctaccgttccccgtgttacggccgttcgtactacgttacgtagtacgaaagtaacggtaacggaccgggtcgtaccgtacgggacggtacctaccggaggtaccgtcttacgttccgtcgtacccggacctaacccggtaaccgggtaaccggaaaccctcggaacccaccccgtaccgtaacgtacctaccggtaccggaaccgggtaccccggaacgtacggttaacggtacggtacgtacggtaccggtcggtacttaacgttacggttacgttacggttcggaacgtacggtacggtacggaacctacgtaacgttaaccgtacgtaacccgaaccgtaaggtaacccgttccgggtaacgtaccggtagggtacccggttagaccggttaccgtaccgtttaccggccgtaaccggtaccaacccggacccgtaacccgaccccgtaacccg

SEQ ID NO: 124128 - DNA, 173 bp, Homo sapiens
  misc_feature: GYAE6OF02F23YT.37.38.D05.1.454.CMB.1.raw
  modified_base (172)..(173): a, c, t, g, unknown or other
  misc_feature (172)..(173): n is a, c, g, or t
tcagtagtgtagatcacgaccggtgctcgatttagtatctgatagttgggtttggggtttggtggtctccactcccgccttgacggggctgccatctgccttccaaccccactgtcactctgttcccaccctcctcatctacactactgagcgggctggcaaggcgcatagnn

SEQ ID NO: 124129 - DNA, 188 bp, Homo sapiens
  misc_feature: GYAE6OF02F4TYT.37.38.D05.1.454.CMB.1.raw
  modified_base (170)..(188): a, c, t, g, unknown or other
  misc_feature (170)..(188): n is a, c, g, or t
tcagtagtgtagatcacgaccggtgctcgatttagtatctgatagttgggtttggggtttggtggtctccactcccgccttgacgggctgccatctgccttccaacccactgtcactctgttccgccctcctcatctacactactgagcgggctggcaaggcgtcatagnnnnnnnnnnnnnnnnnnn

SEQ ID NO: 124130 - DNA, 171 bp, Homo sapiens
  misc_feature: GYAE6OF02G852J.37.38.D05.1.454.CMB.1.raw
  modified_base (170)..(171): a, c, t, g, unknown or other
  misc_feature (170)..(171): n is a, c, g, or t
tcagtagtgtagatcacgaccggtgctcgatttagtatctgatagttgggttggggtttggtggtctccactcccgccttgacgggctgccatctgccttccaaccccactgtcactctgttcccgccctcctcatctacactactgagcgggctggcaaggcgcatagnn

SEQ ID NO: 124131 - DNA, 173 bp, Homo sapiens; identical to SEQ ID NO: 123946
  misc_feature: GYAE6OF02HJ6OV.37.38.D05.1.454.CMB.1.raw
  modified_base (173)..(173): a, c, t, g, unknown or other
  misc_feature (173)..(173): n is a, c, g, or t

SEQ ID NO: 124132 - DNA, 451 bp, Homo sapiens
  misc_feature: GYAE6OF02H0D3S.37.38.D05.1.454.CMB.1.raw
  modified_base (443)..(451): a, c, t, g, unknown or other
  misc_feature (443)..(451): n is a, c, g, or t
tcagtagtgtagatcacgaccggtgctcgatttagtatctgataggttgggtttgggcagtgtccgtagtccccgggacagacagccaccatcacctgctctggacgatgaattgggaaataaatatgcttgctgggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagcccaaggccaaccccactgtcactctgttccccacctcctcatcctacactactgacgcggctggcaaggcacatagnnnnnnnnn

SEQ ID NO: 124133 - DNA, 177 bp, Homo sapiens
  misc_feature: GYAE6OF02GCRXM.37.38.D05.1.454.CMB.1.raw
  modified_base (172)..(177): a, c, t, g, unknown or other
  misc_feature (172)..(177): n is a, c, g, or t
tcagtagtgtagatcacgaccggtgctcgatttagtatctgatagttgggtttgggggtttggtggtctccactcccgccttgacgggctgccatctgccttccaaccccactgtcactctgttcccgccctcctcatctacactactgagcgggctggcaaggcgcatagnnnnnn

SEQ ID NO: 124134 - DNA, 443 bp, Homo sapiens
  misc_feature: GYAE6OF02FLLBO.37.38.D05.1.454.CMB.1.raw
  modified_base (437)..(443): a, c, t, g, unknown or other
  misc_feature (437)..(443): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcgggacccaggctatggatgaggctgactattactgtcagacgtgggacagcaatactgcacaacaggtcttcggaactggggaccagggtcatcgtctaggtcagcccaaggccaacccactgtcactctgttccccaccctcctcatctacactactgacgcggctggcaaggcgcatagnnnnnnn

SEQ ID NO: 124135 - DNA, 205 bp, Homo sapiens
  misc_feature: GYAE6OF02JDR6J.37.38.D05.1.454.CMB.1.raw
  modified_base (174)..(182): a, c, t, g, unknown or other
  misc_feature (174)..(182): n is a, c, g, or t
  modified_base (184)..(205): a, c, t, g, unknown or other
  misc_feature (184)..(205): n is a, c, g, or t
tcagtagtgtagatcacgaccggtgctcgatttagtatctgataggttgggtttgggggtttggtggtctccactcccgccttgacgggctgccatctgccttcaaccccactgtcactctgttcccgccctcctcatctacactactgagcgggcttggcaaggcgctatagnnnnnnnnngnnnnnnnnnnnnnnnnnnnnnn

SEQ ID NO: 124136 - DNA, 196 bp, Homo sapiens
  misc_feature: GYAE6OF02H3E3Z.37.38.D05.1.454.CMB.1.raw
  modified_base (164)..(196): a, c, t, g, unknown or other
  misc_feature (164)..(196): n is a, c, g, or t
tcagtagtgtagatcacgaccggtgctcgatttagtatctgatagttgggtttgggggttgtgtctccatccgccttgacgggctgccatctgccttccaacccactgtcactctgtcccgcctctcatcgtacactactgagcgggctggcaaggcgcatagnnnnnnnnnnnnnnnnnnnnnnnnnnnnnnnnn

SEQ ID NO: 124137 - DNA, 173 bp, Homo sapiens; identical to SEQ ID NO: 123962
  misc_feature: GYAE6OF02FN8A3.37.38.D05.1.454.CMB.1.raw
  modified_base (173)..(173): a, c, t, g, unknown or other
  misc_feature (173)..(173): n is a, c, g, or t

SEQ ID NO: 124138 - DNA, 177 bp, Homo sapiens
  misc_feature: GYAE6OF02GTQ97.37.38.D05.1.454.CMB.1.raw
  modified_base (173)..(177): a, c, t, g, unknown or other
  misc_feature (173)..(177): n is a, c, g, or t
tcagtagtgtagatcacgaccggtgctcgatttagtatctgataggttgggtttgggggtttggtggtctccactcccgccttgacgggctgccatctgccttccaaccccactgtcactctgttcccgccctcctcatctacactactgagcgggctggcaaggcgcatagnnnnn

SEQ ID NO: 124139 - DNA, 172 bp, Homo sapiens
  misc_feature: GYAE6OF02IRJX7.37.38.D05.1.454.CMB.1.raw
tcagtagtgtagatcacgaccggtgctcgatttagtatctgatagttgggtttgggggtttggtggtctccactcccgccttgacggggctgccatctgccttccaaccccactgtcactctgttcccaccctcctcatctacactactgagcgggctggcaaggcgcatag

SEQ ID NO: 124140 - DNA, 211 bp, Homo sapiens
  misc_feature: GYAE6OF02G3O8M.37.38.D05.1.454.CMB.1.raw
  modified_base (170)..(211): a, c, t, g, unknown or other
  misc_feature (170)..(211): n is a, c, g, or t
tcagtagtgtagatcacgaccggtgctcgatttagtatctgatagttgggtttgggggttggtggtctccactcccgccttgacgggctgccatctgccttccaaccccactgtcactctgttcccgcctcctcatctacactactgagcgggctggcaaggcgcatagnnnnnnnnnnnnnnnnnnnnnnnnnnnnnnnnnnnnnnnnnn

SEQ ID NO: 124141 - DNA, 173 bp, Homo sapiens; identical to SEQ ID NO: 123962
  misc_feature: GYAE6OF02HUGQI.37.38.D05.1.454.CMB.1.raw
  modified_base (173)..(173): a, c, t, g, unknown or other
  misc_feature (173)..(173): n is a, c, g, or t

SEQ ID NO: 124142 - DNA, 494 bp, Homo sapiens
  misc_feature: GYAE6OF02JIACS.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggcagtcccctgtgctggtcatctatcaagataagaagcgggcctcagggatccctgagcgattctctggctccaactccgggaacacagccaccctgaccatcagcgggacccaggctatggatgaggctgactatactgtcagacgtggacagcaatactgcacaacaggtctcggaactgggaccagggtcagtcgtctaggtcaggcccaggcccaaccccg

SEQ ID NO: 124143 - DNA, 499 bp, Homo sapiens
  misc_feature: GYAE6OF02JHI1J.37.38.D05.1.454.CMB.1.raw
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (459)..(459): a, c, t, g, unknown or other
  misc_feature (459)..(459): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggcagtcccctgtgctggtcatctatcaagataagaagcgggctcgagggatccctgagcgattctctggctccaactccgggaacacacgccacctgaccatcagcggaccaggctagngatgagctgactatacngtcagacgtggacagcaatctgacaacgacgagtctacggaacgtcgggaaccngggtacagtcgtaccgtaggccagcccgacggcccaaccc

SEQ ID NO: 124144 - DNA, 173 bp, Homo sapiens; identical to SEQ ID NO: 123946
  misc_feature: GYAE6OF02GZYJJ.37.38.D05.1.454.CMB.1.raw
  modified_base (173)..(173): a, c, t, g, unknown or other
  misc_feature (173)..(173): n is a, c, g, or t

SEQ ID NO: 124145 - DNA, 185 bp, Homo sapiens
  misc_feature: GYAE6OF02IX8LS.37.38.D05.1.454.CMB.1.raw
  modified_base (174)..(185): a, c, t, g, unknown or other
  misc_feature (174)..(185): n is a, c, g, or t
tcagtagtgtagatcacgaccggtgctcgatttagtatctgatagttgggtttgggggtttggtggtctccactcccgccgttgacggggctgccatctgccttccaaccccactgtcactctgttcccgccctcctcatctacactactgagcgggctggcaaggcgcatagnnnnnnnnnnnn

SEQ ID NO: 124146 - DNA, 450 bp, Homo sapiens
  misc_feature: GYAE6OF02GHVMB.37.38.D05.1.454.CMB.1.raw
  modified_base (375)..(375): a, c, t, g, unknown or other
  misc_feature (375)..(375): n is a, c, g, or t
  modified_base (437)..(450): a, c, t, g, unknown or other
  misc_feature (437)..(450): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtctaggtcagcccaaggccaacccntgtcactctcgttcccgccctcctcatcctacactactgagcgggctggcaaggcgcatagnnnnnnnnnnnnnn

SEQ ID NO: 124147 - DNA, 513 bp, Homo sapiens
  misc_feature: GYAE6OF02JCMTR.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccgaactccgggaacacgacgcccaccctgaccatccagccgggacccaggctatggatgaggctgactattactgtcagacgtggacagacaatactgacacaacaggtcttacggaacgtgggaccaggggtcagttcgtacctaggtcacggcccacggcccaaccccg

SEQ ID NO: 124148 - DNA, 456 bp, Homo sapiens
  misc_feature: GYAE6OF02IU9K2.37.38.D05.1.454.CMB.1.raw
  modified_base (441)..(456): a, c, t, g, unknown or other
  misc_feature (441)..(456): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtctaggtcagcccaaggcccaacccactgtcactctcgttccccgccctcctcatcctacactactgacgcggctggccaaggcacatagnnnnnnnnnnnnnnnn

SEQ ID NO: 124149 - DNA, 504 bp, Homo sapiens
  misc_feature: GYAE6OF02GA9CP.37.38.D05.1.454.CMB.1.raw
  modified_base (446)..(446): a, c, t, g, unknown or other
  misc_feature (446)..(446): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagccgggacccaggctagtggatggaggctgacttattactgtcagacgtgggacagcaatactgacacaacnggtctacggaacgtgggaccagggtcagtcgtcctaggtccagcccaggcccaacccg

SEQ ID NO: 124150 - DNA, 504 bp, Homo sapiens
  misc_feature: GYAE6OF02GZGV8.37.38.D05.1.454.CMB.1.raw
  modified_base (391)..(391): a, c, t, g, unknown or other
  misc_feature (391)..(391): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatcccgtgagcgattctctggctccaactccggaacacacgccaccctgaccatcagcgggacccaggctanggatgaggctgactattactgtcagcgtagggacagcaatactgacaacaacgaggtctcggaactgggacctagggtccagtcgtcctaggtcacggaccacgcccaacccg

SEQ ID NO: 124151 - DNA, 171 bp, Homo sapiens
  misc_feature: GYAE6OF02H0KD2.37.38.D05.1.454.CMB.1.raw
tcagtagtgtagatcacgaccggtgctcgatttagtatctgatagttgggtttgggggtttggtggtctccactcccgccttgacggggctgccatctgccttccaaccccactgtcactctgttcccaccctcctcatctacactctgagcgggctggcaaggcgcatag

SEQ ID NO: 124152 - DNA, 502 bp, Homo sapiens
  misc_feature: GYAE6OF02FHKSD.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtccagtcgtcctaggtccagccccaaggcccaaccccg

SEQ ID NO: 124153 - DNA, 473 bp, Homo sapiens
  misc_feature: GYAE6OF02G3ZAA.37.38.D05.1.454.CMB.1.raw
  modified_base (451)..(473): a, c, t, g, unknown or other
  misc_feature (451)..(473): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcaggacgtgggacagcaatactgcacaacaggtcttcggaactgggaccagggtcatcgtcctaggtcagcccaaggcccaaccccactcgtccactcctcgttccccaccctcctcatcctacactactgacgcgggctggcaaggccgacagtacgnnnnnnnnnnnnnnnnnnnnnnn

SEQ ID NO: 124154 - DNA, 175 bp, Homo sapiens; identical to SEQ ID NO: 124010
  misc_feature: GYAE6OF02F24WN.37.38.D05.1.454.CMB.1.raw
  modified_base (173)..(175): a, c, t, g, unknown or other
  misc_feature (173)..(175): n is a, c, g, or t

SEQ ID NO: 124155 - DNA, 447 bp, Homo sapiens
  misc_feature: GYAE6OF02I4E6H.37.38.D05.1.454.CMB.1.raw
  modified_base (375)..(375): a, c, t, g, unknown or other
  misc_feature (375)..(375): n is a, c, g, or t
  modified_base (438)..(447): a, c, t, g, unknown or other
  misc_feature (438)..(447): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtctagtcagcccaaggcccaacccnctcgtcactctgttcccgccctcctcatcctacactactgagcgggctggcaaggcgcatagnnnnnnnnnn

SEQ ID NO: 124156 - DNA, 174 bp, Homo sapiens
  misc_feature: GYAE6OF02HDA9G.37.38.D05.1.454.CMB.1.raw
  modified_base (173)..(174): a, c, t, g, unknown or other
  misc_feature (173)..(174): n is a, c, g, or t
tcagtagtgtagatcacgaccggtgctcgatttagtatctgatagttgggtttgggggtttggtggtctccactcccgccttgacggggctgtcatctgccttccaaccccactgtcactctgttcccgccctcctcatctacactactgagcgggctggcaaggcgcatagnn

SEQ ID NO: 124157 - DNA, 447 bp, Homo sapiens
  misc_feature: GYAE6OF02GU1XZ.37.38.D05.1.454.CMB.1.raw
  modified_base (441)..(447): a, c, t, g, unknown or other
  misc_feature (441)..(447): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagcccaaggcccaaccccactgtcactctgttccccaccctcctcatctacactactgagcgggctggcaaggcgacatagnnnnnnn

SEQ ID NO: 124158 - DNA, 448 bp, Homo sapiens
  misc_feature: GYAE6OF02H1X48.37.38.D05.1.454.CMB.1.raw
  modified_base (374)..(374): a, c, t, g, unknown or other
  misc_feature (374)..(374): n is a, c, g, or t
  modified_base (436)..(448): a, c, t, g, unknown or other
  misc_feature (436)..(448): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcggacccaggctatggatgaggctgactattactgtcagacgtgggacagcaatactgcacaacaggtcttcggaactgggaccagggtcatcgtctagtcagcccaaggcccaacccntcgtcactctcgttcccaccctctcatcctacactactgacgcggctggcaaggcgcatagnnnnnnnnnnnnn

SEQ ID NO: 124159 - DNA, 500 bp, Homo sapiens
  misc_feature: GYAE6OF02JED59.37.38.D05.1.454.CMB.1.raw
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataatatgcttgctggtatcagcagaagccgggccagtcccctgtgctggtcatctatcaagataagaagcgggactcagggatcccgtgagcgattctctggctccaactccaggaacacagccacctgaccatcagcggacccaggctatggatgaggctagactattacngtcagacgtgggacagcaatctgacacaacgngtacttaccggaacgtgggaccagggttacagtcgtccaggtcacgcccaaggtacccc

SEQ ID NO: 124160 - DNA, 505 bp, Homo sapiens
  misc_feature: GYAE6OF02H5KFI.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccgggccagtcccctgtgctggtcatctatcaagataagaagcgggcctcagggatccctgagcgattctctggctccaactcggaacacacgccaccctgaccatcacgcgggacccaggctagtggatgaggctgactattactgtcagacggtgggacagacaatactgacacaacaggtcttcggacgtgggaccagggtcagtcgtctacggtccacgcccacggccaaccccg

SEQ ID NO: 124161 - DNA, 596 bp, Homo sapiens
  misc_feature: GYAE6OF02I5GC7.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccggccacgtcccctgtgctggtcatctatcaagataagaacggcggctacgaggacgtccgtgagcgattctctggctaccaaccgtaccggaacacacgcccaccctcgaccactcgacggccgggacccgaggctacgtaggtacgtaggacggctacggtaacttacttaacgtgtacgacgtaacggtacggggacgagacaacttaaccgtgaaccaacaacgtacggtaccgttacggtaaccgtcgggaaccgacgggttacacgtttacggtcccgttaagggtacccgtaaccgacccggtaaccggaccctaaacccccg

SEQ ID NO: 124162 - DNA, 173 bp, Homo sapiens; identical to SEQ ID NO: 123946
  misc_feature: GYAE6OF02GQTZ0.37.38.D05.1.454.CMB.1.raw
  modified_base (173)..(173): a, c, t, g, unknown or other
  misc_feature (173)..(173): n is a, c, g, or t

SEQ ID NO: 124163 - DNA, 230 bp, Homo sapiens
  misc_feature: GYAE6OF02IGOYP.37.38.D05.1.454.CMB.1.raw
  modified_base (176)..(183): a, c, t, g, unknown or other
  misc_feature (176)..(183): n is a, c, g, or t
  modified_base (185)..(186): a, c, t, g, unknown or other
  misc_feature (185)..(186): n is a, c, g, or t
  modified_base (188)..(230): a, c, t, g, unknown or other
  misc_feature (188)..(230): n is a, c, g, or t
tcagtagtgtagatcacgaccggtgctcgatttagtatctgatagttggggtttagggggtttgtggtctccactcccgccttgacggggctgccatcctgccttccaaccccactgtcactctgttcccaccctcctcatctacactactgagacgggctggcaaggcgcatagnnnnnnnngnncnnnnnnnnnnnnnnnnnnnnnnnnnnnnnnnnnnnnnnnnnnn

SEQ ID NO: 124164 - DNA, 517 bp, Homo sapiens
  misc_feature: GYAE6OF02JGARM.37.38.D05.1.454.CMB.1.raw
  modified_base (353)..(353): a, c, t, g, unknown or other
  misc_feature (353)..(353): n is a, c, g, or t
tcagtagtgtagatcacgaccggtgctcgatttagtatctgatagttgggtttggggctgggcctcaggaagcagcatcggaggtgcctcagccatggcatggatccctctcttcctaggcgtccttgcttactgcacaggatccgtggcctcctatgaactgactcagccaccctcagtgtccgtgtccccgggacagacagccaccatcacctgctctggagatgaattgggaaataatatgcttgctggtatcagcagagccggcagtccctgtgctggtcatctatcaagataagaagcgggcctcgagggactcccgtgagcgattctctggctccaactccggaacncagccacctgaccatcagcgggacccaggctagtggatgaggctgacttagttactgtcagcgtagggacagcaacgtctgcaacaacgacggtcttacgggaacctcgggaaccagggtcacgttccgtaccgtaggtccacggtacccacggtcccaacccg

SEQ ID NO: 124165 - DNA, 457 bp, Homo sapiens
  misc_feature: GYAE6OF02JWDF4.37.38.D05.1.454.CMB.1.raw
  modified_base (380)..(380): a, c, t, g, unknown or other
  misc_feature (380)..(380): n is a, c, g, or t
  modified_base (441)..(441): a, c, t, g, unknown or other
  misc_feature (441)..(441): n is a, c, g, or t
  modified_base (446)..(457): a, c, t, g, unknown or other
  misc_feature (446)..(457): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatctgacacaacaggtctacggaactggggaccagggtcatcgtcctaggtcacgcccaaggcccaaacccntcgtacacctctccgttcccgccctcctcactcctacactctgacgccggctggcaaggcncatgnnnnnnnnnnnn

SEQ ID NO: 124166 - DNA, 884 bp, Homo sapiens
  misc_feature: GYAE6OF02HN2OY.37.38.D05.1.454.CMB.1.raw
tcagtagtgtagatcacgaccggtgctcgatttagtatctgataggttggtttgggcagtgtcccgtgtccccgggacaggacagcccgacctactctaccgtgctctggagatgaattggaaataaagtatgcttgcgtggttagtcagcctaggttaacgccgggtccacgttcccctttaggtggtcttcggtctattcctaagttccaaagtagttaaaggaaggtccgggggccgtcgtaggggtaccttcccgtcggtagggccgtagtttccttcgtagggccttccctaaccttccggggaacaccacggcccctaccccttggaacctactacctacggaccgggtaaccccctagggtcctacgtttgggacttacggtacggggtcctacggtaaccttaacgtttaccgtacggtaccgaacggggtacccggtagggaacgtacgggtacctaaagttaccgtacggtaccttaacctaaacgttacggttaccgttaacggtaacggtacgggtaaccgtacgggtaactacgttaccggtaccgtaacgggtacccgtaccccgtaaacgggaccccgtaaaccccgtacgtttaccgtaaccctaacccgttttcccgttaccccggtttacccccggcccctttaacccgttacccgtaaacgttacccttaaaccccgtaccgtttaaccggttaccgggttaaccggtacccggggttaaacgttccggggaacccgaaacggggtccccgttaacggtaaacggttaaccggtgaaccgacgtacggcgtcgtacttacgttatcgtacgaccggtagtacgtactcgtcgggttactgttacgtacttacggagggtcattcg

SEQ ID NO: 124167 - DNA, 506 bp, Homo sapiens
  misc_feature: GYAE6OF02IJXDW.37.38.D05.1.454.CMB.1.raw
  modified_base (214)..(214): a, c, t, g, unknown or other
  misc_feature (214)..(214): n is a, c, g, or t
  modified_base (444)..(444): a, c, t, g, unknown or other
  misc_feature (444)..(444): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (486)..(493): a, c, t, g, unknown or other
  misc_feature (486)..(493): n is a, c, g, or t
  modified_base (495)..(501): a, c, t, g, unknown or other
  misc_feature (495)..(501): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
tcagtagtgtagatcacgaccggtgctcgatttagtatctgatagtttggggttttggggcacgtgtccgtgtccccgggacagacgagccaccagtcacctgtctctggagatgaattgggaaagtaaatatgcttgctcggtatcagcagaagccgggcagtccctgtgctggtcatctatcaagataagagcgggcctcagggatcctagngcgattctctggctccaactccgggaactacgacgccaccctgaccattcacgccgggacccagggctagtcggagtgacggcctagacttagttacgtggtccgaggacggtgggacaggacaatactgacacaactggtcttcggaactcgggaaccagggtcactcgtacctagtcacgcccaacggccaacccatcgtcactctcgtcccacctcctcactctacnctactgagcgggctggcacggcgacagtacgcngcnacntannnnnnnncnnnnnnntntnn

SEQ ID NO: 124168 - DNA, 174 bp, Homo sapiens; identical to SEQ ID NO: 123975
  misc_feature: GYAE6OF02F1CV3.37.38.D05.1.454.CMB.1.raw
  modified_base (173)..(174): a, c, t, g, unknown or other
  misc_feature (173)..(174): n is a, c, g, or t

SEQ ID NO: 124169 - DNA, 457 bp, Homo sapiens
  misc_feature: GYAE6OF02GXDY3.37.38.D05.1.454.CMB.1.raw
  modified_base (441)..(442): a, c, t, g, unknown or other
  misc_feature (441)..(442): n is a, c, g, or t
  modified_base (444)..(457): a, c, t, g, unknown or other
  misc_feature (444)..(457): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtctagtcagcccaaggcccaacccactgtcactctcgttccccaccctcctacactctacacttactgagcgggctggcaaggcgcatagnngnnnnnnnnnnnnnn

SEQ ID NO: 124170 - DNA, 518 bp, Homo sapiens
  misc_feature: GYAE6OF02HF973.37.38.D05.1.454.CMB.1.raw
  modified_base (393)..(393): a, c, t, g, unknown or other
  misc_feature (393)..(393): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtccccctgtgctggtcatctatcaagataaagaagcgggcctcagggatcccgtgacgcgattctctggctccaactccgggaacacagccacctgaccatcagccgggaccaggctanggatgaggctgactatactgtcagacgtgggacagacaatactgcacaacgaggtccttcggaacgtgggacctagggtcacgttcgtaccgttaggtccacggcccgaaggcccctaaaccccg

SEQ ID NO: 124171 - DNA, 447 bp, Homo sapiens
  misc_feature: GYAE6OF02I7OE9.37.38.D05.1.454.CMB.1.raw
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
  modified_base (432)..(447): a, c, t, g, unknown or other
  misc_feature (432)..(447): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcggaccaggctatggatgaggctgactattactgtcagcgtgggacagcaatactgcacaacaggtcttcggaactgggacagggtcatcgtctaggtcagcccaaggccaacccatcgcactctcgttcccaccctccncatcctacacttactgacgcggctggcaggcncatagnnnnnnnnnnnnnnnn

SEQ ID NO: 124172 - DNA, 186 bp, Homo sapiens
  misc_feature: GYAE6OF02GNSOX.37.38.D05.1.454.CMB.1.raw
  modified_base (174)..(186): a, c, t, g, unknown or other
  misc_feature (174)..(186): n is a, c, g, or t
tcagtagtgtagatcacgaccggtgctcgatttagtatctgatagttgggtttggggggtttggtggtctccactcccgccttgacggggctgccatctgccttccaaccccactgtcactctgttcccaccctcctcatctacactactgagcgggctggcaaggcgcatagnnnnnnnnnnnnn

SEQ ID NO: 124173 - DNA, 648 bp, Homo sapiens
  misc_feature: GYAE6OF02HD4D5.37.38.D05.1.454.CMB.1.raw
  modified_base (331)..(331): a, c, t, g, unknown or other
  misc_feature (331)..(331): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccggacagacagccaccatcacctgctctggagatagaattagggaaaataaatatgcttgctggtatcagcagagccggccacgtcccgtgtcgcgtggtcatctatacaagataagagcggcctacgaggactccgngacgcgtattctcgtcgcctaccgaacgtacccgggaaacacgaccgacccaccctcgaacccagtaccgacggacccgggaacccaggtactagtacgggagtcggacgtctacggtacttacgttacgtggtaccaacggacggttacgggaccaacgtacctaaacgtacctacggaaccaaaccgtaacgtaccgggtttaccgttaaccggggaaaccgttccggggaacccggtacggggttaccaccggtttccgtacccggttaacggtacccgaaccggtaacccgaacccggtaccccctaaccccg

SEQ ID NO: 124174 - DNA, 444 bp, Homo sapiens
  misc_feature: GYAE6OF02H65PP.37.38.D05.1.454.CMB.1.raw
  modified_base (430)..(430): a, c, t, g, unknown or other
  misc_feature (430)..(430): n is a, c, g, or t
  modified_base (435)..(444): a, c, t, g, unknown or other
  misc_feature (435)..(444): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcggacccaggctatggatgaggctgactattactgtcagacgtgggacagcaatactgcacaacaggtcttacggaactgggaccagggtcagtcgctaggtcagcccaaggcccaacccactgtcactctcgtcccaccctctcatctacactactgacgcgggctggcaggcncatgnnnnnnnnnn

SEQ ID NO: 124175 - DNA, 175 bp, Homo sapiens; identical to SEQ ID NO: 124010
  misc_feature: GYAE6OF02I0X85.37.38.D05.1.454.CMB.1.raw
  modified_base (173)..(175): a, c, t, g, unknown or other
  misc_feature (173)..(175): n is a, c, g, or t

SEQ ID NO: 124176 - DNA, 857 bp, Homo sapiens
  misc_feature: GYAE6OF02IH90I.37.38.D05.1.454.CMB.1.raw
tcagtagtgtagatcacgaccggtgctcgatttagtatctgatagttgggtttgggcagtgtccgtgtccccggactagacagccaccatcgtaccgtgctctggagactagaagttggaaataaagtatgcttgctggtagtccagcagaagccggccaggtcccctgtgctggtcatcgtatcaagataagaagcgggacctcgagggactccctgagcgattcctctcggcctaccaaccttcccgggaacaccacgccacccttgaacctagtacgaacggaccggggaaccccacggacctaagtcggaacttcgggaacggggtcctaggtaaccttaacgttaaccttcggttaccgacggtaaccggttaggggtaacctacggtaccttaaaagtttaaccgttacggtaccaaaaccgtaaaaccgtaaaacggggttaccgttttaaccgggaaaacccgttaccgggggtaaaccccgtaaccgggggttaacctaacgtttacccggttaaccgtttaacgggttaaccgaaccggtaaccccccgtaaaacgggttaaccccctaaaaccccccggtaaacgtttacccgggttacccctaaaccgtttacccggtttaaccggttttacccccccaacccgtttacccgtaacgtacctacccgtttaaaccgaccgtttaaccgtacggttaacgggttacccggtcctacgggaccgtaacgggacccgaacgttaccggtaagctaacgttacctagtacgacgtacgtacgtacgtacctacgtacgttacgacgtacgtacgtacgtacgtacgtacgtacgtacgtccgtacgacg

SEQ ID NO: 124177 - DNA, 529 bp, Homo sapiens
  misc_feature: GYAE6OF02IVJJF.37.38.D05.1.454.CMB.1.raw
  modified_base (399)..(399): a, c, t, g, unknown or other
  misc_feature (399)..(399): n is a, c, g, or t
  modified_base (452)..(452): a, c, t, g, unknown or other
  misc_feature (452)..(452): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccgggccagtcccctgtgctggtcatctatcaagataagaagcgggcctcgagggatcccgtgagcgattctctcggcccaactccgggaacacacgcccaccctgaccatcgagccgggacccaggcctagnggatgaggctagactattctgtcagacgtgggacagcaatactgacacaacgnggttacttcggaacgtcgggaacctagggtcacgttcgtacgtaggtcgacggacccaacggccccaacccgtaccg

SEQ ID NO: 124178 - DNA, 527 bp, Homo sapiens
  misc_feature: GYAE6OF02HQVAS.37.38.D05.1.454.CMB.1.raw
  modified_base (507)..(527): a, c, t, g, unknown or other
  misc_feature (507)..(527): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtccccctgtgctggtcatctatcaagataagaagcgggcctcagggatccctgagcgattctctggctccaactccgggaacacagccaccctgaccatcagcgggacccaggctatggatgaggctgactattactgtcagacgtggacagcaatacgtgacaacaacgtacggttccgttacggaacgtcgggacccgtagggtcaacgttcgtaccgtagggtccacgacccgaaacggccccaaaccccgtactcgtaccaccttcgtcccgttaccccacccttcctactactaccctaacctacctactcggacgtccgggcgtggaccgaacggcgacgtatacgnnnnnnnnnnnnnnnnnnnnn

SEQ ID NO: 124179 - DNA, 464 bp, Homo sapiens
  misc_feature: GYAE6OF02INCCL.37.38.D05.1.454.CMB.1.raw
  modified_base (303)..(303): a, c, t, g, unknown or other
  misc_feature (303)..(303): n is a, c, g, or t
  modified_base (436)..(436): a, c, t, g, unknown or other
  misc_feature (436)..(436): n is a, c, g, or t
  modified_base (441)..(442): a, c, t, g, unknown or other
  misc_feature (441)..(442): n is a, c, g, or t
  modified_base (444)..(464): a, c, t, g, unknown or other
  misc_feature (444)..(464): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcggacccaggctatggatgaggctgactattactgtcagacgtggacngcaatactgcacaacaggtcttcggaactgggaccagggtcatcgtctaggtcagacccaaggccaacccatgtcactctcgtcccgccctcctcactcctacacttacgtcgacgcgggctggcaaggccgnatagnncnnnnnnnnnnnnnnnnnnnnn

SEQ ID NO: 124180 - DNA, 477 bp, Homo sapiens
  misc_feature: GYAE6OF02G2SUY.37.38.D05.1.454.CMB.1.raw
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (377)..(377): a, c, t, g, unknown or other
  misc_feature (377)..(377): n is a, c, g, or t
  modified_base (455)..(477): a, c, t, g, unknown or other
  misc_feature (455)..(477): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagcgtgggacagcaatacngcacaacnggtctcggaactgggaccagggtcagtcgtcctaggtcacgcccaaggcccaacccntcgcactctcgtccccacctcctcatcctacactacgtgacgccgggctacgggacaacgggccgacaagtacgcagnnnnnnnnnnnnnnnnnnnnnnn

SEQ ID NO: 124181 - DNA, 569 bp, Homo sapiens
  misc_feature: GYAE6OF02G5CZH.37.38.D05.1.454.CMB.1.raw
  modified_base (295)..(295): a, c, t, g, unknown or other
  misc_feature (295)..(295): n is a, c, g, or t
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctancaagataagagcgggcctcgacgggtactccctgacgcgtattctcgtgcctccaacgtcccgggaaacacacgcccacctcgaccactccgaggcccggaccgagctagnggatggacggtctagacttattacgtgtacaggacggtaggacngaacaactacgtcgactaacgtaacgtcgttacgttacggtaaccgtcgggaaccgtagggtaccaacggttccgttacgtacggtaccgaccggaccccgaacggacccctaaccccg

SEQ ID NO: 124182 - DNA, 452 bp, Homo sapiens
  misc_feature: GYAE6OF02GM7SC.37.38.D05.1.454.CMB.1.raw
  modified_base (442)..(452): a, c, t, g, unknown or other
  misc_feature (442)..(452): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagcccaaggcccaacccactgtcactctcgttccccgcctcctcatcctacacttactgagcgggctggcaaggcgacatagnnnnnnnnnnn

SEQ ID NO: 124183 - DNA, 453 bp, Homo sapiens
  misc_feature: GYAE6OF02G0D5Y.37.38.D05.1.454.CMB.1.raw
  modified_base (440)..(453): a, c, t, g, unknown or other
  misc_feature (440)..(453): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcggacccaggctatggatgaggctgactattactgtcagacgtgggacagcaatactgcacaacaggtcttcggaactgggaccagggtcatcgtctaggtcagcccaaggcccaaccccatgtccactctcgttccccaccctcctcatcctacactactgagcgggctggcaaggcacatagnnnnnnnnnnnnnn

SEQ ID NO: 124184 - DNA, 453 bp, Homo sapiens
  misc_feature: GYAE6OF02GH399.37.38.D05.1.454.CMB.1.raw
  modified_base (435)..(435): a, c, t, g, unknown or other
  misc_feature (435)..(435): n is a, c, g, or t
  modified_base (441)..(453): a, c, t, g, unknown or other
  misc_feature (441)..(453): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtcctaggtcagccccaaggcccaaccccactgtcactctcgttccccgccctcctcactcacactactgagcgggctggcaggcncatagnnnnnnnnnnnnn

SEQ ID NO: 124185 - DNA, 446 bp, Homo sapiens
  misc_feature: GYAE6OF02ILVKZ.37.38.D05.1.454.CMB.1.raw
  modified_base (436)..(446): a, c, t, g, unknown or other
  misc_feature (436)..(446): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcggacccaggctatggatgaggctgactattactgtcagacgtgggacagcaatactgcacaacaggtcttcggaactgggacagggtcatcgtcctaggtcagcccaaggccaacccactgtcactctgttcccgccctcctcatcctacactactgagcgggctggcaaggcgcatagnnnnnnnnnnn

SEQ ID NO: 124186 - DNA, 521 bp, Homo sapiens
  misc_feature: GYAE6OF02IPYWU.37.38.D05.1.454.CMB.1.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
  modified_base (441)..(441): a, c, t, g, unknown or other
  misc_feature (441)..(441): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (501)..(503): a, c, t, g, unknown or other
  misc_feature (501)..(503): n is a, c, g, or t
  modified_base (505)..(505): a, c, t, g, unknown or other
  misc_feature (505)..(505): n is a, c, g, or t
  modified_base (508)..(521): a, c, t, g, unknown or other
  misc_feature (508)..(521): n is a, c, g, or t
tcagtagtgtagatcacgaccggtgctcgatttagtatctgatagttgggtttgggtcgagtgtccgtgtccccgggacagacagccaccatcacctgctctggagatgaattgggaaataaatatagcttgctggtatcagcagaagccgggcagtcccctgtgctggtcatctatcaagataagaagcgggcctcgagggatccctgagcgattctctggcctccgaacgtccgggaacaccgngccacccgtgaccatcacggccggacccaggctacgtggactgacgctggactattacngtacaggacgtggaaccagactaatcngacacaagacggttactacggaacgtgggaaccgnggggtaccagtcggtcaaggtcacncccgaagcccaacccngtcgtctaactctccgtaccctaccctcctacnctacctacctactactcgaacgccggtcgaggccgaaggccganacgtacgtncgtacgnnnancannnnnnnnnnnnnn

SEQ ID NO: 124187 - DNA, 714 bp, Homo sapiens
  misc_feature: GYAE6OF02GKAEX.37.38.D05.1.454.CMB.1.raw
tcagtagtgtagatcacgaccggtgctcgatttagtatctgatagttgggtttgggggctgggcctcaggaagcagcatcggaggtgcctcagccatggcatggatacccctctcttcctcggcgtcccttgcttactgcacaggatccgtggcctcctatgaactgactcagccacctcaggtcgtccgtgtccccggacagacgagccacactcacctgctctggagatgaattgggaaataatatgcttgctggtatcagcagacgccggcacgtcccctgtgctggtcagtctatcaagataagaagccgggcctacgacgggtactcccgtagacgtacgtactttcgtcgtcggcctaccgaaaccgtccgggaaacctaccgaaccgcccctaacccgttagaaccctacgtaccgaaccgggacccgggtaacccgaacgggtaccgtaaacgttacgggaacgttacgggacggttacgtacggttaacgttaacgtttaccgtacgttaccgacggtacgggtacgggtaacacggtactaaacgtccgtacggacaaccgtaacgtcgggttaccgttaaccgggtaaccggttcggggtaaacccgtacggggttaccctaccgggtttacccggttaccggttaaccgggttacccgtaacccggtaaccccggtaacccggtacccccgtaaaccccccg

SEQ ID NO: 124188 - DNA, 612 bp, Homo sapiens
  misc_feature: GYAE6OF02ICYRG.37.38.D05.1.454.CMB.1.raw
  modified_base (181)..(181): a, c, t, g, unknown or other
  misc_feature (181)..(181): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtntccgtgtccccgggacagacagccaccatcacctgctctggagatgaattgggaaaataaatatgcttgctggtatcagcagaagccgggcagtcccctgtgctggtcatctatcaagataagaagcgggcctcgaggactcccgtgagcgaattcgtctggctaccaacgtccgggaaacaccgacgcccaacccgtcgaaccactaccgaacggcccgggaacccagggtacctagtagggaatggaacggtctacgtaactactttaacgtgaccgaagaccgggtagggacaagacctaaagtacctaggacaaaccgaaacgtagggttaccgtttaacggaccgttaacggggaacccttaaggggtacctacgttaccggttccgtaacgggtaccaacggaccccaaggtaccccaaaccccg

SEQ ID NO: 124189 - DNA, 522 bp, Homo sapiens
  misc_feature: GYAE6OF02F33JO.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccgggccagtcccctgtcgctggtcatctatcaagataagaagcgggcctcgagggactcccgtgagcgattctctcggctccaacgtccgggaacacagcccacctgaccatcagcgggacccaggctagtggatggaggctgactattactgtcagacgtgggacagacaatactgacacaacgagtcttacggaacgtcgggaccagggtctacgtcgtaccgtaggtccacgcccgaacggccctaaccccg

SEQ ID NO: 124190 - DNA, 567 bp, Homo sapiens
  misc_feature: GYAE6OF02H47JV.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccggcagtccctgtgctggtcatctatcaagataagaagcgggcctcgagggactccctgacgcgattctcgtggcctaccaacgtcccgggaaacacacgcccacccgtgacccataccgacggccgggacccaggctaagtgggatggaacggctagaacttattactgtacagtacggtcgggaacaggacaagtactgaccaacaacgtaggtaccgttacggaacgtgggaacccgtagggtctaaccgttcggtacccgtaggtcccaccggacccgaaccggaccctaaccccg

SEQ ID NO: 124191 - DNA, 317 bp, Homo sapiens
  misc_feature: GYAE6OF02F691W.37.38.D05.1.454.CMB.1.raw
  modified_base (311)..(317): a, c, t, g, unknown or other
  misc_feature (311)..(317): n is a, c, g, or t
tcagtagtgtagatcacgaccggtgctcgatttagtatctgatagttgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccctggaaccagcagtgacgttggcagcccaaggctcgcccctggtcactctcgttcccacctcctcatctacactactgagcgggctggcaaggcgcatagnnnnnnn

SEQ ID NO: 124192 - DNA, 606 bp, Homo sapiens
  misc_feature: GYAE6OF02JYAXO.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattagggaaataaatatgcttgctggtatcagcagacgccggccacgtcccctgtcgcgtgtcatctatcaagataagagcggcctcgacggactccgtgagcgtattctctacggcctaccgtaaccgtccggaaacaccgacgccctacccgtcgaaccctataccgacggccgggaacccgaggacctaaggtcggagttacggacggtactagtacgttacttaccgtggttacgaggtacggtacggaacgacgtactaacgtaccgtacgaccaacgtaacgtacgggtcttacgggacgtacggggaacctagggtacctacggtccgttaccgtacggtaccgaccggacccgaccggaccctaaccccg

SEQ ID NO: 124193 - DNA, 458 bp, Homo sapiens
  misc_feature: GYAE6OF02FOLHT.37.38.D05.1.454.CMB.1.raw
  modified_base (321)..(321): a, c, t, g, unknown or other
  misc_feature (321)..(321): n is a, c, g, or t
  modified_base (377)..(377): a, c, t, g, unknown or other
  misc_feature (377)..(377): n is a, c, g, or t
  modified_base (434)..(434): a, c, t, g, unknown or other
  misc_feature (434)..(434): n is a, c, g, or t
  modified_base (441)..(458): a, c, t, g, unknown or other
  misc_feature (441)..(458): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacnggtcttcggaactggggaccagggtcatcgtctaggtcagcccaaggcccaacccnctgtcactctcgttccccaccctcctcatccacactactgacgcggctggacaggcncagtagnnnnnnnnnnnnnnnnnn

SEQ ID NO: 124194 - DNA, 541 bp, Homo sapiens
  misc_feature: GYAE6OF02GUMY1.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccgggccacgtcccctgtgctggtcatctatcaagataaagaagcgggcctagacgggactcccgtagacgcgtattctctggcctaccgaacgtccggaaacacgacgcccaacctcgaccatccgaggccgggacccaggctagtggatggagctagtactattactgtacagtacgtaggacagacaatcagcaacaacgtaggtactacggaacgtcggaaccgagggtcacgtcgtaccgtacggtccacggacccgacgacccaacccg

SEQ ID NO: 124195 - DNA, 490 bp, Homo sapiens
  misc_feature: GYAE6OF02GHA3I.37.38.D05.1.454.CMB.1.raw
  modified_base (464)..(464): a, c, t, g, unknown or other
  misc_feature (464)..(464): n is a, c, g, or t
  modified_base (466)..(471): a, c, t, g, unknown or other
  misc_feature (466)..(471): n is a, c, g, or t
  modified_base (473)..(473): a, c, t, g, unknown or other
  misc_feature (473)..(473): n is a, c, g, or t
  modified_base (476)..(490): a, c, t, g, unknown or other
  misc_feature (476)..(490): n is a, c, g, or t
tcagtagtgtagatcacgaccggtgctcgatttagtatctgatagttgggtttgggcagtgtccgtgtccccgggacagacagccaccagtcacctgctctggagatgaattgggaaataaatatgcttgctggtatcagcagaagccgggccagtcccctgtgctggtcatctatcaagataagaagcgggacctcagggatccctgagcgattctctggcctccaactccgggaacacagcccacctgaccatcagcggacccaggctatggatgaggctgactatactgtcagacgtggacagctaatactgcacaacaggtcttcggaactcgggacagggtcacgtcgtccgtaggtcacgcccaaaggcccaaccccagtcgtaccacgttactcgttccccgacccttcctcactcctacacttacgtgacgcgggctggacaagggccactatagncnnnnnnangtnnnnnnnnnnnnnnn

SEQ ID NO: 124196 - DNA, 717 bp, Homo sapiens
  misc_feature: GYAE6OF02GPA3G.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcgagaacgccggaccacgtcccctgtcgctggtcatctatcaagataaggaacgcgggtacctacgagggactcccgtagacgcgtattcgtcgtcggcctaccgaaccgtacccggggaaacaacccgtacggacccctaacccgtcgaacccctacgtacccgaacgggccccgggaaaccccagggaccgttaaggtacgggacgtacgggacgggtacttacggtaaacctttactttaacgtcggttacgacgggtaaccggtacggggaacctaacggaaccttaaacgttaccgtacgaccaaaccgtaaccgtaacgggtttccgttaaccggggaaccggttaccgggggtaaacccgttacggggttacccgaacgtttacccggttaccgttaaccgggttaccaacccgggtacccccgtaaccgggacccccttaaaccccccgg

SEQ ID NO: 124197 - DNA, 780 bp, Homo sapiens
  misc_feature: GYAE6OF02JWFP5.37.38.D05.1.454.CMB.1.raw
  modified_base (160)..(160): a, c, t, g, unknown or other
  misc_feature (160)..(160): n is a, c, g, or t
  modified_base (743)..(743): a, c, t, g, unknown or other
  misc_feature (743)..(743): n is a, c, g, or t
  modified_base (754)..(754): a, c, t, g, unknown or other
  misc_feature (754)..(754): n is a, c, g, or t
  modified_base (760)..(760): a, c, t, g, unknown or other
  misc_feature (760)..(760): n is a, c, g, or t
  modified_base (766)..(766): a, c, t, g, unknown or other
  misc_feature (766)..(766): n is a, c, g, or t
  modified_base (774)..(774): a, c, t, g, unknown or other
  misc_feature (774)..(774): n is a, c, g, or t
  modified_base (778)..(779): a, c, t, g, unknown or other
  misc_feature (778)..(779): n is a, c, g, or t
tcagtagtgtagatcacgaccggtgctcgatttagtatctgatagttgggtttgggtcgagtgtccgtgtcccgggacacgacagccaccatcacctgctctggagatgaattgggaataaatatagcttgctggtatcagcagaagccgggcagtcccngtcgctggtcatctatcaagataagaagcgggcctcaagggactcccgtgacgcgacgttctctggctccaactccggggaacaccgacgccacccttcgaccactcacggccgggaacccagggcctaacgtcggtagtacggacgggtcctagaaccgtttattaaccgtcggttaccgaacgaaccgggtttcgggggaaaccacggaaccaaaacgtttaccgtaggtaccaacgaaacccgtagggttaccgtttaacgggaaccgtttacgggggaaccccgttaaggggttcctaaacgtccggtttaaccgttacgggggttaactaaacccgggacccccgaaaggggtacccccctaaaacccccgtacgttaccggtttaaccccgaaccgtttaaccgttccccgtttaacccccgaaccccgttcccttaccccgtaaaacttccccgttaaaaccaccgtttaacccgttacggaaaccgggttcccgggaaaccgtttcgggaaccccggtaagggttacccgaccggttaacctaagggccttaacgcgaacgccgttacgagtccncgctcgcgacncacgcncgtacncgacgcgngacnnc

SEQ ID NO: 124198 - DNA, 459 bp, Homo sapiens
  misc_feature: GYAE6OF02GIDX9.37.38.D05.1.454.CMB.1.raw
  modified_base (446)..(459): a, c, t, g, unknown or other
  misc_feature (446)..(459): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtgggacagcaatactgcacaacaggtcttcggaactgggaccagggtcatcgtccttggtcagcccaaggcccaaccccactcgtcactctcgttcccgccctcctcactcctacactactcgacgcgggctggcaaggcgcatacgnnnnnnnnnnnnnn

SEQ ID NO: 124199 - DNA, 569 bp, Homo sapiens
  misc_feature: GYAE6OF02HBFW9.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggacagacagccaccatcacctgctctggagatgaattagggaaataaatatgcttgctggtatcagcagaagccggccacgtccctgtgctggtcatctatacaagataagagcggcctacgaggactccgtgacgcgtacttctcgtcggactacccgaacgtacccgggaacacgacgacccacccgtagacccataccgacggccgggacccaggtctagtggactgaggtctagtacttattacgtgtcgagacggtaggacagactaataccgtgactaacgacgtacggtacgttacggacggtcggaccgtagggtaccagttccgtaccgttacgggaccaccggacccgtaacggacccctaacccg

SEQ ID NO: 124200 - DNA, 552 bp, Homo sapiens
  misc_feature: GYAE6OF02IAG1P.37.38.D05.1.454.CMB.1.raw
  modified_base (224)..(224): a, c, t, g, unknown or other
  misc_feature (224)..(224): n is a, c, g, or t
  modified_base (409)..(409): a, c, t, g, unknown or other
  misc_feature (409)..(409): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctgganatgaattgggaaaataaatatgcttagctggtatcagcagaagccggaccacgtcccctgtgctggtcatctatcaagataagagcggactcgagggactcccgtagacgcgtattctcgtggctaccgaactccaaggaacacacgcccacctgaaccatcgaggccgggacccaggcctaagnggatgacggctacgactattactgtacgagacgtggacagacaaatacgacgacaacgaactaggtaccttacggaacgttcgggaccgtagggtacctagtccggtaccgttaacggtccacgtaccccgaaccgaaccccc

SEQ ID NO: 124201 - DNA, 493 bp, Homo sapiens
  misc_feature: GYAE6OF02JP4V6.37.38.D05.1.454.CMB.1.raw
  modified_base (467)..(467): a, c, t, g, unknown or other
  misc_feature (467)..(467): n is a, c, g, or t
  modified_base (473)..(493): a, c, t, g, unknown or other
  misc_feature (473)..(493): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcggacccaggctagtgatgaggctgactatactgtcagacgtggacagcaatactgcacaacaggtcctcggaactcgggaccagggtcagtcgtaccgtaggtccgacccaagggcccaaccccagttcgacctacctcctcgttaccccgcccttccgtacacttcctaaccacctacttcgacgcgggactcggacagggcgacagtagngactcnnnnnnnnnnnnnnnnnnnnn

SEQ ID NO: 124202 - DNA, 450 bp, Homo sapiens
  misc_feature: GYAE6OF02IB8QZ.37.38.D05.1.454.CMB.1.raw
  modified_base (438)..(450): a, c, t, g, unknown or other
  misc_feature (438)..(450): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgagctgactattactgtcagacgtgggacagcaatactgcacaacaggtcttcggaactgggaccagggtcagtcgtcctaggtcagcccaaggccaaccccatcgtcactctgtcccgcctcctcactctacactactgacgcgggctggcaaggcgcatagnnnnnnnnnnnnn

SEQ ID NO: 124203 - DNA, 690 bp, Homo sapiens
  misc_feature: GYAE6OF02IVVDK.37.38.D05.1.454.CMB.1.raw
  modified_base (222)..(222): a, c, t, g, unknown or other
  misc_feature (222)..(222): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctctatgaactgactcagccaccctcagtgtccgtgtcccggacagacagccaccatcacctgctctggagntagaattagggaaaataaatatggtcttgctggtatcaagcaagaacgccgggacctacgtcccctgtcgacttcggtcatcctaatacaagaataaaggaagcgggacctagagggtactcccgagacgcgtaattcctcgtacggctaacccgtaacgacccgggaaacacgaccgaccctacccgtacgaacctaacgaccgaaccgggaccgggaaccccggaacggtaccgtaagtacgggtaggtacggaacggtacgttacggaactttaacttaaccggtagtaaccgtaacggacgggttaacgggaaccgtaaccggaacctaaacgtaacgtaccggaaacacgtaaacggtacgtaccggttaacggaaccggtacgggaacccggtagggtacgtaaccgttacggttaccgtaacggtaccgaccggaacctaaccgggacccctaaaccccgg

SEQ ID NO: 124204 - DNA, 539 bp, Homo sapiens
  misc_feature: GYAE6OF02HL8HW.37.38.D05.1.454.CMB.1.raw
  modified_base (390)..(390): a, c, t, g, unknown or other
  misc_feature (390)..(390): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccggccagtcccctgtgctggtcatctatcaagataagaagcgggcctcagggatccctgagcgattctctggctccaactccgggaacacacgccaccctgaccatcagcggacccaggctagnggatgaggctgacttatactgtcagtacggtggacagacaatacgtgacaaccaacgacggttcgttaccggaacgttcggggaccctaaggggtccaacgttccggtacctacgggtccacggaccccaagggccccctaaaccccgg

SEQ ID NO: 124205 - DNA, 461 bp, Homo sapiens
  misc_feature: GYAE6OF02F5T4N.37.38.D05.1.454.CMB.1.raw
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
  modified_base (449)..(461): a, c, t, g, unknown or other
  misc_feature (449)..(461): n is a, c, g, or t
tcagtagtgtagatcacgaccggtgctcgatttagtatctgatagttgggtttgggcagtgtccgtgtccccgggacagacagcccaccatcacctgctctggagatgaattgggaaataaatatgcttgctggtatcagcagaagaccggggcccagtcccctcgtgctggtcatctatcaagataagaagcggcctcagggatccctgagcgattctctggctccaacctccgggaacacagccaccctagaccactcagcgggacccaggctatggagtgaggctgactattactgtcagacgtgggacgacgcgaactactgcaacaacaggtcttcgactgggaccaggtcatcgtactagtcagcccaacggccaacccactgtcactctctcccgccctcctcanctacnctaactcgagccggactgacaggcgnactagnnnnnnnnnnnnn

SEQ ID NO: 124206 - DNA, 533 bp, Homo sapiens
  misc_feature: GYAE6OF02IDCCZ.37.38.D05.1.454.CMB.1.raw
  modified_base (282)..(282): a, c, t, g, unknown or other
  misc_feature (282)..(282): n is a, c, g, or t
  modified_base (322)..(322): a, c, t, g, unknown or other
  misc_feature (322)..(322): n is a, c, g, or t
  modified_base (511)..(533): a, c, t, g, unknown or other
  misc_feature (511)..(533): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcgagggactccctgagcgattctctggctccaactccgggaacacacgccaccctgaccatcagccgggacccaggctagtggatggnggctagtactattactgtcagacggtggacagacaatacngacacaacgtacggtcttacggacgtcgggaccgaggtcacgtcgtactaggtcacgacccgaacggacccaacccctacgtcgtcctaccttcgttccgttacccccaccgttccctacacttccctaactaccttacgtcgacggtccggtcgtacgggactaacgggccgacgtaacgtagcacgnnnnnnnnnnnnnnnnnnnnnnn

SEQ ID NO: 124207 - DNA, 582 bp, Homo sapiens
  misc_feature: GYAE6OF02H4B5P.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtcccccgggacagacagccaccatcacctgcctctggagatgaattagggaaataaatatgcttgctggtatcagcaggaacgccgggccacgtcccctgtgctggtcatctatacaagtataagaaggcgggcctcgagggtactcccgtgagcgtattctcgtggcctaccgaacgtccgggaacacacgcccacctcgacactcacggccggacccaggctagtggataggacggtctagaacttacttcgtgtacaggtaccggtagggacacgacaaattcgtacgactaactaacgagttcccgtaccggtaacgtcgggaacccgtagggtactacgtccggttacgtacggaccgtacccggaacccgaccggtacccctaaccccg

SEQ ID NO: 124208 - DNA, 695 bp, Homo sapiens
  misc_feature: GYAE6OF02FO67L.37.38.D05.1.454.CMB.1.raw
  modified_base (295)..(295): a, c, t, g, unknown or other
  misc_feature (295)..(295): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctancaagataagaagcgggcctcgagggactcccgtagacgcgtattccgtcgtcggacctcccgaaaccgtcccgggaaactaccgaccgacccctaccccgacggaacccacgtccgaaccgggacccgggtaaccccgagggtaccttaaggtacgggtacgtacgggaacgggtccttacgtaaccgtttaacgtttaccgtcggttaaccgaacgggtacggttacggggaacctaacgggacctaaacgttacgtaccgaccgaaaccgtaaccgtacgggtttaccgtaacgggaaccggttacggggaacccgtacggggtacctaccggttaccggttaccggttaacggttacccgacccggtaccccggaacccggtccccctaaaccccgg

SEQ ID NO: 124209 - DNA, 608 bp, Homo sapiens
  misc_feature: GYAE6OF02I49MG.37.38.D05.1.454.CMB.1.raw
  modified_base (467)..(467): a, c, t, g, unknown or other
  misc_feature (467)..(467): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgtcttgctggtatcagcagaaggccgggccacgtcccctgtgctggtcatctatcaagataagaacggcggcctcgagggtactcctgacgcgtattctcgtcggctacccgaacgtaccgggaacaccgacgaccctacccgtcgaacccagtaccgacgggaccccgggaacccgagggtcctaaggtgggagtaggacggtctaggtaacttattacgtntacgacgtacggtacggactacggaactaactaccgtgaccaacgtaacgtaggttaccgtacgggaacgttcgggaccgtacgggtctaacgtcggttaccgtaggaccaaccggaccccggaacggacccctaaccccg

SEQ ID NO: 124210 - DNA, 323 bp, Homo sapiens
  misc_feature: GYAE6OF02IFN4U.37.38.D05.1.454.CMB.1.raw
  modified_base (271)..(271): a, c, t, g, unknown or other
  misc_feature (271)..(271): n is a, c, g, or t
  modified_base (316)..(323): a, c, t, g, unknown or other
  misc_feature (316)..(323): n is a, c, g, or t
tcagtagtgtagatcacgaccggtgctcgatttagtatctgatagttgggggggtcgtcaggaggcagcgctctcaggacatctccaccatggcctgggctatgctgctcctcaccctcctcactcagggcacagggtcctgggcccagtctgccctgactcagcctgcctccgtgtctgggtctcctggacagtcgatccaccatctcctgccctggaaccagcagtgacgttgcagacccagctcgccccctggtcactctcgtccccnccctctcatctaccactactgaggcggctggcaagggcacatagnnnnnnnn

SEQ ID NO: 124211 - DNA, 829 bp, Homo sapiens
  misc_feature: GYAE6OF02J1FSC.37.38.D05.1.454.CMB.1.raw
tcagtagtgtagatcacgaccggtgctcgatttagtatctgatagttgggtttggggcgtgggcctcaggaagcagcatcggaggtgcctcagccatggcatggatccctctcttcctcggcgtccttgcttactgcacaggatccgtgcctcctatgaactgactcacgccacctcagtcgtccgtcggtccccggacacgacacgcccaccatccgacctcgctcctggagtatcgtaaagttagggtaaaataaattagttcgtaccgtttgaccgttagttactaccgagaccgaaggtaaccggcccggtacccgtaaccggttcccccgttaggtaccggtcgttcggttaccgtactaccgttaacgtaaccgtaaggtaaacggtttaaacgggacggtacccgggtaccgtacggttaaaccgggaccgtttaacccggacggtacggtaacccgttcttaccgtaccggtcgtaacccgtaccgtaaaccgtacccgggaaacacccgacccgtaccgtacccgtaactaccgtaacgaccgtaaaccccgggcgggaaacccccgtagggtaacccgttaggtaaccgggtaacttaccgggaaggttacccggttaaccgttacgttaaccgttaacgttacggacccgttaacggggaccggtaacggtacgttaaaccgacgtaaccggttacaccggaaactaacgaaccggttacgtaccggtacggtaaccgggtaccggttaccgacggtaccgtaacgttccgtcgttaaccggtacccaacggtacccggtacccaacccgtaaccccg

SEQ ID NO: 124212 - DNA, 651 bp, Homo sapiens
  misc_feature: GYAE6OF02F35E8.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaaataaatatgcttgctggtatcagcagaagccgggcacgtcccctgtgctggtcatctatcaagataagaaggcgggacctcgagggactcccgtgagcgtattctcgtggcctaccgaacgtacccggggaaccaacgacgccccaccctcgacccatccacggaccgggacccagggtcctaagtgggaacgtggacggtctaggtaacttacgttaacttggtaccgaggtaccggtaggggaactacgactaaacgtttcgacgaccaaccgtaaaccggtacggttaccgtttaaccgggaacggttcggggaaccccgtaggggttaccctacggtttacccgggttacccggttacgggttacccgaaccgggtacccccggaaaccgggtacccccaaaccccccgg

SEQ ID NO: 124213 - DNA, 620 bp, Homo sapiens
  misc_feature: GYAE6OF02GL8G5.37.38.D05.1.454.CMB.1.raw
  modified_base (295)..(295): a, c, t, g, unknown or other
  misc_feature (295)..(295): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgacttgctggtatcagcagaagccggcacgtcccctgtgctggtcatctancaagataaagaacgcgggcctacgagggactccctgacgcgtattctcgtcggctccgaacgtcccgggaacacacgcccacccgtcgaaccactcacggccgggaccccagggcctaagtcgggaagtggaacggtctacgtaacttacgttactggtacaggtacggtgggaacacggacaacgttacgtagacaaaccgaacgtacgggttccgttaaccgggaacgttacgggggaaccctaaggggttacctacgttcccggttacccgttaacgggttcccgaccggtacccccgtaacgggacccctaaaccccccgg

SEQ ID NO: 124214 - DNA, 458 bp, Homo sapiens
  misc_feature: GYAE6OF02HDJN7.37.38.D05.1.454.CMB.1.raw
  modified_base (375)..(375): a, c, t, g, unknown or other
  misc_feature (375)..(375): n is a, c, g, or t
  modified_base (435)..(435): a, c, t, g, unknown or other
  misc_feature (435)..(435): n is a, c, g, or t
  modified_base (440)..(458): a, c, t, g, unknown or other
  misc_feature (440)..(458): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccccgtgctggtcatctatcaagataagaagcgggcctcagggatccctgagcgattctctggctccaactccgggaacacagccaccctgaccatcaggcggacccaggctatggatgaggctgactattactgtcagacgtgggacagcaaatactgcaacaacaggtcttacggaactgggaccagggtcatcgtctagtcagccaagccaacccntgcactctctcccaccctcctcactctaacacctactgacgcgggctcggacaacgggcncatgnnnnnnnnnnnnnnnnnnn

SEQ ID NO: 124215 - DNA, 476 bp, Homo sapiens
  misc_feature: GYAE6OF02JFTIS.37.38.D05.1.454.CMB.1.raw
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (417)..(417): a, c, t, g, unknown or other
  misc_feature (417)..(417): n is a, c, g, or t
  modified_base (453)..(476): a, c, t, g, unknown or other
  misc_feature (453)..(476): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctcccaacgtccgggaacacagcccaccctgaccatcagccgggacccaggctatggatgaggctgactattactgtcagacgtgggacagcaatactgcacaacaggtctcggaacngggacagggtcagtcgtctagtcacgacccaaggcccaaccccntcgtcactctccgttcccaccctcctcactcctacnctactgaggccggctacggcgaagccgactagtagnnnnnnnnnnnnnnnnnnnnnnnn

SEQ ID NO: 124216 - DNA, 679 bp, Homo sapiens
  misc_feature: GYAE6OF02HNTE4.37.38.D05.1.454.CMB.1.raw
tcagtagtgtagatcacgaccggtgctcgatttagtatctgatagttgggtttggggctgggcctcacggaagcagcatcggaggtgcctcagccatggcatggatccctctcttcctcggcgtccttgctttactgcacaggatccgtggcctcctattgaactgactcagccaccctcagtgtccgtgtccccgggacaggacagccaccatccaccgtcgctctggagactgaattgggaaataatatgcttgctggtatcagcagaagccggccacgtcccctgtcgctcggtcagtcgtatcaagataagaacgcggacctgagggactcccgtggacgtacgtattctctcggacctaccaaaccgtccgggaaactacacgaccccaccgtacgaaccctacgtaccacgggtacccgggaacccgacgggtactaagtacgggaacgttacgggacgggtactacggtacctttaaccgtttaacgtacggttaccgaagggtaccggttagggaaccgtagacgtaaattccgtaggaaccaaccgtaacgtacggttacgttaccgggtaaccgtcgggggtacccgacggggttaccaaccggttccggttaccgttacgggtaccgtaaccgggtaccccggtaaccgggtaccccctaaaccccgg

SEQ ID NO: 124217 - DNA, 797 bp, Homo sapiens
  misc_feature: GYAE6OF02G4HVW.37.38.D05.1.454.CMB.1.raw
  modified_base (227)..(227): a, c, t, g, unknown or other
  misc_feature (227)..(227): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacagccaccatccacctgcctctgganatgaattagggaaaataaatatgcttgctggtatcagcagaacggccgggccacgtcccctgtcgcgtggtcatctatacaagagtaagaacggcggtcctagacgggtactcccgtgacgcgtattccgtcgtcggcctaccgaaccgtaccgggaaacaccgaccgacccctacccgtacgaaccctacgtaccggaaccgggtacccggggaaacccgtaggtaaccgttaggtacgggtaacgtacgggaacgggttaccgttaacggttaaacctttaacgttaaccttacgggtaaccgttaacgggtaaccggggttacggggaaacctaacggggtaaaccgtaaaacgttaccgttaaccggaaaccgtaaaacccgtaaaccggttaaccggggttttacccgttaaacccggggtaaaccggttaacgggggtaaaccccggttaaacgggggttaccccttaacgggtttaccccgggtttaacccggttaacggggttacccccgaaacccggtaaaccccccggtaaaccccgggtaaccccctaaacccccccgg

SEQ ID NO: 124218 - DNA, 570 bp, Homo sapiens
  misc_feature: GYAE6OF02GKZ6X.37.38.D05.1.454.CMB.1.raw
  modified_base (334)..(334): a, c, t, g, unknown or other
  misc_feature (334)..(334): n is a, c, g, or t
  modified_base (481)..(481): a, c, t, g, unknown or other
  misc_feature (481)..(481): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtcgtccccgggacagacagccaccatccacctgctcgtggagatgaagttgggaaataaatatgcttgctggtatcagcagaacgccggccacgtccctgtgctggtcatctatacaagaagtaagaacgcggacctcgaggactccgngagcgtattctcgtggcctaccgaaccgtcccggaacaccgacgcccaccctcgaacccagtccgacggcccgggacccaggctagtggagtcggacggctagacgttatacctgtacgaggacggtacgggacaggactaacgtcncgaccaagaaccgtcggttactacggtaacgtcgggacctagggtccacgttccgtcgtaggtaccacgacccgaccgacccaaccccg

SEQ ID NO: 124219 - DNA, 511 bp, Homo sapiens
  misc_feature: GYAE6OF02IUSZS.37.38.D05.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
  modified_base (488)..(511): a, c, t, g, unknown or other
  misc_feature (488)..(511): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaacgtccgggaacacacgccaccctgaccatcagccgggacccaggctatggatgaggctggctattactgtcagacgtgggacagacaatacngcaacaacnggtctacggacgtggaccnggtcagtcgtacctaggtccacgaccgacggacccaccctactgtacctacgtcctccgttcccccaccccttctacttaactttaccaccttacgtcggacggtccgggtacctcgggacaacgggtccacgtaatcgatcnnnnnnnnnnnnnnnnnnnnnnnn

SEQ ID NO: 124220 - DNA, 696 bp, Homo sapiens
  misc_feature: GYAE6OF02HWXQ9.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccacatcacctgctctggagatgaattagggaaataaatatgcttgctgtatcagcagaagccggccacgtccctgtcgcgtggtcatctatcaagataagaacgcggcctcgagggtactcccgtagacgcgtagttctcgtcggacttaccgaacgtcccgggaaacacgaccgacccgtaccctacgaacctacgtaccgaacggacccggggacccgaggtacgttagacggtagtacggaacgggtacgttacgaactttaacgttacgtacggtaccgacggtaaccggttacggggaaccgtaacgtaacctaacgttaaccgttacgaacgtaaacccgtaacgtacgggtttacccgttaaccggggtaacgttaccgggggtaacccgttagggggtaacccgtaacgtttacccggttacccggttaaccgggttaccgaaccccgggtaccccgtaaaccgggacccccctaaacccccgg

SEQ ID NO: 124221 - DNA, 650 bp, Homo sapiens
  misc_feature: GYAE6OF02HN7YX.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgtaattgggaaataaatatgacttgctggtatcagcagaagccgggcagtcccctgtgctggtcatctatacaagataaaggaagcgggcctagagggactcccgtagacgcgtattcgtctcggtctaccgtaaccgtacccggggaaactaccgaaccggtccccaacccgttcgaaccctacgtaccgaaccgggacccgggaccccgtagggtacctaacggttgggaacgttcggaaggcgttacgaactttagttaaccgtgtaccgaggtaccggttaggggaccaggaccaagttacgtcgacctaaccgaaacgtacggttaccttaacgggaccgttcgggaaccgtaggggtctacggttaccgttacgtacgggtaccgaacggtaccccgtaacggacccctaaacccccg

SEQ ID NO: 124222 - DNA, 327 bp, Homo sapiens
  misc_feature: GYAE6OF02GRCE0.37.38.D05.1.454.CMB.1.raw
  modified_base (321)..(327): a, c, t, g, unknown or other
  misc_feature (321)..(327): n is a, c, g, or t
tcagtagtgtagatcacgaccggtgctcgatttagtatctgatagttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccctggaaccagcagtgacgttggtcagcccaaggcctcgccccctcggtcactctcgttccccaccctcctcactctacactactgacggcggctggcaaggcgacatagnnnnnnn

SEQ ID NO: 124223 - DNA, 563 bp, Homo sapiens
  misc_feature: GYAE6OF02IWMZ6.37.38.D05.1.454.CMB.1.raw
  modified_base (418)..(418): a, c, t, g, unknown or other
  misc_feature (418)..(418): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (561)..(561): a, c, t, g, unknown or other
  misc_feature (561)..(561): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcgagggatccctgagcgattctctggctccaacgtccgggaacacagcccacctgaccatcaggccggacccaggctaagtggatgaggctgactattactgtcaggacgtgggacaggctaatactgactaaccaacgtagggttaccttacgggaactggggaaccgagggttcaacgttcgttccgtaagggtccaaacgtcccgaacgacccgaaccccngtcgactactccgtacgtccccgcctaccacgtctaccaccttaactactcggactccggggtacacggtaccggacggactacccgtaagtgtacgcacgcgacncncgcncncacgcacncnncncgcacgncgcgtacanac

SEQ ID NO: 124224 - DNA, 580 bp, Homo sapiens
  misc_feature: GYAE6OF02JLA94.37.38.D05.1.454.CMB.1.raw
  modified_base (177)..(177): a, c, t, g, unknown or other
  misc_feature (177)..(177): n is a, c, g, or t
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (473)..(473): a, c, t, g, unknown or other
  misc_feature (473)..(473): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctnagtgtccgtgtccccggganagacagcctacatcacctgctcngganatgaattgggaaataatntgcttgactggtatcagcagaagccgggtcagtcccctgtagctggtcatcgtatcaagataagaacgcggcctacgagggtactccgtagacgcgtaattccgtcttcggactcaaccgttaccgggaacctacgacgtccgaccctgaccatcaacgggccggacccaggactagtggatgacggctagactattcgtgtacagtacgtaggacctagcctaagtaccngacaaccgtagaccggttacttacgggaaccgtcgggaaccgtaggtaccgacgttaccgtaccggtacggttaccgaccgtacccggaaccggtccctaaaccccg

SEQ ID NO: 124225 - DNA, 506 bp, Homo sapiens
  misc_feature: GYAE6OF02HB8LI.37.38.D05.1.454.CMB.1.raw
  modified_base (482)..(482): a, c, t, g, unknown or other
  misc_feature (482)..(482): n is a, c, g, or t
  modified_base (485)..(506): a, c, t, g, unknown or other
  misc_feature (485)..(506): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccacctgaccatcagcggacccaggctatgatgagctgactattactgtcagacgtgggacagacaatactgcaacaacaggttcttacggaacgtcggggaccagggtcagtccgtccgtaggtcacgcccgaaggccccaacccgtctcgtccaccttccgttccgttacccccgcccttcctctacttaccctacaccttactaggacggtccgggctcgggaccaaggccgactatagnacnnnnnnnnnnnnnnnnnnnnnn

SEQ ID NO: 124226 - DNA, 546 bp, Homo sapiens
  misc_feature: GYAE6OF02IN9RO.37.38.D05.1.454.CMB.1.raw
  modified_base (339)..(339): a, c, t, g, unknown or other
  misc_feature (339)..(339): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtcgctggtcatctatcaagataagaagcgggcctcgagggactccctgacgcgattcnctggctaccgaacgtccggaacacacgcccaccctgaccatccagccgggacccaggctagtggatggagctagacttattacgtgtacagtacggtcgggacagactaagtactgacaaccaacgaggttccgtacggtaaccgtcgggaacccgagggtcctacgtcgtaccgtaggtaccacggacccgacggcccaaaccccg

SEQ ID NO: 124227 - DNA, 621 bp, Homo sapiens
  misc_feature: GYAE6OF02IFKOW.37.38.D05.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (405)..(405): a, c, t, g, unknown or other
  misc_feature (405)..(405): n is a, c, g, or t
tcagtagtgtagatcacgaccggtgctcgatttagtatctgatagttgggtttggggctgggcctcaggaagcagcgatcggaggtgcctcagccatggcatggatccctctcttcctcggcgtccttgcttactgcacaggatccgtggcctcctatgaactgactcagccacctcagtgtccgtgtccccggganagacngccaccatccacctgctctggagatgaattgggaaataaatatgcttgctggtatcagcagagccggcacgtccctgtgctggtcatctatcaagactaagaagcgggcctcgagggactcctgagcgtattcctcgtacggtctccgaaccgtcggaaccacacgacccacccgtcgacctatccgaacggccgggaacccngggtactagtacgggtatacggaggtctacggtaacttaattacgtcgacgagtacgggttacgggacaacgcgtaaacttcgtacgtaccaaactaaccggtaggttaccgtttaccgggaacgttcgggggaacccgtaagggggtacctaacgttacccggttacgttacgggtaccgaccggtacccgtaacccgggaccctaaaccccccg

SEQ ID NO: 124228 - DNA, 753 bp, Homo sapiens
  misc_feature: GYAE6OF02FG03A.37.38.D05.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccaccatccacctgctctgganatgaattgggaaaataatatgtcttgctggtatcagcagaacgtccgggcacgtccctgtgctggtacatctatcgaagataaggaaggccgggacctcgaagggactcccgtaggacgtcgtatttccgtcgtacggtcctacccgaaacgtcccggggaaaccaccgaacgtcccccaccgtacgacccgaactccgaaccgggtcccggggaaccccagggtaccttaggtacggggtaattcgggaacggtacgttacgttaaacctttaacgttaacgttacggttaaccggaacgggtaaccgggttacggggaaccgtaacgaaccgttaaacgtaacccgttcgaaaccgtaaacccgtaaaccgggttacggttttacccgtaaaccgggtaaccgggttaaccgggggtaacccgtaacggggggttaccctaaccggtttacccggtttacccgttaacggggtaacccacccgggtaacccccggtaaaccgggtaccccccttaaaaccccccgg

SEQ ID NO: 124229 - DNA, 568 bp, Homo sapiens
  misc_feature: GYAE6OF02FYRKX.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccacatccacctgctctggagatgaattgggaaataaatatgcttgctggtatcagcagaagccggccagtcccctgtgctggtcatctatcaagataagaagcgggacctcgagggactcccgtgagccgattcctcgtcggctacccaaacgttcccggggaaacaccgagccctaacctcgaccaatccgacggccggggaaccccaggtcctaagtcgggaactcggaaggctaggtacctagttactgtaccgagtacggtagggacagtacaagttcagacaacaacgtggttactacggacgtgggacctagggtcctagtccgtacgtacggtccacggtcccacgaccctaacccg

SEQ ID NO: 124230 - DNA, 532 bp, Homo sapiens
  misc_feature: GYAE6OF02IITM7.37.38.D05.1.454.CMB.1.raw
  modified_base (195)..(195): a, c, t, g, unknown or other
  misc_feature (195)..(195): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
  modified_base (508)..(508): a, c, t, g, unknown or other
  misc_feature (508)..(508): n is a, c, g, or t
  modified_base (511)..(512): a, c, t, g, unknown or other
  misc_feature (511)..(512): n is a, c, g, or t
  modified_base (514)..(515): a, c, t, g, unknown or other
  misc_feature (514)..(515): n is a, c, g, or t
  modified_base (517)..(518): a, c, t, g, unknown or other
  misc_feature (517)..(518): n is a, c, g, or t
  modified_base (520)..(532): a, c, t, g, unknown or other
  misc_feature (520)..(532): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctnagggactccctgagcgattctctggctccaactccgggaacacacgccaccctgaccatcgagcgggaccaggctanggatgaggctgactattactgtcaggacgtgggacngacaagtacngacaacaacgtggtcttacggaacgtgggaacngggtcatcgtccgtaggtccagcccgaaggccccaaaccccgnttcgtacctacctccttcgttacccctaccccttcctaccgtactacccgtaaccaaccttacgtcggaacggccggggtactcgggaccgtaacggcgacgtacgtaagctgncanncnngnncnnnnnnnnnnnnn

SEQ ID NO: 124231 - DNA, 669 bp, Homo sapiens
  misc_feature: GYAE6OF02F43MV.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattagggaaataaatatgcttgctggtatcagcagaagccgggccacgtcccctgtgctggtcatctatcaagataagaaggcggactcgagggactccctaggacgcgtattcctcgtcggactccaacgtcccgggaaaccacgacgacccacccgtgaacccactcgaacggcccggggaacccagggtacctaaggtacgggaacgtacggaacgggtctacggtaactttaacttaccgtacggtttaccgaacggttaacggtacgggggtacaaaccgactaaacgttacgtaccggaacctaaaccgaaaccgtacggttaccggttaacccggtaacgggttcggggtaaacccggtaggggtacctaacgttaccccggtacgttacggtaccgaacgtacccccggaaccgggacccctaaaccccccgg

SEQ ID NO: 124232 - DNA, 576 bp, Homo sapiens
  misc_feature: GYAE6OF02H6FGF.37.38.D05.1.454.CMB.1.raw
  modified_base (552)..(552): a, c, t, g, unknown or other
  misc_feature (552)..(552): n is a, c, g, or t
  modified_base (555)..(576): a, c, t, g, unknown or other
  misc_feature (555)..(576): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtccctgtgctggtcatctatcaagataagaagcgggcctcgagggatccctgagcgtattctctggcctccaaccgtccgggaacacagccaccctcgaccatcgaggccgggacccaggtcctatggatggaggctagactaattactgtcgagacggtagggctagacaatacgtcgacaacgaacgtacggttacgttaccggtaaacggtcgggaacccgagggtctacgttacgtaccgttacgggtaccacgaccccgaacggaccccaaccccctagtacgtcctaaccgttcccgttacgttcccccgacccttccgtacctaacttcccgtaacctaacgttacccttagaacggccgggttacgcggactacgggcctacgagtagcntcnnnnnnnnnnnnnnnnnnnnnn

SEQ ID NO: 124233 - DNA, 461 bp, Homo sapiens
  misc_feature: GYAE6OF02FVGVW.37.38.D05.1.454.CMB.1.raw
  modified_base (237)..(237): a, c, t, g, unknown or other
  misc_feature (237)..(237): n is a, c, g, or t
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
  modified_base (438)..(461): a, c, t, g, unknown or other
  misc_feature (438)..(461): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggcctccaactccgggaacncagccacctgaccatcagcgggacccaggctatggatgaggctgactattactgtcagacgtgggacagcaatactgcacaacnggtctacggaactgggacagggtcagtcgtcaggtcagcccaaggcccaacccntcgtccactctcgttcccnccctccncatctacacttacngacgcggctggcaggcanatagnnnnnnnnnnnnnnnnnnnnnnnn

SEQ ID NO: 124234 - DNA, 529 bp, Homo sapiens
  misc_feature: GYAE6OF02FKU3T.37.38.D05.1.454.CMB.1.raw
  modified_base (197)..(197): a, c, t, g, unknown or other
  misc_feature (197)..(197): n is a, c, g, or t
  modified_base (329)..(329): a, c, t, g, unknown or other
  misc_feature (329)..(329): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccggganagacagccaccatccacctgcctctggagatgaattgggaaaataatatgcttgctggtatcagcagaacgccgggccacgtcccctgtgctggtcatctatcaagataagagcgggcctcgagggctccgngagcgattctctggctccaactccgggacacacgcccaccctcgaccatcacgaccgggacccaggctagtggatggaggctagtacctagttactgtaccaggtacggtgggacagactaactacgtgacacaacgtagtacgtacgaacgtggaccgaggtcagtcgaccgtagccacgacccacggaccctaacccg

SEQ ID NO: 124235 - DNA, 535 bp, Homo sapiens
  misc_feature: GYAE6OF02FU1LM.37.38.D05.1.454.CMB.1.raw
  modified_base (507)..(507): a, c, t, g, unknown or other
  misc_feature (507)..(507): n is a, c, g, or t
  modified_base (516)..(521): a, c, t, g, unknown or other
  misc_feature (516)..(521): n is a, c, g, or t
  modified_base (523)..(535): a, c, t, g, unknown or other
  misc_feature (523)..(535): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagcccacctgaccatcagcgggaccaggctatggatgacggctgactattactgtcagcgtggacagcaatactgacacaacaggtctcggaacgtggggaccagggtcagtcgtcgtaggtcacgacccgaaaggccccaaccccgtacgtcgtacaccttcgtcccgtttccccgcccttccctacgaccttaccttaacctaccttaacgtcggaacggccggggtaccgttacggaccggtaaacgggccgtacgtaagtacgtancagtcacgnnnnnncnnnnnnnnnnnnn

SEQ ID NO: 124236 - DNA, 773 bp, Homo sapiens
  misc_feature: GYAE6OF02I46G9.37.38.D05.1.454.CMB.1.raw
  modified_base (146)..(146): a, c, t, g, unknown or other
  misc_feature (146)..(146): n is a, c, g, or t
  modified_base (454)..(454): a, c, t, g, unknown or other
  misc_feature (454)..(454): n is a, c, g, or t
tcagtagtgtagatcacgaccggtgctcgatttagtatctgatagttggggttgggtctgggcctcaggaagcagccatcggaggtgcctcagccatggctactggatccctcgtcttcctcggcgtccttgcgttactgccacgnggactccgtggcctcctatcggaacctgactcacgcccacccgtcacgttcgtcccgtcgtccccgggacacgaccagcccaccatcacctgacctctgggatagttgtaagttagggaaacttaagtactgacttcggccggtaggtatccgagtacgaacgaggcccggacgacgtcccctagtcgtcgtggtacgatacctaatacaaagtactaaacgaacgggtaccggtcctacggagggactcccgtagacgtaccgtacttcgtcgtcggccttaacccgaaccggtacccgggtaaacnccgtaaccgtacccgtaacccttacggaacccctagtacccgaaccgggaccccgggaaccccgtaacggccgttaacggttccggtaacgtcgggacgttccgtacgaaccgttaacgttaccgtaccgtacgtaacgggtaccggtacgggaaacttaccgggtaacttaacgttaaccgttcggaaaccctaacgggtaaaccgttaccgggtaccgtttaccggaaccggttaacggccggttaacggttccctacgtacccggtttaccggacggtacccgacggaacccgttaacccggccctaaacccccgg

SEQ ID NO: 124237 - DNA, 559 bp, Homo sapiens
  misc_feature: GYAE6OF02IL4DN.37.38.D05.1.454.CMB.1.raw
  modified_base (492)..(492): a, c, t, g, unknown or other
  misc_feature (492)..(492): n is a, c, g, or t
  modified_base (534)..(536): a, c, t, g, unknown or other
  misc_feature (534)..(536): n is a, c, g, or t
  modified_base (539)..(559): a, c, t, g, unknown or other
  misc_feature (539)..(559): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcgagggactcccgtgagcgtattcctcgtcgcctaccaacgtccggaacacgacgcccaccctgaaccatcgacggccggaacccaggactagtggagtggaggtctagtactattacgtgtacgaggacggtcgggaacagactaatacgtgaccaacacgtacggttcgttacggaacgtcgggaccgtagggtctacgtccgttcgtaggtccaacggacccgaccggaccccaacccgtacgtcgactaacctccgttacccgtacccctaacccttccacctataccctaacncttaacgtcggacggtccggcgtaggaccagggcactaagtnnngannnnnnnnnnnnnnnnnnnnn

SEQ ID NO: 124238 - DNA, 512 bp, Homo sapiens
  misc_feature: GYAE6OF02FFYY6.37.38.D05.1.454.CMB.1.raw
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (486)..(488): a, c, t, g, unknown or other
  misc_feature (486)..(488): n is a, c, g, or t
  modified_base (491)..(491): a, c, t, g, unknown or other
  misc_feature (491)..(491): n is a, c, g, or t
  modified_base (493)..(494): a, c, t, g, unknown or other
  misc_feature (493)..(494): n is a, c, g, or t
  modified_base (497)..(497): a, c, t, g, unknown or other
  misc_feature (497)..(497): n is a, c, g, or t
  modified_base (499)..(501): a, c, t, g, unknown or other
  misc_feature (499)..(501): n is a, c, g, or t
  modified_base (503)..(508): a, c, t, g, unknown or other
  misc_feature (503)..(508): n is a, c, g, or t
  modified_base (510)..(512): a, c, t, g, unknown or other
  misc_feature (510)..(512): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataaagaagcggggcctcagggatccctgagcgattctctggctccaactccgggaacacagccacctgaccatcancgggacccaggctatggatgaggctgactattacngtcagactgggacagcaaatactgcacaaanggtcttcggaatggggaccagggtcagtccgtctaaggtcaacgcccaaaggacccaaaccccatcgtacaactcctgtttcccccgccctacctaccatccgtaactacttactcgtaacggccgggtctcgggacctaagggccgtacacgtagncgtnacnnncancnngcncnnncnnnnnncnnn

SEQ ID NO: 124239 - DNA, 173 bp, Homo sapiens; identical to SEQ ID NO: 123962
  misc_feature: GYAE6OF02HTUCD.37.38.D05.1.454.CMB.1.raw
  modified_base (173)..(173): a, c, t, g, unknown or other
  misc_feature (173)..(173): n is a, c, g, or t

SEQ ID NO: 124240 - DNA, 664 bp, Homo sapiens
  misc_feature: GYAE6OF02HY3WC.37.38.D05.1.454.CMB.1.raw
  modified_base (315)..(315): a, c, t, g, unknown or other
  misc_feature (315)..(315): n is a, c, g, or t
  modified_base (400)..(400): a, c, t, g, unknown or other
  misc_feature (400)..(400): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccgggacagacacgccaccatcacctgctcgtggagatagaagttagggaaataatatgtcttagtcgtggtatcagcaaggaacggcccggacacggtcccctgtcgcgtcggtacatctanacaagataagaacggtcggcctagacggacttcccgaggacgcgtacttacctcgtcggtacctaccgaaccgtccgggaaaccnccgaccgtaccctaccgtaccgaaccacgtaccgacgggtcccgggaacccagggtacctagacggtacgtacggtacggcgttacgtaacgtttacttacgtcgtacgtaaggtccgggtaggactacggactaacgtacgtccgaacaaccgtaacgtacggttaccgttaccggtacgggacggtaccggtacggtaaccgtacgttccggtaaccgttacggtaccgaccggtacccgacccggttaccccgaaaccccg

SEQ ID NO: 124241 - DNA, 697 bp, Homo sapiens
  misc_feature: GYAE6OF02I43RX.37.38.D05.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcggtccccgggacagacncgccaccatcacctgctcgtgganatagaagttaggaaaattaaatatgtcttgcgtggtactcagcagacggccggcacgtccctgtcgctggtcactactatacaagaacgtaaggaacggtccgggtacctacggaacggaccgtccgtacggacgcgtaacgtttccgtcgtcggtacctacccgaaccggtaccgggaaccaccgaccgtccccaacccgtcgaacctacgtaccgaccgggacccgggacccgacggtaccttaggtacggtagtaggacggtactacgtaacgtttattacgttagtacggaacgggtacgggacgggaacgacgtaacgtaagtaccgttgaaccaacgaacgttacgggttaccgttaaccgggtaacggtaccggggtaaccgtaacggggttccctaacggttacccggttacggtaaccggtacccgaacgtaccccggaacccggaccccctaaacccg

SEQ ID NO: 124242 - DNA, 693 bp, Homo sapiens
  misc_feature: GYAE6OF02H0VES.37.38.D05.1.454.CMB.1.raw
  modified_base (198)..(198): a, c, t, g, unknown or other
  misc_feature (198)..(198): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtgtccgtgtccccggganagacagccacatcacctgctctgagatagaattagggaaataatatgtcttagctggtatcagcagaacgcccgggccacgtccccgtgtcgtcttggtcatctatcaagataagaacggccggcctacgacgggtactcccgtagacggtcgtacttctcgtcggtaccctaccgtaaccgtacccgggaacaaccgccgacccctaccccgttacgaaccctacgtaccggaacgggtaccccgggaaccccgtaagggtacctacggtgggtaacgttacgggacggtaccgttacggtaacctttaacgtttaacgtcggtaaccgaagggtaccggtacgggaactacgtaacgtaacttacgtacaaccgtaaaccgtaacggtacggttaccgttacgggtaaccggtacgggaaccggtacgggtacctacgttcccggttaccgtacgggtccaacccggacccgtacccggaccccctaaccccg

SEQ ID NO: 124243 - DNA, 628 bp, Homo sapiens
  misc_feature: GYAE6OF02G3TMS.37.38.D05.1.454.CMB.1.raw
  modified_base (454)..(454): a, c, t, g, unknown or other
  misc_feature (454)..(454): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgtaattagggaaaataaatatgcttgctggtatcagcagaacgccggccacgtcccctgtcgctggtcacttctatacgaagagtaaagacggcgggacctacgacgggtactcccgtaggagcgtattaccgtcgtcggcctacccgaacgtacccgggaacaccgaccgccccaaccctcgaacccactccgaacggcccgggacccgaggtcctaagtggtaacnggacggtcgtacgtaacttaagttacgtcggtaccgtaacggtagggttaacggactacgactaacttaccgacgacaaaccgaccgtaggtaccgttaccgggaacgtcgggaaccctagggtcctacgttcggtaccgtacggtccaccgacccgtacgacccctaaccccg

SEQ ID NO: 124244 - DNA, 569 bp, Homo sapiens
  misc_feature: GYAE6OF02GB5RV.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccacgtcccctgtcgctggtcatctatcaagataagacgcggcctgacggactccctgacgcgtattcctcgtcggctaccgaaccgtccggaacacacgcccaccctcgacccatcgacggcggacccaggctagtggatgaggctcgacttattacgtgtacgagacggtagggacagcaattacgcgacaacgaacgtacggtcgttacggaacgtcggggaacccgagggtacccagttacccggttaccgtacgggttacccaacggacccctaacgggccccctaaaccccgg

SEQ ID NO: 124245 - DNA, 706 bp, Homo sapiens
  misc_feature: GYAE6OF02JTPKB.37.38.D05.1.454.CMB.1.raw
  modified_base (527)..(527): a, c, t, g, unknown or other
  misc_feature (527)..(527): n is a, c, g, or t
tcagtagtgtagatcacgaccggtgctcgatttagtatctgatagttgggtttggggtcgtgggccgtcaggaagcagcatcggaggtgcctcagccatggcatggatccctctcttcctcggcgtccttgcttactgcacaggactcgtcggcctcctatgaactgacctcagcccaccctcagtcgtccgtcggtccccgggacacgaccacgccaccgactccacctgcctcgtggacgatgaattagggaaaactaagtatgcttgcgtagtatacaggctaggacggccggaccgcgtcccctggtcgtacgtcggtacgcttaccgtacgtaacaacgtaagttaacggaacggccgggtacctaacggacgggttacacggttacgacggaacggtactacgttacgttcgtcggtacccgttaacccgtaaccgtacccggaaacgtacccgaccggaccctacccgaccgacctaccgccgtaacccgggaccgggacccgtagtacccgtgtaccgnggtaagggacctgtaccgtataaacgtttcacggtacgtacggtacggtacgtacgactaccgaactacgtcccaacgtaaccgaacggtcggttaacccggacgggtaacgtaacgggaccgttcgggtaacctccggtacgttaccggagaccgtacccgaccgtcccgtaaacccg

SEQ ID NO: 124246 - DNA, 654 bp, Homo sapiens
  misc_feature: GYAE6OF02FX7GJ.37.38.D05.1.454.CMB.1.raw
  modified_base (224)..(224): a, c, t, g, unknown or other
  misc_feature (224)..(224): n is a, c, g, or t
  modified_base (340)..(340): a, c, t, g, unknown or other
  misc_feature (340)..(340): n is a, c, g, or t
tcagtagtgtagatcacgaccggtgctcgatttagtatctgatagttgggtttggggctgggcctcaggaagcagcatcggaggtgtctcagccatggcatggatccctctcttcctcggcgtccttgcttactgcacaggatccgtggcctcctatgaactgactcagccaccctcagtgtccgtgtccccgggacagacagccaccatcacctgctctgganatgaattgggaaaataaatatgcttgctggtatcagcagaagccgggccacgtcccctgtgctggtcatctatcaagataagaagcgggcctcgagggactcccgtgagcgattcncgtcggcctaccaacgtccgggaaacaccgacgacccacccgtgaacccatccgacggaccggggaacccagggtccttagtacgggatacgggacggtactaggtaactttaacgttacgtcgtaccggaacgtacgggttacggggaccaacgtacgtaaacgtttaccgcgtaaccgtaaaccgaaccgttaagggtttacccgttaaccgggaacccggttacggggaacccgtaacggggtcctaacggttcccggtaccggttacgggttaccaccgggtacccccaacgggaccccctaaaccccgg

SEQ ID NO: 124247 - DNA, 842 bp, Homo sapiens
  misc_feature: GYAE6OF02GG0KE.37.38.D05.1.454.CMB.1.raw
  modified_base (803)..(803): a, c, t, g, unknown or other
  misc_feature (803)..(803): n is a, c, g, or t
  modified_base (814)..(814): a, c, t, g, unknown or other
  misc_feature (814)..(814): n is a, c, g, or t
  modified_base (820)..(820): a, c, t, g, unknown or other
  misc_feature (820)..(820): n is a, c, g, or t
  modified_base (826)..(826): a, c, t, g, unknown or other
  misc_feature (826)..(826): n is a, c, g, or t
  modified_base (834)..(834): a, c, t, g, unknown or other
  misc_feature (834)..(834): n is a, c, g, or t
  modified_base (839)..(839): a, c, t, g, unknown or other
  misc_feature (839)..(839): n is a, c, g, or t
tcagtagtgtagatcacgaccggtgctcgatttagtatctgatagttgggtttgggtcgagtgtccgtgtccccgggacagacagccaccatcacctgctctggagatgaattgggaaataaatatgcttgctggtatcagcagaacgcggcagtcccctgtcgctggtcatctatcaagataaaggaagcgggtcctacgagggactccctggacgcgtacttctcgtacggccttccgaaaccgtcccggggaaacaccgacgtcccaccgtcgaacctactcgaacgccgggtaccccaggtactacgtcggaagtcgaacggtctaggtaccttaattaccgttggtaccgtaaggtaaccggttacgggggtaaacacggtaactaaaacgttaccggtacgaccgaaaaccccggttaaacggtaacgggttttaacccgtaaacggggtaaaccgggttaccgggggtaaacctaacggggggttccctaaaagttttccccggaacgggttttaaccgggaccgtaacccggtaacccccggttaaaaccggggtcccccctaaaacccccggtttacggtacccgggtttaaccctaacccggtttaccccgtttaacccggtttaccccccgtacccccggtttacccttacccggttaacccttaccggtaaaccctaaccgtttacccggttacggtaaccgggtaccggtaccggtttaccgggaccggtaaaccggtcccgtagtacccgttaaggcctaagttaccgccgttaagcgtacgacgtacncgtcgacacgntacgtntacgcncgacgtanctcgntcg

SEQ ID NO: 124248 - DNA, 530 bp, Homo sapiens
  misc_feature: GYAE6OF02IWSPS.37.38.D05.1.454.CMB.1.raw
  modified_base (318)..(318): a, c, t, g, unknown or other
  misc_feature (318)..(318): n is a, c, g, or t
  modified_base (408)..(408): a, c, t, g, unknown or other
  misc_feature (408)..(408): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (510)..(516): a, c, t, g, unknown or other
  misc_feature (510)..(516): n is a, c, g, or t
  modified_base (518)..(530): a, c, t, g, unknown or other
  misc_feature (518)..(530): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcgagggatcctgagcgattctctggctccaactccgggaacacacgccaccctgaccatcacggcgggacccaggctatggatggagctgactattactgtcagacgtgggacagaccaatacngcaacacgacggttacttacggaacgtcggggaaccgacggggtcaagttccgtaccgtaggtaccacggacccgaacggacccaacccncgtcgtaccacttctccgttccccgccctctacactctaacccattaccgtggaccgcgggtacgtcgggaccaaacggggcaaccagtaacggnacgnacnnnnnnngnnnnnnnnnnnnn

SEQ ID NO: 124249 - DNA, 649 bp, Homo sapiens
  misc_feature: GYAE6OF02JFO7M.37.38.D05.1.454.CMB.1.raw
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (626)..(627): a, c, t, g, unknown or other
  misc_feature (626)..(627): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (640)..(642): a, c, t, g, unknown or other
  misc_feature (640)..(642): n is a, c, g, or t
  modified_base (644)..(649): a, c, t, g, unknown or other
  misc_feature (644)..(649): n is a, c, g, or t
tcagtagtgtagatcacgaccggtgctcgatttagtatctgatagttgggtttgggtcgagtgtccgtgtccccgggacagacagccaccatcacctgctctggagatgaattgggaaataaatatgcttgctggtatcagcagaagccgggccagtcccctgtcgctggtcatctatcaagataagaagcggctcagggatcccgtgagcgattcctcgtggccttccaaaccgtcccggggaaaccacgacggacccacccgtcgacccagtccgacggccggggaaccccaaggccctaagtggactaggcggcctaggaccttaattactggtacgacggacggtcgggaacagggacctaaaagtccgtgaaccgtaacgaacgaagggttccttaacggaaacgtcgggggaacctaggggtacctaagttccggtaccggtaacgggtaccaccgaccccggaaacgggtcccccaaaaccctcggtagtacccccgtaactttccggtacccgtttcccccaacccgtttccaacctactaccctaaccttaacgtccgttacgaccgggtcgcgttcggaccgaaggccggttacaagttaacgngacngcncncgnncncnncncngncnnncnnnnnn

SEQ ID NO: 124250 - DNA, 746 bp, Homo sapiens
  misc_feature: GYAE6OF02JCDQI.37.38.D05.1.454.CMB.1.raw
  modified_base (196)..(196): a, c, t, g, unknown or other
  misc_feature (196)..(196): n is a, c, g, or t
  modified_base (313)..(313): a, c, t, g, unknown or other
  misc_feature (313)..(313): n is a, c, g, or t
  modified_base (475)..(475): a, c, t, g, unknown or other
  misc_feature (475)..(475): n is a, c, g, or t
tcagtagtgtagatcacgaccggtgctcgatttagtatctgatagttgggtttggggctgggcctcaggaagcagcatcgggaggtgcctcagccatggcatggatccctctcttcctcggcgtccttgcttactgcacaggatccgtggcctcctatgaactgactcagccacctcagtgtccgtcgtcccggangacagccacatccactgctcgtggagatagtaagttagggaaaattaatatgtcttgcgtggtatcgagtcgaaggaacggcccgggaccacgtcccctgtcgcgtggtacatctanacaaggataaacggacggtccggcctaggaacggtacctcccgtaggacgtcgtacttccgtcgtccgtccgtaaccgaacggtacccggaactaccgacggtccccaaccgtaccgacctaacgccgtaccggggaccggtaacccgaggttaccgtacgngggtaacgtacgggacgttccgtacggtaaccttacgttaccgttagacccgtaagggtacgggttaccgggaaactacggaaacttaacccgttacggtaacccgtaccgtaaacggttaacccgttacgggttaccctttaaccgggggtaacccggtaacgggggtaacccgttaacggggttaccctaacggttttaccccggtaaccggttacggaaccccggttaacccggaacccccggtaacccggtcccccctaaaccccgg

SEQ ID NO: 124251 - DNA, 489 bp, Homo sapiens
  misc_feature: GYAE6OF02HHYEC.37.38.D05.1.454.CMB.1.raw
  modified_base (335)..(335): a, c, t, g, unknown or other
  misc_feature (335)..(335): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
  modified_base (468)..(469): a, c, t, g, unknown or other
  misc_feature (468)..(469): n is a, c, g, or t
  modified_base (471)..(489): a, c, t, g, unknown or other
  misc_feature (471)..(489): n is a, c, g, or t
tcagtagtgtagatcacgaccggtgctcgattttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacacgccaccctgaccatccaggccgggaccccaggcctagtcggatggaggctgacttattactgtacagacggtggacagcaatctgacaacaacgnggttcttacggaacgtgggaccagggtcagtcgtactaggtcacgtacccaacggcccaacccgntcgtccacttctcgtccccnccctctcatctaactctacngacgtcggctgacgacggcacatgntgnncnnnnnnnnnnnnnnnnnnn

SEQ ID NO: 124252 - DNA, 645 bp, Homo sapiens
  misc_feature: GYAE6OF02F88GQ.37.38.D05.1.454.CMB.1.raw
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(629): a, c, t, g, unknown or other
  misc_feature (625)..(629): n is a, c, g, or t
  modified_base (631)..(631): a, c, t, g, unknown or other
  misc_feature (631)..(631): n is a, c, g, or t
  modified_base (633)..(641): a, c, t, g, unknown or other
  misc_feature (633)..(641): n is a, c, g, or t
  modified_base (643)..(645): a, c, t, g, unknown or other
  misc_feature (643)..(645): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccacgtcccctgtgctggtcatctatcaagataagaagcggcctcgagggactccctgagcgattcctctggcctaccaaccgtccgggaacaacacgaccccacctcgaaccatccgaacggccgggaacccagggactagtcggataggacggtcgtagtaaccttaagtttaccgtgttccgaagggacggtaggggaccaggactaaacgtactcgacaacgaacgtacggttacttacggaacgtacgggaacgtcgggtactacgttcgtaccgtagggacctaaccggaccccgaaacggtacccccaaccccgtacgtccggtacctaccgttccgtttaccccgttccccccgtacccccttcccgttactaaccctttacccgtaaacccttaccgttaacgtacggaccgggtacccgggtcgtaacgggacgaaccggtcaacgtacgtacgctagctnancnnnnngncnnnnnnnnncnnn

SEQ ID NO: 124253 - DNA, 750 bp, Homo sapiens
  misc_feature: GYAE6OF02JYSCH.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtgtccgtcgtccccgggacagacagccaccatcacctgctcgtggagatagtaagttagggaaaattaaatatgtcttagcgttggtatcgagacgagaacggccgggaccacggtcccctggtcgcgttaggtctacgttctacgtactaaaggaacgtaaaggacggcgggtaccgtacggacgggtactcccgtaggacgtcgtattccgtacgtacgtcctaaccgaccgttaccggaaccaccgacgtacccaccgtaccgacctactaccggaaccggaccccgggtacccgaaggtccgtaaggtacgggaacgtaggacggtactacgtaaaccgttccgtttaacgtaccgggtaccgggtaacggtacgggttaaccggaacgtaacggtaccttaaaccgttaccgggactaacccggtaaacgaacccgggttcggttaccgttaaccgggtaaaccggtacggggtaacccgtaaacgggtccctaaccggttacccggttaccgtaccgggaaccaccccgggttaacccgaccccgggtaacccctaacccccgg

SEQ ID NO: 124254 - DNA, 628 bp, Homo sapiens
  misc_feature: GYAE6OF02I2MQ7.37.38.D05.1.454.CMB.1.raw
  modified_base (598)..(598): a, c, t, g, unknown or other
  misc_feature (598)..(598): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(614): a, c, t, g, unknown or other
  misc_feature (612)..(614): n is a, c, g, or t
  modified_base (616)..(616): a, c, t, g, unknown or other
  misc_feature (616)..(616): n is a, c, g, or t
  modified_base (618)..(619): a, c, t, g, unknown or other
  misc_feature (618)..(619): n is a, c, g, or t
  modified_base (621)..(624): a, c, t, g, unknown or other
  misc_feature (621)..(624): n is a, c, g, or t
  modified_base (626)..(628): a, c, t, g, unknown or other
  misc_feature (626)..(628): n is a, c, g, or t
tcagtagtgtagatcacgaccggtgctcgatttagtatctgatagttgggtttgggcagtgtccgtgtcccagggacagacagccaccatcacctgctctggagatgaattgggaaataaatatgcttgctggtatcagcagaagccgggccagtcccctgtgctggtcatctatcaagataagagcgggcctcgagggactccctgagcgtatttcctcgtggcctaccaaccgtccgggaacacgacgcccgaccctgaccactacacggccgggacccagggcctagtgggactgggacggcttaggaacttacttacgtgtcgaggacggtcgggaacgacgactaatacctgaccgtaacaaacggtacggttaccgttacgggaacgtacggggtaacctaggggtcaacggtttcggtacccgtaggtacgtacggacccgtaaccgggacccaacccccgtacgtcgtacctacctccgttccgtaccccgtccctacccttccacttacccgttacctaaccgttactaggacccgggtccggccgttacggaaccgggtaacgggcccgtaacgtacgtacgtcgctncgagtcacancncnnncncnngnnnncnnn

SEQ ID NO: 124255 - DNA, 821 bp, Homo sapiens
  misc_feature: GYAE6OF02IT7W4.37.38.D05.1.454.CMB.1.raw
  modified_base (183)..(183): a, c, t, g, unknown or other
  misc_feature (183)..(183): n is a, c, g, or t
  modified_base (242)..(242): a, c, t, g, unknown or other
  misc_feature (242)..(242): n is a, c, g, or t
tcagtagtgtagatcacgaccggtgctcgatttagtatctgatagttgggtttggggctgggcctcaggaagcagcatcggaggtgcctcagccatggcatggatcccctctcttcctcggcgtccttgcttacgtgcacaggatccggtggcctcctatcgaactgactcacgcccaccctnagttcgtccgtcggtaccccgggacagaccacgcccaccatccacctgcctcgtagganacgtagtaagttagggaaaattaatgtcgtacgttcgacgttaggttactaccgtaagacgaacggaaccggcccgggaccctaccggttccccctggtccggtccggttcggtacctacttaccgttactaactaaaggaacgtaaacgggaacgggtccgggacccgtacggaacgggtaccttacccggtaggacgtaccgttacgtttccgtccggtacggtacccttaacccggtaaccggtaaccgggtaaacccacccgtaacccgacccctacccggtacgtaacccacgtacccgaaccgggacccggggaccccgagggttaccgtacggtacgggtaccgtcggggtaacgtcgttaccgtaaccgtttacgttaccgtcggtaaccggtagggtacccgggtaacggacgtaacgaacgttaaccgttaccggacaaaccggtaaccgttaacgggtaccgggtttacggtaaccgggtacgggtaaccgggttaaccggtagggtccttaccggttccggtaccgtacggtaccgtaccccggaaccgtaccggacccctaacccg

SEQ ID NO: 124256 - DNA, 677 bp, Homo sapiens
  misc_feature: GYAE6OF02GGONF.37.38.D05.1.454.CMB.1.raw
  modified_base (226)..(226): a, c, t, g, unknown or other
  misc_feature (226)..(226): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtcgtccgtgtccccggacagacacgccaccatcacctgctctgganatagaagttaggaaataatatgacttgtcgtaggtatacgagacaaggaacggcccggcctaccgtcccctaggtcgcgttcggtactacttaccgtataccgaaagacgtaaaggaacggccgggtacctacggaacgggtaacctcccgtaggaacgccgtaattcctgtcggacctaccgaacgtaccgggaaactaccgacgacccgaccgtacgaccctaagtccgaacggacccgggaaccgacgtacgtaacgttacgggacgtacggaacgggtctaacgtttaacttaacgttacgttacggtacgaacggtacgggtaggaactacgacttaactacgacgtacaaccgtaacgtcgttacgtacggacgtaacggggacctaagggtacctacggttcgtacgtacggtaccgaaccgacccgtacggccctaaccccgg

SEQ ID NO: 124257 - DNA, 555 bp, Homo sapiens
  misc_feature: GYAE6OF02HG7SX.37.38.D05.1.454.CMB.1.raw
  modified_base (529)..(529): a, c, t, g, unknown or other
  misc_feature (529)..(529): n is a, c, g, or t
  modified_base (532)..(536): a, c, t, g, unknown or other
  misc_feature (532)..(536): n is a, c, g, or t
  modified_base (538)..(548): a, c, t, g, unknown or other
  misc_feature (538)..(548): n is a, c, g, or t
  modified_base (550)..(555): a, c, t, g, unknown or other
  misc_feature (550)..(555): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggactccctgagcgtattctctggacctccaacgtccgggaacacacgtcccaccctgacccatccgacggccgggacccaggctagtggactggaggctagactattactgtcaggacgtgggacaggactaatacgtcgacacaagtacggttcgttaccggaacgtcggggaacgtagggtaccagttcccggtacctaggtaccaacggacccgaacggaccccaaaccccgtgtaccggtccaccttccgttccctacccccactttctaacctctaaccaccttacgcggacggcgggtcacgggacaaccggcgaactagtacgngcnnnnnannnnnnnnnnncnnnnnn

SEQ ID NO: 124258 - DNA, 649 bp, Homo sapiens
  misc_feature: GYAE6OF02HP0GU.37.38.D05.1.454.CMB.1.raw
  modified_base (229)..(229): a, c, t, g, unknown or other
  misc_feature (229)..(229): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtcgtccgtcggtccccgggacagacagccaccatcacctgcctctgganatagaattagggaaaataaatatgtcttgcgttggtatcgagacaaggaacgccgggccacgtcccctgtcgcgtcggtcatctanacaagtanaaggacggccgggtacctacgacgggactcccgtagacgcgtacttcctgtcgtcctaccgacgtacccggaaaccaccgacacccgacccgtacgaccctaacgtaccggaccgggaccgggaacccgagggtacctaggtcggaagtgggacgttaccgtataacgtttacgttacgtgtccgaaggaacgggtcgggaacagtaaccgtaagttacgtacgaccaaccgtaacgtcgggttacttaccgggaacggtcgggaccgtaggtcgacgttcggtaccgttacggccgtaaccggaccctaccggacccctaacccg

SEQ ID NO: 124259 - DNA, 673 bp, Homo sapiens
  misc_feature: GYAE6OF02F9K48.37.38.D05.1.454.CMB.1.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgcccaccctnagtcgtccgtcggtccccgganacgacacgcccaaccatccacctgcctcgtaggagataggtaagttaagggaaaaattaaagtatacgtcttgacgttggtactcgagcaaggaacggcccgggaccacgtccccgtgtcggctggtcactactaatacaaagtaagtaaaggaacgggccgggtacccacggaacgggtactccgtaggacgtacgtattccgtcgtacgtaccgtaccgaaccgtacccggaaacaccgaccgacccctactacgaccctactaccgacgggacccggtaaccgacggtacgtacggagtacgtacgacggtcgtacgtaacttacgttacgtcgtacgtacggtacggtaggacaagacgtaacgtcgacgacaacgtactacggtacgtacgtaccggtcggaccgtagggtcctacggtccgtaaccggtaggtacccgaacgaccccggaaccgacccctaacccg

SEQ ID NO: 124260 - DNA, 638 bp, Homo sapiens
  misc_feature: GYAE6OF02GQARC.37.38.D05.1.454.CMB.1.raw
  modified_base (304)..(304): a, c, t, g, unknown or other
  misc_feature (304)..(304): n is a, c, g, or t
  modified_base (474)..(474): a, c, t, g, unknown or other
  misc_feature (474)..(474): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatccacctgctctggagatagtaagttagggaaaataaatatgcttgcgtggtatcagcaggaacgccggcctacgtccctgtgctggtcatctanacaagataagaacggcggcctagagggactcccgtgacgcgtattccgtcgtcggcctaccgtaaccgtcccgggaaacacgaccgaccctaacccgtcgaaccactcgaacggtcccgggaacccgaggtactagtaggacgtggacggtctacgtacttaacgttacnggtacgacggtacggtacgggacaggtactaacgttaccgacgtaccaacaacgttaacggttccgttaaccgggaacggttaccgggaaccggtacgggttacctacgttcccggttaccgtaacggtccgaacccggaacccgacccggacccctaaccccg

SEQ ID NO: 124261 - DNA, 756 bp, Homo sapiens
  misc_feature: GYAE6OF02IHLCT.37.38.D05.1.454.CMB.1.raw
  modified_base (337)..(337): a, c, t, g, unknown or other
  misc_feature (337)..(337): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccgggacacgacacgccaccactcacctgcctcgtaggacgatagaagttagggaaaataaatatgtcttacgctaggtactcgagacaacggaacggccgggcctaaccggtccccgttggtcgtcggtcggtctactcttaanacgaaagtaataaggaacggccgggacctacggaacgggacctcccgtaggaccgtcgtaacgttccgtcgtcggtacctaacccgtaaccggtacccgggaaaccaccgaccgaccccgtaacccgaccgtaaccgtacgtacccgaacgggtacccggggaaccctacgggtaccgtaaggtacggaacgttacggacggttacgtaacgtacgtttacttaacgttacggaccggtaacggtaacgggtaaccggacgtaacgtaaccgtaaacgttacgtaaccgaaaccgtaaacgtaaccggttacgggttacccgttaacgggtaaccgggtacgggtaacggtaacggtcctacgttacccggttacgaccggtaccgaccggaaccccaacccgggaccctaaaccccgg

SEQ ID NO: 124262 - DNA, 708 bp, Homo sapiens
  misc_feature: GYAE6OF02H4EOJ.37.38.D05.1.454.CMB.1.raw
  modified_base (221)..(221): a, c, t, g, unknown or other
  misc_feature (221)..(221): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtgcctcctatgaactgactcacgccacctcagtcgtccgtcggtccccgggacacgacacgccacatcactgctntggagatagaagttaggaaataaatagtgcttgcgtaggtatcagacaggaacggccggaccacgttccccgtgtcgtcgtacggtctactccgtaataacgaaagtaacgtaaacggaacggccgggtcctacggaacgggtacctcccgtggtaacgacgttacttccgtcgtacgacctaaccgtaaccgtacccgggaaacacgaacgacccgtacccgtacgacctactacgaaccgggacccggaccgaggtacgtaagtcgggacgttagggacgtacgtaacgtaacgttacgttaacgtcgtacgaacggtaccgggtaacggaactaacggtaactaacgtaccgtacgaaccgaaaccgtaacgggttacgtttaccggtaaaccgggacgggttaacggtacccgtacgggtactaccggttacccgttacggtacggtacccaaccggtaacccgacccgtaaccccgaacccg

SEQ ID NO: 124263 - DNA, 678 bp, Homo sapiens
  misc_feature: GYAE6OF02IJ9N4.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtgcctcctatgaactgactcagcccaccctcagtgtccgtgtccccgggacagacagcccaaccatcacctgctctggagatagtaagttaggaaataaatagtgcttgctggtatcgagcaaggaacgccgggccacgttccccgtgtcgtctggtcagtctatcaagataagaacggcggtacctacggaggtactccgtagacgtactacttctcgtcgcctaccgaacgtccggaacactacgcccaccgtagaccctagtccgacggaccgggacccagggtctaagtgaacgtgaacggtctacgtaacgttactaacgttcgaccgtacggtaaccggtcggggaacacgtaaccgtaacgttacgtccgaaaaccgtaacgtaaacggtacgggtttaccgtaacggggtaacccggttaacggggtaccctaacggggtacctaaccgtttcccggttacccggtaaacggttaccccgaacccgggtaacccgtaacccgggacccccccttaaaaccccgg

SEQ ID NO: 124264 - DNA, 775 bp, Homo sapiens
  misc_feature: GYAE6OF02FLCTO.37.38.D05.1.454.CMB.1.raw
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggccttcctatgaactgactcagccaccctcagtgtccgtgtccccgggacagacngccaccatccacctgctctggagatgaagttagggaaattaaatntgcttgcgtggtatcagtcaaggaagcccgggaccacggtcccctggtcgtccgtggtcgacgttctaactacaaggtataaggaacggccgggacctacggagggacttcccgtaggacgtacgtactttccgtccgtcggtaccttacccgtaaacccgtaccgggggtaaaaccacccgaccggtaccccaacccgttacgaacccgacgttaccggaacgggacccggggtaaccccggtaacggtaccgtaaggtacgggtaacggtacgggtacggttacgttaccggttaacgtttaacgtttaccgttaggtaccggtaacgggtaacgggttaacggggaaccgtaacggaaccgttaaacgttaccggtaacggtaacctaaaccgttaaccggtacgggtttaccggtaaccgggtaccgggttacgggaaccggtacgggttaacctacgggtaccggttaccggtaccgggtaccggaacccggaaccccggtaccggtaccccctaaccccgg

SEQ ID NO: 124265 - DNA, 854 bp, Homo sapiens
  misc_feature: GYAE6OF02IU5G4.37.38.D05.1.454.CMB.1.raw
  modified_base (197)..(197): a, c, t, g, unknown or other
  misc_feature (197)..(197): n is a, c, g, or t
tcagtagtgtagatcacgaccggtgctcgatttagtatctgatagttgggtttggggctgggcctcaggaagcagcatcggaggtgcctcagccatggcatggatccctctcttcctcgcgtccttgcttactgcacaggatccgtgcctcctatgaactgactcagcccacctcagtcgtccgtcgtccccggganacgacacgaccaccatccacctcgcctctggagtatacgtaagttagggaaaataattagtcgtacgttcgcttaggtaactccgtaagaccgaaggaaccggtcccgggacccgtaaccgttcccccgtggtacggccgttagggtaccctaagtttacctaacgttaccgaaaaggtaaacgtaaacggaacgggtacccggtccttaacggggacggtaccttacccgaggacgtacgtaaccgttctaaccggtgtaacccgttacccaaaccgggtaccggtaaaccaccgtacccgaccctaaccccggtagtaaaccccgacgtaccgaaccgggttaccccggggaccccggtacggtaaccgttaacggttaccgggtaagtaccggtaacgggtaccgttacggttaacccgtttaagtttaccgtaaccggtaccggtaaaccggtaccggggttaaacggtaccgtaacggtaacctaacgtttaaccgacgaaccgtaacggtaaccgttaccgggttaccgttaacgggttaaccggtacccgggtaaccgggtacggttaaccgttaccggttacccgggttaccggtttaccggacccgtaccccgggtaaacccctaccgggtaccccctaaaaccccgg

SEQ ID NO: 124266 - DNA, 794 bp, Homo sapiens
  misc_feature: GYAE6OF02JT70H.37.38.D05.1.454.CMB.1.raw
  modified_base (482)..(482): a, c, t, g, unknown or other
  misc_feature (482)..(482): n is a, c, g, or t
tcagtagtgtagatcacgaccggtgctcgatttagtatctgatagttgggtttggggctgggcctcaggaagcagcatcggaggtgcctcagccatggcatggatccctctcttcctcggtgtcctgcttactgcacaggactccgtggcctcctatgaactcgactcacgccacccctcacgtcggtcccgtcggtacccccgggacaggaacctcgacccaacctatacccgaccctcggaccttccgttagggaacgtagtacgggttaaaagttttaaggggaaaaaattaaaacgttactacggttaccgttaggtccggttaggttacgttaccgaacggacggaacggtaaccgggtccccggggtacctacccgggtccccgttgggtaggtcgttcggtacaacttcgtactaacgaaggtaacaaacggtacgggtaccggaccttacggaggtccctacgtaggtaaccgngttaacgttctacggtcggtacctacccggtaaaccgtccgggaaacctaccaccggaccccctaaccgtaccgactaccggtaccgtaccggacccgggtacccgacgtacgtaacgtcgaacgtcggaaggtctacgtacttacttaccgtagtccggtaaggtaaccgggtaggtaaccgacgtaaccgacttacgaacgactaaccgaacgtacgggtacttagggacccggtacggtacggtaccgtaacggttcgtaccggttacggtaccgacgtacccggaacgtacccgaaccgtaaccccgg

SEQ ID NO: 124267 - DNA, 674 bp, Homo sapiens
  misc_feature: GYAE6OF02JUH43.37.38.D05.1.454.CMB.1.raw
  modified_base (378)..(378): a, c, t, g, unknown or other
  misc_feature (378)..(378): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
  modified_base (649)..(654): a, c, t, g, unknown or other
  misc_feature (649)..(654): n is a, c, g, or t
  modified_base (656)..(660): a, c, t, g, unknown or other
  misc_feature (656)..(660): n is a, c, g, or t
  modified_base (662)..(665): a, c, t, g, unknown or other
  misc_feature (662)..(665): n is a, c, g, or t
  modified_base (667)..(667): a, c, t, g, unknown or other
  misc_feature (667)..(667): n is a, c, g, or t
  modified_base (669)..(674): a, c, t, g, unknown or other
  misc_feature (669)..(674): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgtcttgctaggtatcagcgagaagccgggccagtcccctgtgcgtggtcatcctatacaagtaataaaggaacggccgggacctcgaacggggacttccccgtggacggccgtacttcgttccgtcggacctacccaaaccggtacccgggaaaccaccgacggtacccaaccccgttcaacccacgtaccgaccggacccgggggaacccaggtccgtaagtcggagtggacggtcctgtaacctagttaccngtacggacgtacgggtaccgaccggagaacctaattacgccgaacctaacgtaacggtacggtttaccgtaaccggtaccggttacggggaacctaacgggtcctacgtttacccggttacggtacggacctacccgaaaccccgaaccggacccccaaaccccgtcgtaccgtaccctaccgttccgttaccccgttaccccacccccttcgtacctacttacccgtactcctacgacgtcgccggtactcggactcgcagtacncgncnnnnnncnnnnncnnnncncnnnnnn

SEQ ID NO: 124268 - DNA, 891 bp, Homo sapiens
  misc_feature: GYAE6OF02IRFUA.37.38.D05.1.454.CMB.1.raw
  modified_base (596)..(596): a, c, t, g, unknown or other
  misc_feature (596)..(596): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggactccggtggcctcctatgaactgactcacgcccacctcagtcgtccggtcgtccccgggacacgacgacgcccaccactccaccctgtcctcgtaggacgagttagtaaagttaagggaaaacttaaaagtatcggttacgtttggttacggttaatacgaacgtacggaacggtaaccgggccccggggtaccctaccggttacccccgttgggttcggtacggttcggttacctacgttaccttaataccgtaaaaggtaacgtaaaacgggaacgggtacccgggtaccgttaaccggaacgggggtaacccttccggtacggtaacggtaccgttaacgtttaccttcgtaccgtaaccgtacccgaaaaccgtacccgggaaaccaccgaccgaacccccgtacccgtacgaaccctacgtaccggaaccgggtacccgggaacccggngtaacgtacggttaagggacggtacgggtacgtaccggttacgttaacctttagtttacccgtaggtaaccggtaccgggtaccggggtacgggaaccgaaacgggtaaccttaacttaccggacgtaaaccgtaaaccggaaacgtttacgggttaacccggttacgggaaccgggtttaccggggtaaccggtaaccgggtttccttaacccggtcccgggtttaaccgttaacggggaacccggtaaccccggaacccgggtaacccggtaaaccccctaccccgttaccgg

SEQ ID NO: 124269 - DNA, 550 bp, Homo sapiens
  misc_feature: GYAE6OF02GG267.37.38.D05.1.454.CMB.1.raw
  modified_base (406)..(406): a, c, t, g, unknown or other
  misc_feature (406)..(406): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatccacctgctctggagatgaattgggaaaataatatgcttgctggtatcagcagaagccgggccacgtcccctgtgctggtcatctatcaagataagaagcgggcctacgagggactccctgacgcgtattctctggcctaccgaactccgggaacacgacgacccaccctgaccatcacgcgggacccaggctagnggatgagctgacttatactgtacaggtacggtggaacagacctaagtactgaccaacgaacgacggttccttacgggaacgtcgggaaccgaggggtcacgttcgtacccgtaggtccaccggacccacggacccctaaccccg

SEQ ID NO: 124270 - DNA, 680 bp, Homo sapiens
  misc_feature: GYAE6OF02F3JMV.37.38.D05.1.454.CMB.1.raw
tcagtagtgtagatcacgaccggtgctcgatttagtatctgatagttgggtttggggctgggcctcaggaagcagcatcggaggtgtctcagccatggcatggatccctctcttcctcggcgtccttgcttactgcacaggatccgtggcctcctatgaactgactcagccaccctcagtcgtccgtgtccccgggacagaccagccaccatcacctgctctggagactgaattacgggaaaataaatagtagcttgctggtatcagcagaacgccggccacgtcccctgtcgtcgtggtcagtctatcaagagtaagacgccggcctacgacgggtactacccgtagacgcgtaacttccgtacgtcggtacctaccgtaaccgtacccgggaaacaccgtacgaccccgaacccgtacgaacccaagtaccgaacgggacccgggaacccgtacggtaccttaacggtacggtaacgtacggacggtacgtacgtaaccttaacgttacgtcggtacgaggtaccggtacggacgtacgtaactaagtaccgtacgaaccgtaaccgtaactacggtttacgtaccggtaacggtaccgggtaaccggtacgggttacctacggttacccgtacggtacggtaccgaaccggacccgaacccggtccccgtaaccccg

SEQ ID NO: 124271 - DNA, 686 bp, Homo sapiens
  misc_feature: GYAE6OF02IELC0.37.38.D05.1.454.CMB.1.raw
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (464)..(464): a, c, t, g, unknown or other
  misc_feature (464)..(464): n is a, c, g, or t
  modified_base (557)..(557): a, c, t, g, unknown or other
  misc_feature (557)..(557): n is a, c, g, or t
tcagtagtgtagatcacgaccggtgctcgatttagtatctgataggttgggtttggggctgggcctcaggaagcagcatcggaggtgcctcagccatggcatggatccctctcttcctcggcgtccttgcttactgcacaggatccggtggcctctatgaactgactcganccctacctcagtcgtccgtcggtccccgganagacngaccactactcgacctgcctcgtggaagagttagaagtttacgggaaaaataatacttagtccttggtacgttaggtactcgaacggacaaggaaccggcccgggtacctaaccggttcccctggttacgccgttacgggtaccttacgtacctattaacgaacgtaagtaaacgaacgggcggtaccgtacggaacggtctaccgtagcgtacgtattacgtctacggtaccaacccgtaacgtacccgggaaacnccacgacccgtacccgactacgacgtaccgaacgggccggaaacccgagggtactaggtacggcgtagcggtaactacgtattaacgttacgngtaaccgagttcgggacgtacaacgtactagtaccgtacacgtaacgtagtaagttcgtacggtaagcggtaccggaacgtctacgtaccgtcggtacgtccacggaaccgtaccggtacccctaaccg

SEQ ID NO: 124272 - DNA, 555 bp, Homo sapiens
  misc_feature: GYAE6OF02FPXCH.37.38.D05.1.454.CMB.1.raw
  modified_base (281)..(281): a, c, t, g, unknown or other
  misc_feature (281)..(281): n is a, c, g, or t
tcagtagtgtagatcacgaccggtgctcgatttagtatctgatagttgggtttgggctgggcctcaggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatccacctgctctggagatgaattgggaaataatatgcttgctggtatcagcagaagccggaccagtcccctgngctggtcatctatcaagataagaagcggcctacgaggactcccgtgagcgtattcctctggcctaccaaccgtccgggaactacgacgcccaacccgtgacccatccgaggaccgggacccaggcctagtcggatcggaggctagactagttactcgtacagtaccggtggactacggactaacgtcgtgaccacgaactaggtcgtacgaacgttcgggaccgtacggtctacgtccgttccgtagtccgacgtcccgaacgccctaaccccg

SEQ ID NO: 124273 - DNA, 777 bp, Homo sapiens
  misc_feature: GYAE6OF02HZA9X.37.38.D05.1.454.CMB.1.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
tcagtagtgtagatcacgaccggtgctcgatttagtatctgatagttgggtttggggctgggcctcaggaagcagcatcggaggtgcctcagccatggcatggatcccctctcttcctcggcgtccttgcttactgcacaggatccgtggcctcctatgaactgactcacgccaccctnagtcgtccgtggtccccggganacgacacgccaccatcacctgctcgtaggatagtgaagttacgggaaaattaaatagtcgtacttgcgttaggtatacgaacggacgtaaggaaccggcccgggtacctaccgttcccccgtggtacgtcgttacgggtactaacgttctaacgtagaaacgtaagtaacggaaccggcgggtacctacggaacgggtactcccgtaggtacgtacgtacgtttcctacggtcggtacccgtaaccgtaaaccggacccgggaaacctaccgaaacccggtcccctaaccccggtacgaaccccgtacgtaccggaccggggtaccccgggaaccggtaggttaccaaggtacggacggttacgaacgttaccgtataaaccgtttacgttaacgcggtacgtaaacggtacgggttacgacgtaacgtaacgtaacgttaccgtacgaacctaacgaaccggttacgttccggtaaccggtaacgggtcggttacccggaggttaccctacggttccccggttcgttaaaccggtacccgtaacccggtacccctaccggtaaaccctaccccgg

SEQ ID NO: 124274 - DNA, 714 bp, Homo sapiens
  misc_feature: GYAE6OF02IHHGB.37.38.D05.1.454.CMB.1.raw
  modified_base (90)..(90): a, c, t, g, unknown or other
  misc_feature (90)..(90): n is a, c, g, or t
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (445)..(445): a, c, t, g, unknown or other
  misc_feature (445)..(445): n is a, c, g, or t
  modified_base (487)..(487): a, c, t, g, unknown or other
  misc_feature (487)..(487): n is a, c, g, or t
  modified_base (671)..(671): a, c, t, g, unknown or other
  misc_feature (671)..(671): n is a, c, g, or t
tcagtagtgtagatcacgaccggtgctcgatttagtatctgatagttgggtttggggctgggcctcaggaagcagcatcggaggtgcctnagccatggcatggatccctctcttcctcggcgtccttgcttactgcacaggatccggtggcctcctagtgaactgactcgacgccaccctcgtagtcgtccgtcggtccccggacacgactacgccaccgtatccactnccgtgtagganatagaagttagggaaataaactgtagtctagtntcggtatcgacgtcaaggaacgccggacctacgtcccgtaggtcgacgttggttactacgttacgtactacaagtaacgaaacggtaacggccgggttacccgtaggacgggtacctacccgtaggacgtcgtatttcggactcgggtacctacccgtagaaccggaacacncgtacccgtaccacgaccacgtacggacgccccgggtaaccncggacgtaagtcggtagtacggacgttacgtcgtaacgttgttaaccctggtacgacggtacgtagggacgtaccgaagtaaccgttacgtacgaacgtaaccgaggttaccggtaccggttaaaccggaccgggtcgggtaacccgaggttaccgaccgttttaccggccgtttaaaccgggngaacccccgggtaccgtaaccccggtaacccctaaaccccggg

SEQ ID NO: 124275 - DNA, 709 bp, Homo sapiens
  misc_feature: GYAE6OF02HTJGY.37.38.D05.1.454.CMB.1.raw
  modified_base (181)..(181): a, c, t, g, unknown or other
  misc_feature (181)..(181): n is a, c, g, or t
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
  modified_base (520)..(520): a, c, t, g, unknown or other
  misc_feature (520)..(520): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatcgaacctgactcacgcccaccctnagtcgtccgtcggtccccggganacggacacgcccaacagtccaccgtgcctcgtagganactagaaagtttaggaaaacttaaagttagtcgtcttcgacgttggtaactcgagacgaacggaacggtccccgggaccgtaccgttccccgtgtcgtacgtcggtacctagtaccttacaacgaagtaacgtaaacggacggtccgggtacctacggtacggtaccttccgtaggacggtcttacttcncgtacgtcctacccgacggtacccggaacaccnccgacccctacgtacacctacacggacgacccggacgaggtactagtcgagtacgnggtactacgatttacgtcgtacgtacggaggtacgggaggacaacgaacgtactacggtacgaacctaacgacgtacggttaccggtacggtaaccgggtccgggaccgtacggggttacctacccgggttacgttacccgggtacgttaccggaacccgggtaacccaccggtaaccccctaaccccg

SEQ ID NO: 124276 - DNA, 903 bp, Homo sapiens
  misc_feature: GYAE6OF02HMI32.37.38.D05.1.454.CMB.1.raw
  modified_base (239)..(239): a, c, t, g, unknown or other
  misc_feature (239)..(239): n is a, c, g, or t
tcagtagtgtagatcacgaccggtgctcgatttagtatctgatagttgggtttggggctgggcctcaggaagcagcatcgaggtgcctcagccatggcatggatccctctcttcctcggcgtccttgcttactgcacaggatccgtggcctcctatgaactgactcacgccaccctcagtcggtccgtcggtccccgggacagaccacggcccaccactcaccttggcctcgttggganatagtaagtttaggggaaaattaaagtagtacggctttacggtccgttagggttaattccgaacggtactaaacgggaaacgggcccccgggggacccaaccgggttcccccccttgggttcggaccgtttacggggtcctaacgttactaacgtttaccgaaaggtaacgttaaaacgggaaacgggcccggggtacccgtaccggacggggacctttacccccgaggtacggacgtaactttccgttactcggtcctaccgaaccgttccggggaaactacgccgaccctacccgtaccgaaccctacgtaccgaccgggtaacccgggacccgtaggtaccgtaacggttcggggacgtacggtacggggtccttacggtaaccgtttaacgtttacgggttaccggtaacggttacgggaaccgggggttaccgggtaaaccggaccggtaaccttaaaacgtttacccggggttaacgttccccgaaacggttaaacccggttgggggtttaacccgtttaacggggttaaccccgtaagggggtacccggttaaaccggtcccggttaaaccgttaccccgggtttacccgtttaaaccggggccccgttaaaacccgggacccccggtaaacccggggtcccccgttaaacccccgg

SEQ ID NO: 124277 - DNA, 778 bp, Homo sapiens
  misc_feature: GYAE6OF02GSTMG.37.38.D05.1.454.CMB.1.raw
  modified_base (341)..(341): a, c, t, g, unknown or other
  misc_feature (341)..(341): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccaccctcagtcgtccgtcgtccccgggacagacagcccaccactccacctgcctcgtcgggagatagtaagttagggaaaattaaatatgtacttgcgttaggtatccgagacgaacggaacggcccgggaccgtaccgttccccgtggtcgtcgtggtactattcttanaccaaagaagtaaacggacggtccggtccgtacggaggtacctccgagtacggtacgttattcgtccgtcgacctacccgtaaaccggtaccgggaaaccaccgacccgaccctacccgtacggaaccctacgtaccggacgggaccccgggaacccgagggtacctagggtacggtagtacggtacgggaccttacgttacgtttagttcctagggtaccacgggttacgggtaccgggaactaaccgggtaataaacttccggtaacgacccggtaaaaacgtaccggttaacgggttacccgggttaaccggtaaacgggttaacccggggaaccggttacgggtaccctttaaccggggtttacccgtaaccggggttaacggaaccccggacccggtaacccccgggaacccggtaaccccctaaccccggg

SEQ ID NO: 124278 - DNA, 728 bp, Homo sapiens
  misc_feature: GYAE6OF02I7TC4.37.38.D05.1.454.CMB.1.raw
  modified_base (178)..(178): a, c, t, g, unknown or other
  misc_feature (178)..(178): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgtacaggatccggtggcctcctatgaactgactcagccaccctnagtcgtccgtggtccccggacagacacgccaccataccacctcgctcgtaggagatgtaagttagggaaaataaatagtagtcttagcttaggtactcaagtacaaggaacggcccggccgacgtcccctggtcgacgttcggtctaagttcctaatacgaaagtaagtaaacggacggtcggggccccttaggaacggggtacctaccccgtagaacggtccgtaagtttcctaccgtcgggtaccctacccggaaacccgttaccggggaaccaccgaccgtaccccacccgtgaaccacgtacgaacggtccgggaacccctaggtactaggagtacgtacgggacgtaccgttagtaacgttacgttacgtcggtacgaacggtacgggtaggaacctagaaccgaagtttaaccgcgaaccaaacgtaaccggttaacggtcgtttaacccgggaacgttcgggacccggtaaggttaccctaacggttccggaccgttacggtcccgaaccgaaccccgtaacggacccccgaaccttacccgg

SEQ ID NO: 124279 - DNA, 683 bp, Homo sapiens
  misc_feature: GYAE6OF02I7GRJ.37.38.D05.1.454.CMB.1.raw
  modified_base (246)..(246): a, c, t, g, unknown or other
  misc_feature (246)..(246): n is a, c, g, or t
  modified_base (456)..(456): a, c, t, g, unknown or other
  misc_feature (456)..(456): n is a, c, g, or t
  modified_base (568)..(568): a, c, t, g, unknown or other
  misc_feature (568)..(568): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcagccacctcagtcgtccgtcgtccccggacagacacgccacatcacctgctctggagatgtaagttagggaaattaatntgtcttgacgtggtatcgagtcgaacggacggcccgggacctaccggttccccgttaggttcggaccgttgggtacctagttaccgttaactaacgtaaaggtaaacttaaacgggaacggtccgggtacctacggacgggtacctcccgtagacgtcgtattcgtcgtacgctaccgacgtaccggacacgtaccacccgtacccgtanaccgtactcggaaccgggtcccgggaccaggtcctagttcggacgtcggacggtcttagtacttagttaccgtacgacgtacggtacgtaccggacgtacgactaacgtacncggactaaccgacgttaccggtacgtacgggtaacggtcgggtaaccgtagggtaccctaggttcccgttaacgaccggtacccgaccggtacccgtacccgacccctaacccgg

SEQ ID NO: 124280 - DNA, 741 bp, Homo sapiens
  misc_feature: GYAE6OF02HYRFU.37.38.D05.1.454.CMB.1.raw
  modified_base (202)..(202): a, c, t, g, unknown or other
  misc_feature (202)..(202): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttagcttactgcacaggatccgtgcctcctatgaactgactcagcccaccctcagtcgtccgtgtccccggaagacncgccactatcgacctgtctacgtggagtagtagtaagttacgggaaaataaattagtggtaccttgcttaaggtacacgaacgacgaaggaacggcccgggtacctacggttcccccgtgtacgtcgttggtacttactcctaagttacaaagtaataaggaacggcggacctagacgggtaccttccgagacgtctaagttcgtacgtcgggcttaacccgaacggtacccgggaaaccacgaccggacccttacccgagtaacccacgtaacccgaacgggtccccgggaaacccacgggtaccgtaaagttcggggaacgttagggaacggacgtttacgttaaacgttaacgtttcgtacggaccgacgggtaacggttacggacgaacggtactaaaccttcgacggaactaaaccggtaacgtacggttaccgttaacgggaaccggtaacgggaacccggtagtaaccgtaccgttaccggtaccggtaccggtacgtaacccggaacccgtacggaaccccctaaacccgg

SEQ ID NO: 124281 - DNA, 204 bp, Homo sapiens
  misc_feature: GYAE6OF02F4Z48.37.38.D05.1.454.CMB.1.raw
  modified_base (138)..(138): a, c, t, g, unknown or other
  misc_feature (138)..(138): n is a, c, g, or t
  modified_base (173)..(204): a, c, t, g, unknown or other
  misc_feature (173)..(204): n is a, c, g, or t
tcagtagtgtagatcacgaccggtgctcgatttagtatctgatagttggggtttggggggtttggtggtctccactcccgccttgacggggctgccatcctgccttccaaccccatgtcactctgttcccacctcctnatctacactactgagcggctggcaaggcgcatagnnnnnnnnnnnnnnnnnnnnnnnnnnnnnnnn

SEQ ID NO: 124282 - DNA, 749 bp, Homo sapiens
  misc_feature: GYAE6OF02HOJEU.37.38.D05.1.454.CMB.1.raw
  modified_base (92)..(92): a, c, t, g, unknown or other
  misc_feature (92)..(92): n is a, c, g, or t
  modified_base (177)..(177): a, c, t, g, unknown or other
  misc_feature (177)..(177): n is a, c, g, or t
  modified_base (367)..(367): a, c, t, g, unknown or other
  misc_feature (367)..(367): n is a, c, g, or t
  modified_base (735)..(735): a, c, t, g, unknown or other
  misc_feature (735)..(735): n is a, c, g, or t
tcagtagtgtagatcacgaccggtgctcgatttagtatctgatagttgggtttggggctgggcctcaggaagcagcatcggaggtgcctcanccatggcatggatccctctcttcctcggcgtccttgcttactgcacaggatccgtgcctctatgaactgactcacgccacccctnacggtcgtccgtcggtcccccgggacacgacacggacccaccgactccaccgtcgcctcgtggagtaagtacgtaaggttaggaaaattaaacgtgttgtccttacggtacgttacgggtaacttcggaagacgaacggaaccggtccgggaccctacggtccccgtgtcggtcggtggtaccactctanaacgtaagaacgtaacggacggtcgggacctacggaacggtacctaccggtgacgtacgttactccgtccgcgtccttaaccgaaccggtaccggaaaccacgtacccgaccctaccgtacgactacgtaccggaccggtacccggaccggacgtacgtaggtacgacgtacggacggtctacggtacttaacttacgtctaccggtaaggtaacggggttacgaacgacgaacgtaactttacgaccgtaacaacgggtaacctacgggtttacccgaacgggtttaccggggaaccgggttaaccgggtacggttaaccgttacggttacccgtacgtaccgggaccgaccggtaccccggtaacncccccgtaacccgg

SEQ ID NO: 124283 - DNA, 661 bp, Homo sapiens
  misc_feature: GYAE6OF02FK60A.37.38.D05.1.454.CMB.1.raw
  modified_base (234)..(234): a, c, t, g, unknown or other
  misc_feature (234)..(234): n is a, c, g, or t
  modified_base (575)..(575): a, c, t, g, unknown or other
  misc_feature (575)..(575): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggccctcctatgaactgactcacgcccaccctcagtcgtccgtcggtcccccgggacagacacgcccaccatcacctcgctctgganatgtaattagggaaaataatatgcttgctggtatcagacaaggaacggcccgggcctaccgttccccctggtagtccgtggtctacttctaactacgaaagtaataaaggaacggccggggtaccctacggacgggaaccgttcccgtaggacgtccgtacttcctaccgtcggtaccctacccaaaccggtcccgggaaaccaccgtaccgcccctaacccgtacgaccctacgtccgaacgggtcccgggacccgagtaccgttaggtcggacgtaggacggttctaggttaaccttacgttactcgtacgacgggtacgtagggaccagacactacgnaaccactagtcgtacgtacggacgtacggaccgtagggtctcgtccgtaccgtaggtccgaccgacccgtaccgacccctacccgg

SEQ ID NO: 124284 - DNA, 642 bp, Homo sapiens
  misc_feature: GYAE6OF02GGWCP.37.38.D05.1.454.CMB.1.raw
  modified_base (254)..(254): a, c, t, g, unknown or other
  misc_feature (254)..(254): n is a, c, g, or t
  modified_base (580)..(580): a, c, t, g, unknown or other
  misc_feature (580)..(580): n is a, c, g, or t
  modified_base (596)..(596): a, c, t, g, unknown or other
  misc_feature (596)..(596): n is a, c, g, or t
tcagtagtgtagatcacgaccggtgctcgatttagtatctgatagttgggtttgggcagtgtccgtgtccccgggacagacagcccaccatcacctgctctggagatgaattagggaaataaatatgcttgctggtatcagcagaacgccgggccacgtcccctgtgctggtcatctatcaagataagacgcggcctcgaggtctccctggacgcgtactttctcgtggcctaacccgaaccgtccggaacacnccgacccacctcgaccatacgacggtccgggacctaggctagtggagtcggacggtctagtacttagtccgtagtcgacggtacggtaggaacacgtaacacttacgcgacaacgtacgtcggttaccgtacggaacgtccggagtacggtacctagttccgacgtacggtaccaaccgcccgaaccgacccctaaccctgtccgtactacccgtccgttccccgtaccccctaccgtccttacacctttaccgaccttaaccgacgtcgggacccggtcgacgtcggaacccggagtacccgaagtacggtgacctacgtagacncgtacgcgtacgtacncgtacgcgagacgcgtacgagacgacgacgtcgacgtacgacaccg

SEQ ID NO: 124285 - DNA, 733 bp, Homo sapiens
  misc_feature: GYAE6OF02JL9J8.37.38.D05.1.454.CMB.1.raw
  modified_base (117)..(117): a, c, t, g, unknown or other
  misc_feature (117)..(117): n is a, c, g, or t
  modified_base (204)..(204): a, c, t, g, unknown or other
  misc_feature (204)..(204): n is a, c, g, or t
tcagtagtgtagatcacgaccggtgctcgatttagtatctgatagttgggtttggggctgggcctcaggaagcagcatcggaggtgcctcagccatggcatggatccctctcttccncggcgtccttgcttactgccacaggatccggtaggcctcctaatcgaactgactcacgcccacctcgagtcgtccgtcgtcccgganacgacacgccacactccacctgcctcgaggatactagtaaagttacgggtaaaataagttacgtacgcgtagacgtacgtatacgagtaccgaaggtaaccggccggacctaccggttaccccgtggtacgacgttcggtactacgttaactaagtaacgtaagaaacgtaaagaccggtaaccgggtacctaggaacggtaccgtaccgtaaggtacgacgtacgttacgtacgtacggtaccctaaccggtaacggtaacccgtaaaccgacgtaacccgtacccgtaaccgacgtaaccgtaacgtaccgaacgggaccccggtaacgaaggtaccctaaggtaccggaagtacggaacggtactaaccgtaacgttacttaacgacgtacgaacggtacggagtaacacgtaactaagtaccagtaacgaacgtaacggtactaccggtagacggtaccggtaaggacgtacgaacgttaccgtaacgaccggtaacacccggacccgtaaccgaccctaaaccg

SEQ ID NO: 124286 - DNA, 696 bp, Homo sapiens
  misc_feature: GYAE6OF02GHGL6.37.38.D05.1.454.CMB.1.raw
  modified_base (111)..(111): a, c, t, g, unknown or other
  misc_feature (111)..(111): n is a, c, g, or t
  modified_base (118)..(118): a, c, t, g, unknown or other
  misc_feature (118)..(118): n is a, c, g, or t
  modified_base (135)..(135): a, c, t, g, unknown or other
  misc_feature (135)..(135): n is a, c, g, or t
  modified_base (204)..(204): a, c, t, g, unknown or other
  misc_feature (204)..(204): n is a, c, g, or t
  modified_base (353)..(353): a, c, t, g, unknown or other
  misc_feature (353)..(353): n is a, c, g, or t
  modified_base (512)..(512): a, c, t, g, unknown or other
  misc_feature (512)..(512): n is a, c, g, or t
tcagtagtgtagatcacgaccggtgctcgatttagtatctgatagttggggtttggggctgggcctcaggaagcagcatcggaggtgcctcagccatggcatggatccctntcttccncggcgtccttgcttacngcacaggactccggtgcctctagtcgaactgactcacgcccacctgaggtcgtccggtcgtacccgganagaccacgcctacactccacctcgacttacgtacggaatacgtaggtaacgttaaggaaaaattaaagttcgtgtcttacggtacgttgggtaactacgagacgaaggtaccggcccgggtacctaccgtcccgttggtcgtacggttntactactacgtaactaccgtaaagtaacaaggacggtccggtacctaggtaacggtccgtaccgtagactccgttatcgttacgtacggacctaccgaaccgtacggaacctacgaccgtaccaccgtacgaccgacgtaacgccggtaccggaaccgngtacgtacgacgtacgaggcgtacgtacgttactacttacgtcgtaaggaccggtcgaacggtagaacgtactaacgtagcctaaagtaccctagggtccttaccgggacggtaacggtacgggaccgttaagtccttacgtccgtacgtccgtaccgaccgtaccgacccgtacccgtaaccg

SEQ ID NO: 124287 - DNA, 699 bp, Homo sapiens
  misc_feature: GYAE6OF02FKDUZ.37.38.D05.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatcgaactgactcacgccaccctcagtgtccgtgtccccgggacacgacagccacatcacctgctctgganatgaattaggaaataaatangcttgctgtatnagnagacgccggcacgtccctgtcgcgtggtctatctatcaagtanaagaggcggctacggaggtactccgtgacgtcgtattactcgtggcctaccgtaacgtacccggaacacgtaccacccgacccgttgaacctgtaccgaacgggaccccggaaccgacgggtacgtaacgtcggtaacgtggtaccggtacgttacggttaacttaaggttttaccgttcggttaaccggtaagggtaaccgggttacggtaacccgtaagggtaacccttaaacgttaccgtaacgtaccctaaaacggtaaccgtaaccgggtttaccgttaacgggaaccggttaacggggtacccggtaaaggggttacctaccggttacccggttaccggtaacggtttcccgaaacccgggtaccccgaccggtaacccccgtaacccg

SEQ ID NO: 124288 - DNA, 823 bp, Homo sapiens
  misc_feature: GYAE6OF02II2UW.37.38.D05.1.454.CMB.1.raw
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacaggatccgtggcctcctatgaactgactcacgccacctcagtcgtccgtcgtccccggacagacacgcccaccactcacctgctcgtggaagatagtaagttagggaaaattaatagtcgtcgtttcggcgttgggttaactccgagaccgaaggaaaccggccccgggaccctaaccggttcccccgttagggtcccggtacggttacgggttaccctaactttaccgtagtaacaaaacggtaaactaaacgggaaacggtcccggggtacccgttaacggaacggggtaccttacccgggtacgaaccggtacgtttaccctttaccgtttccgtccggggttaccctaaaccccggtaaaccggtaccccgggtaaaccacccggacccgacccccgtaaccccgttaccgaacccctaacggtaccgtacccgggggaaccccgggtaacccgacgggtaaccgttaacggtacggacggttaagggccggttacctacggttaccttaacgttcgttacgtaacgacgggttcggaaggcctaagacgtaacttacgacgaacctacaacgttaccgttcggtaaccggaggtaaccggaccggttaccggtagttacccgttacggaacccgtttgggaccccaccgggaacccgtaccccggaacccctaaccccgg

SEQ ID NO: 124289 - DNA, 841 bp, Homo sapiens
  misc_feature: GYAE6OF02FR9J6.37.38.D05.1.454.CMB.1.raw
  modified_base (224)..(224): a, c, t, g, unknown or other
  misc_feature (224)..(224): n is a, c, g, or t
tcagtagtgtagatcacgaccggtgctcgatttagtatctgatagttgggttggggctgggcctcaggaagcagcagtcggaggtgcctcagccatggcagtggactccctctccttcctcggccgttccttgccttactgcacgaggtactccggtggccctacctatacgaacctgactacgacgcccaccctctagtcgtccggtccggtaccccgggaanagaccacgacccacctacgtaccacctcgcctacgtagggaataagtaacgtaaagttaaagggtaaaataaaagttacgtacgtcgttgtacgttacggtactacgaacgacgaacgggaaccgggcccgggtacctacccggttacccgtaggtcggtaccgttacggtacctaagttacctaataacgtaaggtaaacgtaagggaccggtacgggaccgtacggaacggtccgaccggtaggtaacgtcgttactacgtccggtacgtaccctaaccgtaaccggaaccggtaacctacccggacgtacccccgacgtaacgacccgtacgaacggacccggggacccggtaacggtaaccgtactaacgggacgtaacggtaggaaccggttactaccgtaacttagttacccggcgttacggtaacgggttcggaacggtaacctacgtaagtaaccgtaccggtaacaacgttaaaccggacggttagttacccgggtaacggtacggtacccgggttaaccggtacggtaaccgtaccggttttaacccggttaacggtaccggtaaaccgaccccgtaaacccgggtaacccccttacccgaacccgg

SEQ ID NO: 124290 - DNA, 627 bp, Homo sapiens
  misc_feature: GYAE6OF02FZ98Q.37.38.D05.1.454.CMB.1.raw
  modified_base (464)..(464): a, c, t, g, unknown or other
  misc_feature (464)..(464): n is a, c, g, or t
  modified_base (568)..(568): a, c, t, g, unknown or other
  misc_feature (568)..(568): n is a, c, g, or t
  modified_base (585)..(585): a, c, t, g, unknown or other
  misc_feature (585)..(585): n is a, c, g, or t
  modified_base (625)..(626): a, c, t, g, unknown or other
  misc_feature (625)..(626): n is a, c, g, or t
tcagtagtgtagatcacgaccggtgctcgatttagtatctgatagttgggtttgggcagtgtccgtgtccccgggacagacagccaccatcacctgctctggagatgaattggaaataaatatgcttgctggtatcagcagagccgggccagtccctgtcgcgtggtcatctatcaagataagagcgggcctcagggtactcctgacgtcgatttctctggacctccgaacctccgggaaacacgacgacccaccgtcgacctacgtacgacggtcgggacccagggcttaagtggacttaggaggtccttagtacttaacgtttacgtcggtacgtacggtaaccggtcggggaacaggactaaacgtacgtagacaaccgttaagaccggttacgttacggaaacgtcgggaactacgggtcaacgttcgtacgtagtccgacacccgaaagcccctaaccncgtcgtacactcgtaccgttaccctcctaccgtctaaccgtcctaacctaacgttcgtggaaccggccggtcgtaccgggactaacgggtaccacgtacgtagngtacgtacgcacagcgntacgacgtcgcacacacgtacactacacgtgtacactacnnc

SEQ ID NO: 124291 - DNA, 818 bp, Homo sapiens
  misc_feature: GYAE6OF02ILNT4.37.38.D05.1.454.CMB.1.raw
  modified_base (183)..(183): a, c, t, g, unknown or other
  misc_feature (183)..(183): n is a, c, g, or t
  modified_base (267)..(267): a, c, t, g, unknown or other
  misc_feature (267)..(267): n is a, c, g, or t
tcagtagtgtagatcacgaccggtgctcgatttagtatctgatagttggggtttggggctgggcctcaggaagcagcatcggaggtgcctcagccatggcatggactccctctcttcctcggcgtccttgcttactgcacaggatccggtggcctcctatgtaactgactcacgcccaccctnacgtcgtccggtacggtccccgggacacgaccacgacccacactccacctcgctcgtggagatagtaagttagggaaataaatntgtacttgactaggtactgaacgacgaacggaccggtcccggacctaccggttcccgtacggtcgtcgttacggtactacgttacctaagtaccgtaaagaacgtaaacgggaccgggtaccgggtacctacgggtaacgggtacccttaccgggtaacggtacggtacgttaccgttcgtaccggttccggtaacccgtaacccggaacccgggttaaacccggaacccaccggaaccccgtcccgtacccgtaaccgaaccttacggacccggtaacgggaaccccggacgtacggttaaccttagggaccggtacggacggttacggacgttaacttaccgttacgttacgtacggtacgggtaaacggcgggttaaccgcggaacttaacggtaaccgtacgaccggtaacaacgttaaccggggacccgtttacgggttaaccggaccgggttaaccggggtacctacggtaacttaacccggtccggttaacccggtaacgtccccggtaaacccggcccggaaaccccgttcccctaaacccgg

SEQ ID NO: 124292 - DNA, 708 bp, Homo sapiens
  misc_feature: GYAE6OF02FZVWZ.37.38.D05.1.454.CMB.1.raw
  modified_base (292)..(292): a, c, t, g, unknown or other
  misc_feature (292)..(292): n is a, c, g, or t
tcagtagtgtagatcacgaccggtgctcgatttagtatctgatagttgggtttggggctgggcctcaggaagcagcatcggaggtgcctcagcccatggcatggatccctctcttcctcggcgtccttgcttactgcacaggatccgtggcctcctatgaactgactcagccaccctcagtgtccgtgtcccccgggacaggaccagccaccattccgaaccctggctactcggagatgaattcgggaaaataaatactgacttgctggtatcgagcacggaagccggaccncgtcccctgtacgtctggtacatctatcaagataaggaacgcgggcctacgaagggtaactcccgtagacgacgtcgttaccgttctacggacccttacaaccgttaacccggggaaaccaaccgaccggacccctaacccgtcggaaccctagtaccgaccggaccgggtaaccccgaggactaaccggttagggaaccgtggtacggacgttacgaacttacgttacttcggtactaccgggtaacgtcggggaaccagtaacgaacttacgtacgaacctacccgaaccgtagggtttaccgtaccgggtaacgtcgggggtaaccctacggggtacccgtaaggttaccccgttaccgttacggggttaccgaacccggtaaccccggaaccggtaccccgtaaaccccccg

SEQ ID NO: 124293 - DNA, 1009 bp, Homo sapiens
  misc_feature: GYAE6OF02JOP6C.37.38.D05.1.454.CMB.1.raw
  modified_base (940)..(940): a, c, t, g, unknown or other
  misc_feature (940)..(940): n is a, c, g, or t
tcagtagtgtagatcacgaccggtgctcgatttagtatctgatagttgggtttggcagtgtccgtgtccccgggacagacagccaccatcacctgctcgtggagatagaagttagggaaaataaatatgtcttgcgtggtatcagcaggaacgccgggactacgtccctgtgcgtgtctactctatagaaagataacggacggccggcctacggacggtaccttcccgtaggacgtcgttcttcgtcgtacggtccctaaccgtaaccggaccgggaaccaccggtacccgaccccgtaccgacgaaccgtacgaccggaccgggaacccggtacccgaacggtaccgtagtaccgggtaaggtaggtaaccgtacgttaaccggtaaccgtttaacgtttaccgtacggttaaccggaacgggtaccgggtaacggaaaccgtacggtaaaaccgttaaaccgggtaccttaccggaaaacccgttaaacggaacccggttttaaacggggttttacccccggttaaacggggttaaacccgggttaaacccgggggtaaacccgggttaaaccggggttacccttttaaccggggtttacccgggtttaaaccggtaaaccggggtaccccgtaaacccccgggaaaacccccggtaaacccggttaaccccctaaaaccccccggtttcggttaaccccgttaaccccggttaccccttttaacccccggtttaccccccggtttaacccccccttaacccccggttaacccctttacccgtaaaccctttaaccccttaaccccgtttaaaccgtttaacccggggtaacgggttaccccgggttacccggggtacccgggtaaaccggtaaacccggggacccgggttaaccgtaaccgggtttaggaccccgtaggtaacgtccgggttaaccncgtactaccgtacgtacgtcgcgtacgtacgtcgtacggtcgtagtacgacgtacgtgtacgtcgtgcg

SEQ ID NO: 124294 - DNA, 812 bp, Homo sapiens
  misc_feature: GYAE6OF02HAEY8.37.38.D05.1.454.CMB.1.raw
  modified_base (644)..(644): a, c, t, g, unknown or other
  misc_feature (644)..(644): n is a, c, g, or t
tcagtagtgtagatcacgaccggtgctcgatttagtatctgatagttgggtttggggctgggcctcaggaagcagcatcggaggtgcctcagccatggcatggatccctctcttcctcggcgtccttgcttactgcacgaggatccgtggcctcctatgaactgactcacgcccaccctcacggttcgtcccgtccggtccccgggaacgacacgcccaccatccacctgcctacgtaggactataggtaagttaggaaaacttaatagtcgtacttcggacgttggtaacttaccggaggtaccgaaagggtaccccgggacccgggacccgttaacccgttcccccgttggtaccgtcgggtacctacgttaccgttaactaacggaaacgtaacggtaaacgggtaaccggtaccggggtaccgtaccggaacggtacccggtaccgtaccggacgtacgttacctttcgttccgtaccggtttccgaacccctaaccggtaaccggaaccgaaccaccgtaccccaccgtacgaccgacgtcggaccggacggacccgacgtgtacgtaggacgtacggacggcgttacggttaccttaaggttccttacggtaccgtacgggtacgttaacggacgtanaccgttagtaacgtacccgtacgaaaccggtaacgttaccggtttaccggtaccgggttaaccggtaccggggtaagtaacccgggttcttacccggtaacggttacccggtcccgttaacggccccggtaaaccccggaacccggtacccccgtaccctaacccggg

SEQ ID NO: 124295 - DNA, 633 bp, Homo sapiens
  misc_feature: GYAE6OF02JMBA3.37.38.D05.1.454.CMB.1.raw
  modified_base (393)..(393): a, c, t, g, unknown or other
  misc_feature (393)..(393): n is a, c, g, or t
  modified_base (492)..(492): a, c, t, g, unknown or other
  misc_feature (492)..(492): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
  modified_base (595)..(595): a, c, t, g, unknown or other
  misc_feature (595)..(595): n is a, c, g, or t
  modified_base (619)..(619): a, c, t, g, unknown or other
  misc_feature (619)..(619): n is a, c, g, or t
tcagtagtgtagatcacgaccggtgctcgatttagtatctgatagttgggtttgggcagtgtccgtgtccccgggacagacagccaccatcacctgctctggagatgaattgggaaataaatatgcttgctggtatcagcagaagccgggccagtcccctgtgctggtcatctatcaagataaaggagtcggcctgagggctccctgagtcgattctcgtcgcctccgaaacgtccggaaactaccgagtcccaccgtcgaccctatccgacgggcccggggcccaagggtctacggttacggtacgttaccggaacgggtcctagtaaccttaacttgtaccgtacgagtaccgggtggacctcggaactaacgtcgtagccaacgtaacgnttaccggttacgggaactcggggtaacctggacgtcctacggtctacggtccacgccgaccggacccaccgtcgcgtactccctacgttccgtaccccnccctccgtactactaccgtacctaccgtaggtaccgcggtaccggacgtcgggtactaccggacctacgatttacggcttcgcgaccgancggacncgtaccngctgactgactccgcgtctaccgngtacgctagctacg

SEQ ID NO: 124296 - DNA, 231 bp, Homo sapiens
  misc_feature: GYAE6OF02JN9HX.37.38.D05.1.454.CMB.1.raw
  modified_base (112)..(112): a, c, t, g, unknown or other
  misc_feature (112)..(112): n is a, c, g, or t
  modified_base (186)..(188): a, c, t, g, unknown or other
  misc_feature (186)..(188): n is a, c, g, or t
  modified_base (191)..(191): a, c, t, g, unknown or other
  misc_feature (191)..(191): n is a, c, g, or t
  modified_base (194)..(231): a, c, t, g, unknown or other
  misc_feature (194)..(231): n is a, c, g, or t
tcagtagtgtagatcacgaccggtgctcgatttagtatctgatagttgggtttggggggtttggtggtctcactcccgccttgacgggctcgccatctgccttccaaccccnctgtcactctgttccccgccctcctcatcctacacctatgacggcgggctgggacaagggcgacctaagtacgnnnatnagnnnnnnnnnnnnnnnnnnnnnnnnnnnnnnnnnnnnnn

SEQ ID NO: 124297 - DNA, 474 bp, Homo sapiens
  misc_feature: GYAE6OF01C4OM3.18.9.A09.1.454.CMB.1.raw
  modified_base (321)..(321): a, c, t, g, unknown or other
  misc_feature (321)..(321): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (464)..(474): a, c, t, g, unknown or other
  misc_feature (464)..(474): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacatcggcctcaggggtccctgaccgattctctggctccaagtctggcacctcagcctcctggccatcactgggctccaggctgaggacgaggctgattatacngcagctcatatacaagcacagcactctctatgtcttcggaactggaccaaggtcaccgtctagtcagcccaagccaacccntcgcactctcttcccaccctccnccatactcgtactcgacgcggctggcaaggcacgatagnnnnnnnnnnn

SEQ ID NO: 124298 - DNA, 483 bp, Homo sapiens
  misc_feature: GYAE6OF01AH9JK.18.9.A09.1.454.CMB.1.raw
  modified_base (470)..(470): a, c, t, g, unknown or other
  misc_feature (470)..(470): n is a, c, g, or t
  modified_base (474)..(483): a, c, t, g, unknown or other
  misc_feature (474)..(483): n is a, c, g, or t
tcagtacgagtatgcacgaccggtgctcgatttagcgagacgcgcagggtcctgggcccagtctgtgctgacgcagccgccctcagtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactcctgttcccgccctcctccatacctcgtactgagcgggctggcaggcgnatgnnnnnnnnnn

SEQ ID NO: 124299 - DNA, 481 bp, Homo sapiens
  misc_feature: GYAE6OF01D44X7.18.9.A09.1.454.CMB.1.raw
  modified_base (472)..(481): a, c, t, g, unknown or other
  misc_feature (472)..(481): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagctgagtggttcgtatgtcttcggatctgggaccaaggtcaccgtctaagtcagcccaagccaaccctctgtcactctcgttcccgcctcctccatactcgtactgagcgggctggcaaggcgcatagnnnnnnnnnn

SEQ ID NO: 124300 - DNA, 511 bp, Homo sapiens
  misc_feature: GYAE6OF01BBOX8.18.9.A09.1.454.CMB.1.raw
  modified_base (348)..(348): a, c, t, g, unknown or other
  misc_feature (348)..(348): n is a, c, g, or t
  modified_base (448)..(448): a, c, t, g, unknown or other
  misc_feature (448)..(448): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
  modified_base (503)..(511): a, c, t, g, unknown or other
  misc_feature (503)..(511): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttggtagcaacaatccggccctcacggggtccctgaccgattctctggcctccaagtctggcacctcacgcctccctggcccatcactgggctccgaggctgaggatggaggctgatttattactgcagctcaatanacaagcaacagcactctctatcgttcttcggaactgggaacctaaggtccaccgtctaggtcacgccaacgcccaaccctactttcactctcgttccccncctcctaccactactccgtactcgacgtccggctggcgaacgggcncgatagncnnnnnnnnn

SEQ ID NO: 124301 - DNA, 486 bp, Homo sapiens
  misc_feature: GYAE6OF01DTTVH.18.9.A09.1.454.CMB.1.raw
  modified_base (479)..(486): a, c, t, g, unknown or other
  misc_feature (479)..(486): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtcttcggatctgggaccaaggtcaccgtcctaagtcagcccaaggcccaacccctctgtcactctcgttccccacccttcctccatacccgtactgagcgggctggcaaggcgcatagnnnnnnnn

SEQ ID NO: 124302 - DNA, 490 bp, Homo sapiens
  misc_feature: GYAE6OF01E1VMZ.18.9.A09.1.454.CMB.1.raw
  modified_base (483)..(490): a, c, t, g, unknown or other
  misc_feature (483)..(490): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggcctccaagtctggcacctcagcctccctggccatcactgggctccaggctgaggatgaggctgactattactgccagtcctatgacatgaggctgagtggttctatgtcttcggatcgtgggaccaaggtcaccgtctaagtcagcccaaggcccaacccctctcgtccactcctcgttcccaccctcctccactacctcgtactgagcgggctggcaaggcgcatagnnnnnnnn

SEQ ID NO: 124303 - DNA, 473 bp, Homo sapiens
  misc_feature: GYAE6OF01DGCYK.18.9.A09.1.454.CMB.1.raw
  modified_base (215)..(215): a, c, t, g, unknown or other
  misc_feature (215)..(215): n is a, c, g, or t
  modified_base (467)..(473): a, c, t, g, unknown or other
  misc_feature (467)..(473): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaaatcctcatctttggtancaacaatcggccctcaggggtccctgaccgattctctggctccaagtctggcacctcagcctcctggccatcactgggcctccaggctgaggatgaggctgactatactgccagtcctatgacatgagctgagtgttcgatgtctcggatcgtggacaaggtcacgtctaagcagcccaagccaaccctctgtccactctcgtcccaccctcctccatcctcgtactgacgcggctggacacggcgcatagnnnnnnn

SEQ ID NO: 124304 - DNA, 481 bp, Homo sapiens
  misc_feature: GYAE6OF01CDWZ9.18.9.A09.1.454.CMB.1.raw
  modified_base (432)..(432): a, c, t, g, unknown or other
  misc_feature (432)..(432): n is a, c, g, or t
  modified_base (474)..(481): a, c, t, g, unknown or other
  misc_feature (474)..(481): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagctgagtggttctatgtcttcggatctgggaccaaggtcaccgtctaagtcagcccaaggcccaacccctctgtccactctcgttcccnccctctccatactcgtactgagcggctggcaaggcgcatagnnnnnnnn

SEQ ID NO: 124305 - DNA, 484 bp, Homo sapiens
  misc_feature: GYAE6OF01CJYCM.18.9.A09.1.454.CMB.1.raw
  modified_base (478)..(484): a, c, t, g, unknown or other
  misc_feature (478)..(484): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggcccaaccctctgtcactctcgttcccgccctcctccattactcgtactgagcgggctggcaaggcgcatagnnnnnnn

SEQ ID NO: 124306 - DNA, 486 bp, Homo sapiens
  misc_feature: GYAE6OF01BQE40.18.9.A09.1.454.CMB.1.raw
  modified_base (479)..(486): a, c, t, g, unknown or other
  misc_feature (479)..(486): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtctaagtcagcccaaggcccaaccctctcgtcactctcgttcccgccctcctccatacctcgtactgacgcggctggcaaggcgcatagnnnnnnnn

SEQ ID NO: 124307 - DNA, 484 bp, Homo sapiens
  misc_feature: GYAE6OF01D4CLS.18.9.A09.1.454.CMB.1.raw
  modified_base (476)..(484): a, c, t, g, unknown or other
  misc_feature (476)..(484): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtctaagtcagcccaaggccaacccctctgtcactctcgttcccgccctcctccatactcgtactgagcggctggcaaggcgcatagnnnnnnnnn

SEQ ID NO: 124308 - DNA, 506 bp, Homo sapiens
  misc_feature: GYAE6OF01EHIP8.18.9.A09.1.454.CMB.1.raw
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
  modified_base (496)..(498): a, c, t, g, unknown or other
  misc_feature (496)..(498): n is a, c, g, or t
  modified_base (500)..(506): a, c, t, g, unknown or other
  misc_feature (500)..(506): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacattcggggcggttatgatgtacactggtaccagcagcttccagggacagcccccaaactcctcatctttggagcaacgaatcggccctcacggggtccctgaccgattctctggctccaagtctggcacctcagcctcctggccatcactgggctccgaggctgaggntggagctgactattacngccagtcctatgacntgaggctgagtggttctatgtcttcggatcgtagggacctaaggtcaccgtctaagtcagacccaaggcccaaccctntcgtccacttctcgttccccnccctcctcctactacttcgtacgtgacgcgggtctggccaagggccgcgataggcnnncnnnnnnn

SEQ ID NO: 124309 - DNA, 485 bp, Homo sapiens
  misc_feature: GYAE6OF01C4L22.18.9.A09.1.454.CMB.1.raw
  modified_base (477)..(485): a, c, t, g, unknown or other
  misc_feature (477)..(485): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctcctggccatcactgggctcaggctgaggatgaggctgactattactgcagtcctatgacatgaggctgagtggttctatgtcttggatcgtggaccaaggtcaccgtcctaagtcagcccaaggcccaaccctctcgtcacttctcgttcccaccctcctccatacctcgtactgacgcggtctggcaaggcgcatagnnnnnnnnn

SEQ ID NO: 124310 - DNA, 520 bp, Homo sapiens
  misc_feature: GYAE6OF01D1BZD.18.9.A09.1.454.CMB.1.raw
  modified_base (330)..(330): a, c, t, g, unknown or other
  misc_feature (330)..(330): n is a, c, g, or t
  modified_base (511)..(520): a, c, t, g, unknown or other
  misc_feature (511)..(520): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcacgcctcctggccatcactgggcctccaggctggaggatggaggctgacttattacngccagtcctatgacatgaggctgagttggtttcgtattgtcgttcggatcgtgggaccaaggtctaccgtctaagtcacgcccgaacggccctaacccctctcgtccacttctccgttccccacccctccctccacttacctcttacgtgacggcggcgtcggcgaacggccgacatacgnnnnnnnnnn

SEQ ID NO: 124311 - DNA, 490 bp, Homo sapiens
  misc_feature: GYAE6OF01AF7OZ.18.9.A09.1.454.CMB.1.raw
  modified_base (481)..(490): a, c, t, g, unknown or other
  misc_feature (481)..(490): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttggatcgtgggaccaaggtcaccgtctaagtcacgcccaggcccaaccctctcgtcactctcgttcccgccctcctccatacctcgtactgacgcgggctggaccaggccgcatgnnnnnnnnnn

SEQ ID NO: 124312 - DNA, 503 bp, Homo sapiens
  misc_feature: GYAE6OF01AOZLV.18.9.A09.1.454.CMB.1.raw
  modified_base (496)..(503): a, c, t, g, unknown or other
  misc_feature (496)..(503): n is a, c, g, or t
tcagtacgagtatgcacgaccggtgctcgatttagcgagacgcgcagggtcctgggcccagtctgtgctgacgcagccgccctcagtgtctggggccccagggcaggagggtcaccatctcctgcactgggagcacctccaacatcggggcgggttatgatgtacactggtaccagcagcttccagggacagcccccaaattgtcatctatggtaacaataatcggccctcgaggggtcccctgaccgattctctggctccaagtctggcacctcagcctccctggccatcactgggctccgaggctgaggatgaggctgactatactgccagtcctatgacagtgaggctggagtggttcgtatgtcttcggattcgtgggaccaaggtccaccgtcctaagtcacgcccaacggcccaaccctctcgtccactcctcgttccccgccctcctcctactacctcgtactgacgcgggctggcaaggcgcagtagnnnnnnnn

SEQ ID NO: 124313 - DNA, 487 bp, Homo sapiens
  misc_feature: GYAE6OF01CFCWX.18.9.A09.1.454.CMB.1.raw
  modified_base (471)..(471): a, c, t, g, unknown or other
  misc_feature (471)..(471): n is a, c, g, or t
  modified_base (477)..(487): a, c, t, g, unknown or other
  misc_feature (477)..(487): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcaacacggcctcctgaccatctctgggctccaggctgaggcgaggctgattatactgcagctcatatacaagcaccagcactctctatgtcttcggaactgggaccaaggtcaccgtctaggtcagcccaaggcccaaccccactcgtccactcctcgttccccgccctcctccactacctcgtactgacgcggctggcaaggcncagtgnnnnnnnnnnn

SEQ ID NO: 124314 - DNA, 485 bp, Homo sapiens
  misc_feature: GYAE6OF01CXXFX.18.9.A09.1.454.CMB.1.raw
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (479)..(485): a, c, t, g, unknown or other
  misc_feature (479)..(485): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaactcctcatctttggagcaaacaatcggccctcaggggtccctgaccgattctctggctccaagtctggcacctcagcctccctggccatcactgggcctccaggctgaggatgaggctgactatactgccagtcctatgacatgagctgagtgttcgtatgtcttcggatcgtagggacctaaggtcaccgtacctaagtcaacgcccaaggcccaacccctcncgtcactctcgtccccnccctcctcatctcgtactgagcggctggcaggcgcatagnnnnnnn

SEQ ID NO: 124315 - DNA, 486 bp, Homo sapiens
  misc_feature: GYAE6OF01A6P5Z.18.9.A09.1.454.CMB.1.raw
  modified_base (476)..(476): a, c, t, g, unknown or other
  misc_feature (476)..(476): n is a, c, g, or t
  modified_base (479)..(486): a, c, t, g, unknown or other
  misc_feature (479)..(486): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaggtcaccgtctaagtcacgcccaacggccaacccctctcgtcactctcgttcccaccctcctccatacctcgtactgagcggctggcaaggcgcanagnnnnnnnn

SEQ ID NO: 124316 - DNA, 865 bp, Homo sapiens
  misc_feature: GYAE6OF01CG5H0.18.9.A09.1.454.CMB.1.raw
tcagtacgagtatgcacgaccggtgctcgatttagcgagacgcgcaggggtcctgggcccagttctcgtgcttgacgccacgccgccctcagtgtctcgggcccgtagggtcgacgaagggtttcaacctatctcctgccacttgggtagccggaccttcccggaaacgacggttcggggacgggttatgtatcgtacactcggtaccagcagtcgtccagggacacgcccctaaactcctactattcgtttggacgactaacgtaactccggcccttcggaccgggggtccctacggtaccccgtacttccgtcgttcggactttaccgaaggttaccttacgggaacctaaccccgttcgtacgggtccccttccgtacggtcccgtacttccgtacggtccgggtccttccgaacggtcgtcggacggtactaggtacggtcttacgtaccttacttaccgtcgtcctacgttccgtaagttacggaaactacgttgggaacgggtaccgtagggtacgtttcgggttttaacgttaagttttcggttcggtttacgggtacgtttcccggtttaacggggaacctaaacgggtttaccccgaaccccggtttaaccttaaaggtcccggtaaccgggtaccccgtaaccgggggtacccccggtaaacccccttcgttaccgttaccgtacccgtttccttacccgggttaccccctaccccgttaccctacccgtaacgtttcccgttaccggttaaccccgttcgggaccggtcccgggttccgttccggggtaacccccgtaacgggtcccgtaccgtaaggtttcggcttacgtacgcgtacgcgtctacgcgagcg

SEQ ID NO: 124317 - DNA, 490 bp, Homo sapiens
  misc_feature: GYAE6OF01D1Z64.18.9.A09.1.454.CMB.1.raw
  modified_base (485)..(490): a, c, t, g, unknown or other
  misc_feature (485)..(490): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctccctggccatcactgggcctccagggctgaggatgaggctgactattactgccagtcctatgacatgaggctgagttggttcgtatgtcttcggatctgggaccaaggtcaccgtctaagtcagcccaaggcccaacccctctgtcactcctcgttccccaccctcctcccatacctcgtactgagcgggctggcaaggcgcatagnnnnnn

SEQ ID NO: 124318 - DNA, 512 bp, Homo sapiens
  misc_feature: GYAE6OF01DBRPM.18.9.A09.1.454.CMB.1.raw
  modified_base (437)..(437): a, c, t, g, unknown or other
  misc_feature (437)..(437): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
  modified_base (502)..(512): a, c, t, g, unknown or other
  misc_feature (502)..(512): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccagggacacgcccccaaactcctcattctttggtagcaacaatccggcccccaggggtccctgaccgattctctggctccaagtctggcacctcagccctccctggccatcacgtgggcctccgaggctggaggatggagctgactattactgccagtcctatgacatgaggtctggagttggttcgtattcgtctttcggatcgtagggacctaaggtcaccgttcctaagtcacgcccaaggcccaaccctntcgtcactctcgtccccacctcctaccatacctcgtacncgagccggctggcacggcncgatagnnnnnnnnnnn

SEQ ID NO: 124319 - DNA, 608 bp, Homo sapiens
  misc_feature: GYAE6OF01BK9F1.18.9.A09.1.454.CMB.1.raw
  modified_base (598)..(608): a, c, t, g, unknown or other
  misc_feature (598)..(608): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtgggagccacctccaacagtcgggggcgggttatgatgtacactggtaccagcagcttccgagggaccacgacccccaaactcctcattctttggagacaaacaatccggccctcgacgggggtccctgaccgtattcctcgtggcctaccaagtctggccacctcacgccctcccgtggcccatccacgtcgggcctccgaggctggaggatggaggctagacttattacgcgacctagtcctatacgactagtggaggtctaggtaggttggttacgtagttcgttcgttcggacgtcgtacgggtacgtaacggtacgtaccgtaccgtaacgtacgaccgacccgaaccgaccctaacccctaccgtcgtcctacctccttccgttccccgtcccctccctaccctacttaccttaccgtacgtacgtacggcggcgtcggacgacggcgcgagttttttttttacgnnnnnnnnnnn

SEQ ID NO: 124320 - DNA, 486 bp, Homo sapiens
  misc_feature: GYAE6OF01A7DLX.18.9.A09.1.454.CMB.1.raw
  modified_base (478)..(486): a, c, t, g, unknown or other
  misc_feature (478)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtgttcgtatgtcttcggatctgggaccaaggtcaccgtcctaagtcagcccaaggcccaaccctctgtcactctcgttccccgccctcctccatacctcgtactgagcgggctggcaggcgcatagnnnnnnnnn

SEQ ID NO: 124321 - DNA, 595 bp, Homo sapiens
  misc_feature: GYAE6OF01CDPN7.18.9.A09.1.454.CMB.1.raw
  modified_base (338)..(338): a, c, t, g, unknown or other
  misc_feature (338)..(338): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (589)..(592): a, c, t, g, unknown or other
  misc_feature (589)..(592): n is a, c, g, or t
  modified_base (594)..(595): a, c, t, g, unknown or other
  misc_feature (594)..(595): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcattctttggtagcaaacaatccggccctcgacggggtccctgaccgtattctctggctccaagtctggcacctcacgcctccctggccatccacgtgggcctccaggctgaggatggaggctgacttattacncgccagtcctatgacatgaggctggagttcggttcgtatcggttcttcggattcgtacggggacctaagggtccacccgttcctaaagtccaacgcccaacgggtcccctaaaccccttcgtcgtacctacccgttcgttacccgtttcccccgcccttcctaccctaacttacccgttccgtaccgttacggacggtccgggtaccgttcgggaccgaaagggccgtccgtaagttaccggngcngctcnnnngnn

SEQ ID NO: 124322 - DNA, 485 bp, Homo sapiens
  misc_feature: GYAE6OF01BHDAW.18.9.A09.1.454.CMB.1.raw
  modified_base (325)..(325): a, c, t, g, unknown or other
  misc_feature (325)..(325): n is a, c, g, or t
  modified_base (477)..(485): a, c, t, g, unknown or other
  misc_feature (477)..(485): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattacngccagtcctatgacatgaggctgagtggttcgtatgtcttcggatctgggaccaaggtcaccgtctaagtcagcccaaggcccaaccctctgtcactctcgttcccaccctcctccatacctcgtactgacgcggctggcaaggcgcatagnnnnnnnnn

SEQ ID NO: 124323 - DNA, 507 bp, Homo sapiens
  misc_feature: GYAE6OF01EX5J0.18.9.A09.1.454.CMB.1.raw
  modified_base (328)..(328): a, c, t, g, unknown or other
  misc_feature (328)..(328): n is a, c, g, or t
  modified_base (422)..(422): a, c, t, g, unknown or other
  misc_feature (422)..(422): n is a, c, g, or t
  modified_base (500)..(507): a, c, t, g, unknown or other
  misc_feature (500)..(507): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggccttccaagtctggcacctcagcctccctggccatcactgggctccgaggctggagatgaggctgactattacngccagtcctatgacagtgaggtctgagttggtcgtatcgttcttcggatcgtgggaccaggtcaccgtctaagcacgcccaacgcccaaccctntcgtccacttctcgtccccacctcctcctatactcgtactggacgcgggtctcggacaacggcgaccagtacgctgcnnnnnnnn

SEQ ID NO: 124324 - DNA, 503 bp, Homo sapiens
  misc_feature: GYAE6OF01E10QM.18.9.A09.1.454.CMB.1.raw
  modified_base (419)..(419): a, c, t, g, unknown or other
  misc_feature (419)..(419): n is a, c, g, or t
  modified_base (492)..(503): a, c, t, g, unknown or other
  misc_feature (492)..(503): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgagctgactattactgccagtcctatgacatgaggctgagtggttcgtatgtcttggattcgtgggaccaaggtcaccgtcctaagtcacgacccaaggcccaaccccnctcgtccacttcctcgttccccaccctcctccctactccgtactgacgccgggctgggccaaggcgcagtagnnnnnnnnnnnn

SEQ ID NO: 124325 - DNA, 499 bp, Homo sapiens
  misc_feature: GYAE6OF01CG4LL.18.9.A09.1.454.CMB.1.raw
  modified_base (489)..(499): a, c, t, g, unknown or other
  misc_feature (489)..(499): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaactcctcatctttggagcaaacaatcggccctcgaggggtccctgaccgattctctggctccaagtctggcacctcagcctccctggccatcactgggctccaggctgaggatgaggctgactattactgcctagtcctatgacatgagctgagttggttcgtatgtcttcggatcgtgggaccaggtcaccgtctaagtcaacgcccaaggcccaaccctctctccactctcgttccccgccctcctccactactccgtactgacgcgggctcggcgaaggccgcatacgnnnnnnnnnnn

SEQ ID NO: 124326 - DNA, 486 bp, Homo sapiens
  misc_feature: GYAE6OF01CAKRI.18.9.A09.1.454.CMB.1.raw
  modified_base (342)..(342): a, c, t, g, unknown or other
  misc_feature (342)..(342): n is a, c, g, or t
  modified_base (459)..(459): a, c, t, g, unknown or other
  misc_feature (459)..(459): n is a, c, g, or t
  modified_base (478)..(486): a, c, t, g, unknown or other
  misc_feature (478)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatccggccctcacggggtccctgaccgattctctggctccaagtctggcacctcagcctccctggccatcactgggctccaggctgaggatgaggctgactatactgccagtcctatgacntgagctgagtggttctatgtcttcggatcgtgggaccaggtcacgtctaagtcacgcccaacggcccaacccctctcgtccactctccgttcccgccctcctccactctcgtactgngcggctggcaggcgcatgnnnnnnnnn

SEQ ID NO: 124327 - DNA, 487 bp, Homo sapiens
  misc_feature: GYAE6OF01BON0Z.18.9.A09.1.454.CMB.1.raw
  modified_base (326)..(326): a, c, t, g, unknown or other
  misc_feature (326)..(326): n is a, c, g, or t
  modified_base (417)..(417): a, c, t, g, unknown or other
  misc_feature (417)..(417): n is a, c, g, or t
  modified_base (481)..(487): a, c, t, g, unknown or other
  misc_feature (481)..(487): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctccctggccatcactgggctccaggctgaggatgaggctgactattacngccagtcctatgacatgaggctgagtggttctatgtcttggatcgtgggaccaaggtcaccgttccaagtcagcccaaggcccaacccctntcgtcactctcgttcccaccctcctccatacctcgtactgagcgggctggccaaggcgcatagnnnnnnn

SEQ ID NO: 124328 - DNA, 483 bp, Homo sapiens
  misc_feature: GYAE6OF01BS6TN.18.9.A09.1.454.CMB.1.raw
  modified_base (322)..(322): a, c, t, g, unknown or other
  misc_feature (322)..(322): n is a, c, g, or t
  modified_base (473)..(475): a, c, t, g, unknown or other
  misc_feature (473)..(475): n is a, c, g, or t
  modified_base (477)..(483): a, c, t, g, unknown or other
  misc_feature (477)..(483): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctcctgccatcactgggctcaggctgagatgagctgactattacngccagtcctatgacatgaggctgagtggttcgtatgtcttggatcgtggaccaagtcaccgtctaagtcacgcccaagcccaaccctctcgtcactctcgttcccgcctctcctatactcgtactcgacgcggctggcaaggcgcagtagnnncnnnnnnn

SEQ ID NO: 124329 - DNA, 500 bp, Homo sapiens
  misc_feature: GYAE6OF01A13G4.18.9.A09.1.454.CMB.1.raw
  modified_base (326)..(326): a, c, t, g, unknown or other
  misc_feature (326)..(326): n is a, c, g, or t
  modified_base (491)..(500): a, c, t, g, unknown or other
  misc_feature (491)..(500): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagccccccaaactcctcatctttggtagcaacaatcggccctcaggggtccctgaccgattctctggctccaagtctggcacctcagcctccctggccatcactgggctccaggctgaggatgaggctgactattacngccagtcctatgacatgaggctgagtggttcgtatgtcttcggatcgtgggaccaggtcaccgtcctaagtcagcccaaggcccaacccctctcgtccacttcctcgttccccgcccttcctccattacctcgtactggacgcgggctcggcaagggcgcatagnnnnnnnnnn

SEQ ID NO: 124330 - DNA, 552 bp, Homo sapiens
  misc_feature: GYAE6OF01EH6G3.18.9.A09.1.454.CMB.1.raw
  modified_base (543)..(545): a, c, t, g, unknown or other
  misc_feature (543)..(545): n is a, c, g, or t
  modified_base (547)..(552): a, c, t, g, unknown or other
  misc_feature (547)..(552): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcagggtccctgaccgattctctggctccaagtctggcacctcacgcctccctggccatccactgggctccaggctgatgatgagctgattattactgccagtcctatcgacactaatctcagtggtcgtgggggtcttcgggcggagggaccgaggctcggaccggttcggtgggtcacggcccgaagggcctccgtcccccgttcggtcctaccgttccgttccgttccccctaccccttccctacctacttaccgttccgtacctcggacggccgggtcgtcgggaccgaacgggccgacgacgttagctgnnncnnnnnn

SEQ ID NO: 124331 - DNA, 761 bp, Homo sapiens
  misc_feature: GYAE6OF01CYVSO.18.9.A09.1.454.CMB.1.raw
  modified_base (740)..(740): a, c, t, g, unknown or other
  misc_feature (740)..(740): n is a, c, g, or t
  modified_base (756)..(756): a, c, t, g, unknown or other
  misc_feature (756)..(756): n is a, c, g, or t
tcagtacgagtatgcacgaccggtgctcgatttagcgagacgcgcagggttccgtgggcccagtctgtgctgacgcagcccgccctcagtgtcctgggccccagggcagaggtcaccatctcctgcacgtgggagccaccttccaacagtcggggcgggttatgatgtacactcggtaccagcagcttccgagggacacgccccctaaaacgtcctcattcgttttggagacaacaagtccggccctcgacgggggtccctgacccgtattctcgtcggtcctaccgaagtcctcggccaccctcacgtccctccgtggcccatccgacgtcgggcctaccgacggtcgtaggaggactggacggtcctaggaacttagttaccgtcgacccgtaaggttcctaagtcggaacctagttacggaacggtccgttaggtaacggttttcggtttacgttaagtttcggttacccggtttacgggacgttccggtacggggtaaacccgttaaacgggttaccccgtaacccggttaccgttaaaccggttaccgaacccggtaacccccgaaaccgggtaccccctaaaccccgttcgtaccgttacccgtacccgtttaccgtttccccggttcccccggtcccccttaccgttacccctacgtttacccgttaccggttaccgttcgggaccgggcccgggtacgtccgggacggtaacggccgtacgtaaggtgacgngtagcgtatacatcgngtgtg

SEQ ID NO: 124332 - DNA, 523 bp, Homo sapiens
  misc_feature: GYAE6OF01EMXVK.18.9.A09.1.454.CMB.1.raw
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (494)..(494): a, c, t, g, unknown or other
  misc_feature (494)..(494): n is a, c, g, or t
  modified_base (512)..(516): a, c, t, g, unknown or other
  misc_feature (512)..(516): n is a, c, g, or t
  modified_base (518)..(523): a, c, t, g, unknown or other
  misc_feature (518)..(523): n is a, c, g, or t
tcagtacgagtatgcacgaccggtgctcgatttagcgagacgcgcagggtccgtgggcccagtctgtgctgacgcagccgccctcagtgtcctgggccccagggcagagggtcaccatctcctgcactgggagcacctccaacatcggggcggttatgatgtacactggtaccagcagcttccagggacagccccccaaaactcctcatctttggtagcaacaatccggccctcgaggggtccctgaccgattctctggcctccaagtcctggccacctcagcctccctggcccatcactgggcctccgaggctgaggntggaggctgactattacngccagtcctagtgactagtgaggtctgagttggttacgtagttgtcgtttcggatcgtcggaccaggtccaccgtctaacgtcacgacccaaggcccaacccctctcgtcctactctcgtccccgccctccctccacttctcgtactgacgccgggntcggcaaggcgctagtgnnnnntnnnnnn

SEQ ID NO: 124333 - DNA, 705 bp, Homo sapiens
  misc_feature: GYAE6OF01D7MBS.18.9.A09.1.454.CMB.1.raw
  modified_base (168)..(168): a, c, t, g, unknown or other
  misc_feature (168)..(168): n is a, c, g, or t
  modified_base (240)..(240): a, c, t, g, unknown or other
  misc_feature (240)..(240): n is a, c, g, or t
  modified_base (363)..(363): a, c, t, g, unknown or other
  misc_feature (363)..(363): n is a, c, g, or t
  modified_base (684)..(684): a, c, t, g, unknown or other
  misc_feature (684)..(684): n is a, c, g, or t
  modified_base (693)..(693): a, c, t, g, unknown or other
  misc_feature (693)..(693): n is a, c, g, or t
  modified_base (701)..(701): a, c, t, g, unknown or other
  misc_feature (701)..(701): n is a, c, g, or t
tcagtacgagtatgcacgaccggtgctcgatttagcgagacgcgcagggtcctggggcccagtctgtgtcctgaccgccagccgccctcgagtgtcgtcgggccccgacgggcagagggtccaccatctcctgcactcgggagcacgtccaacagtcgggcgggttangatgtactactggtaccagcgaagcttccagggacacggtcccccaaaattcctcaattccttttgggtacncctaacgaactaccggacccctccgacggggtccctaggaccccaatttctacttggctaccaaggtctggactaccgtcctagccgtccctggcctagtcctactgggctccaggctgaggntaggacggctgactacttactgctaggcctacgatagtaacaaggtccaacctagacctacgttcttcgtaacttggttaccgttacggaaacgttacgggaaacccaaagggttcctaacccggttcccttaaggggtccgtaacggtacccccggaacggggtaccctaaacccccgtacgttcggttaccctaacccgttcccgttaccgttcccccgtaaccccgtccccgttaacccgaccgtttacccgtccccgttaaccggtcggacgtccgggtccttaccgggccctaaaccgggcgtacctaaggtccgngtcacgcgnggtcagcngcag

SEQ ID NO: 124334 - DNA, 489 bp, Homo sapiens
  misc_feature: GYAE6OF01AQUBG.18.9.A09.1.454.CMB.1.raw
  modified_base (369)..(369): a, c, t, g, unknown or other
  misc_feature (369)..(369): n is a, c, g, or t
  modified_base (481)..(489): a, c, t, g, unknown or other
  misc_feature (481)..(489): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcagggggtccctgaccgattctctggctccaagtctggcacctcagcctccctggccatcactgggctccaggctgaggatgaggctgactatactgccagtcctatgacatgagctgagtggttcgtatgtcttcggntcgtgggaccaggtcaccgtctagtcacgcccaaggccctaaccctctgtccactctcgttccccgcccttccctccatacctcgtactgacgcgggctggcaggcgcatgnnnnnnnnn

SEQ ID NO: 124335 - DNA, 799 bp, Homo sapiens
  misc_feature: GYAE6OF01AKP8Q.18.9.A09.1.454.CMB.1.raw
  modified_base (790)..(799): a, c, t, g, unknown or other
  misc_feature (790)..(799): n is a, c, g, or t
tcagtacgagtatgcacgaccggtgctcgatttagcgagacgcgcagggtcctgggcccagtctgtgctgacgcagccgccctcagtgtcgtcgggcccagggcaggaggtcaccatctcctgcacgtgggagccacctaccaacgaggtcgggggtcggttatgatgtacacgtggtaccagcagtccttaccgagggaccaccgaccccctaactcctactattcgtttaggacgacaactacgtccggcctcggacgggtcctggtaccgtacttcctcgtcggcctaccgtaacgtcgtacggccctacctcgaccgtccctcccgtggacctagtccgacggtccgggcctaccgaggtcgtaggacggtagtacggtaacggtccgttagtaacctttaacgttaccgtaccggtaccttaaccggttacccgttaaggtacggtaaacgttaggttacggggtaacgggttccggttaggggttaacggggttttcgggttttacggttaacggtttccggtttaccggttacgggtacgttaccggggtacccgggaaaccgttaaccgggttacccctaaccccggttaaccggtaaccggtacccgaaccccggtaaccccggaaccccggttacccccttaacccctttcggttaccttaccccctccgtttcccggttcccccgttaccccctccccgttacctaacccgtacgtttaccgtccgggtacgtaccgggacgggtccggttacgacgggacgaacggtccgaagtacgnnnnnnnnnn

SEQ ID NO: 124336 - DNA, 687 bp, Homo sapiens
  misc_feature: GYAE6OF01EUZR4.18.9.A09.1.454.CMB.1.raw
  modified_base (674)..(674): a, c, t, g, unknown or other
  misc_feature (674)..(674): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (681)..(684): a, c, t, g, unknown or other
  misc_feature (681)..(684): n is a, c, g, or t
  modified_base (686)..(687): a, c, t, g, unknown or other
  misc_feature (686)..(687): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatttcctgcactgggagcacctccaacagtcggggcgggttatgatgtacactggtaccagcagcttccagggacacgccccaaactcctcatctttggtagcaacaatccggccctcgacggggtccctgaccgtattctctcggcctccaagttctggccacctcacgccctcctggccatcacgtcgggcctccgaggctggaggatggaggctgacttattactcgacctagtcctatgactagtggaggtctggtaggttcggtttacgttagttcggttcgtttacgggtacttccggtacggggaacccgtaacgggttcccgtaacccggttacccgttaaacggtacccgaaccggtaccccgaaaccgggtaccccctaaacccccgttccgttaccggttaccctaccctttacccgtttaccccgtttacccccctaccccctttccccttacccctaacctttacccgttacccgttaaccgttcggaaccgggtccggggtccgttacggggacccgtaaacgggccgtaacgtacgttaggctcncgncncnnnngnn

SEQ ID NO: 124337 - DNA, 481 bp, Homo sapiens
  misc_feature: GYAE6OF01EQDO0.18.9.A09.1.454.CMB.1.raw
  modified_base (473)..(481): a, c, t, g, unknown or other
  misc_feature (473)..(481): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaatcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtggaccaaggtcaccgtctaagtcagcccaaggccaaccctctcgtcactctcgttcccaccctcctccatactcgtactgacgcggctgcaaggcgcatgnnnnnnnnn

SEQ ID NO: 124338 - DNA, 691 bp, Homo sapiens
  misc_feature: GYAE6OF01CXN02.18.9.A09.1.454.CMB.1.raw
  modified_base (333)..(333): a, c, t, g, unknown or other
  misc_feature (333)..(333): n is a, c, g, or t
  modified_base (680)..(680): a, c, t, g, unknown or other
  misc_feature (680)..(680): n is a, c, g, or t
  modified_base (685)..(686): a, c, t, g, unknown or other
  misc_feature (685)..(686): n is a, c, g, or t
  modified_base (688)..(688): a, c, t, g, unknown or other
  misc_feature (688)..(688): n is a, c, g, or t
  modified_base (690)..(690): a, c, t, g, unknown or other
  misc_feature (690)..(690): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacacgcccccaaatcctcatcttttggagcaacaatccggaccctcgaggggtccctggaccgtattctctggctccaagtctggcacctcacgcctccctggccatccactgggcctcgaggctgaggatggaggctgactatacgngccagtcctatcgaactagtggaggtctaggtaggttgggtttacgtagttcggttacctttcgggacttaccggtacggggtaaccctaaacgggttccctaaaccccgggttacccttaaacgggttacccaaacccgggtaccccaaaccggggtacccctaaacccccgttccgttaccggttacctacccgttcccgtttacccgtttaccccccttaacccccttccccgttaccctaaccgtttacccgttacccggttaaccttacgggtaccggtcccggggtaccgttacggggaaccgtaaacggggcccgaccggtaaagttaacggctagcgtntcacnncngnc

SEQ ID NO: 124339 - DNA, 505 bp, Homo sapiens
  misc_feature: GYAE6OF01BFB95.18.9.A09.1.454.CMB.1.raw
  modified_base (495)..(505): a, c, t, g, unknown or other
  misc_feature (495)..(505): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggcccatcactggctccaggctgaggatgaggctgactattactgccagtcctatgacatgaggctggagttggttctatgtcttcggattcgtgggaccaaggtcacccgtctaagtcagccccaaggccctaacccctctcgtccacctctcgttcccgccccttcctccatacctcgttactcgacgcggctgggccaaggccgcatagnnnnnnnnnnn

SEQ ID NO: 124340 - DNA, 502 bp, Homo sapiens
  misc_feature: GYAE6OF01CGTMR.18.9.A09.1.454.CMB.1.raw
  modified_base (326)..(326): a, c, t, g, unknown or other
  misc_feature (326)..(326): n is a, c, g, or t
  modified_base (493)..(502): a, c, t, g, unknown or other
  misc_feature (493)..(502): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggtcatgatgtacactggtaccagcagcttccagggacagcccccaaactcctcatctttggtagcaacaatcggccctcaggggtccctgaccgattctctggctccaagtctggcaccctcagcctccctggcccatcactgggctccaggctgaggatgagctgactattacngccagtcctatgacatggaggctgagtggttcgtatgtcttcgatcgtgggaccaggtcaccgtctaacgtcacgcccaaggccctaacccctctcgtccactctcgttccccaccctcctcctactacctcgtactcgacggcgggtctcggacaggccgcatagnnnnnnnnnn

SEQ ID NO: 124341 - DNA, 501 bp, Homo sapiens
  misc_feature: GYAE6OF01CKFX5.18.9.A09.1.454.CMB.1.raw
  modified_base (492)..(501): a, c, t, g, unknown or other
  misc_feature (492)..(501): n is a, c, g, or t
tcagtacgagtatgcacgaccggtgctcgatttagcgagacgcgcagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcactaatcggccctcaggggttttctaatcgcttctctggctcaagtctggcaacacggcctccctgaccatctctgggctccaggctgaggacgaggctgattattactgccagtcctatgacatgagctgagtgttcgtatgtcttcggatcgtggaccaaggtcaccgtctaagtcacgcccaacggcccaaccctctacgtcacttcctcgttccccgcccttcctccattacctccgtactcgagccggctcggaccaagggcgcatagnnnnnnnnnn

SEQ ID NO: 124342 - DNA, 577 bp, Homo sapiens
  misc_feature: GYAE6OF01DAU7U.18.9.A09.1.454.CMB.1.raw
  modified_base (216)..(216): a, c, t, g, unknown or other
  misc_feature (216)..(216): n is a, c, g, or t
  modified_base (568)..(577): a, c, t, g, unknown or other
  misc_feature (568)..(577): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacacgcccccaaactcctcatctttggtancaacaatccggccctcaggggtccctgaccgattctctggctaccaagtctggcacctcacgcctccctggccatcactcgggcctccgaggctgaggatggaggcttagacttattacctgcctagtcctaatgaactatggaggtctggaggttggtttcgtattgttctttcgggattcgtacgggacctaacggtccaccgttaccgttaaggtcgtaacggaccccgtaacgggacccctaacccccttcgtacgtcctaccgttccttccgttccccaccccttccctaccctactaccttccactcggacggccgggtctcggaccgaacggcgacctagtagcnnnnnnnnnn

SEQ ID NO: 124343 - DNA, 488 bp, Homo sapiens
  misc_feature: GYAE6OF01BE76U.18.9.A09.1.454.CMB.1.raw
  modified_base (337)..(337): a, c, t, g, unknown or other
  misc_feature (337)..(337): n is a, c, g, or t
  modified_base (471)..(471): a, c, t, g, unknown or other
  misc_feature (471)..(471): n is a, c, g, or t
  modified_base (478)..(488): a, c, t, g, unknown or other
  misc_feature (478)..(488): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtcccctgaccgattctctggctccaagtctggcacctcagcctcctggccatcactgggctccaggctgagatgagctgactatactgccagtcctatgacntgaggctggagttggttctatgtcttggatcgtgggaccaaggtaacctctaagtcacgcccaaggcccaaccctctcgtcactctcgttccccgccctcctcctatacctcgtactgacgcggctggcaggcncagtagnnnnnnnnnnn

SEQ ID NO: 124344 - DNA, 533 bp, Homo sapiens
  misc_feature: GYAE6OF01C3CAB.18.9.A09.1.454.CMB.1.raw
  modified_base (444)..(444): a, c, t, g, unknown or other
  misc_feature (444)..(444): n is a, c, g, or t
  modified_base (524)..(533): a, c, t, g, unknown or other
  misc_feature (524)..(533): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacacgccccccaaactcctcattctttggagcaacaatccggcctcgacggggtccctgaccgattctctggcctccaagtctggcacctcacgccctccctggcccatcacgtgggcctccgaggctgaggatggaggctgaacttatactgaccctagtcctatgacagtggagtctggagttggtctagtcgtcgttggatcgtagggacctaaggtccaccgtactaagtcaccgaccaaggccctaacctntctccacttctcgtcccccgccctcctcctacttactccgtactcggacgccgggtctgggacctaagggcgacgatgcnnnnnnnnnn

SEQ ID NO: 124345 - DNA, 549 bp, Homo sapiens
  misc_feature: GYAE6OF01D4UCP.18.9.A09.1.454.CMB.1.raw
  modified_base (334)..(334): a, c, t, g, unknown or other
  misc_feature (334)..(334): n is a, c, g, or t
  modified_base (540)..(549): a, c, t, g, unknown or other
  misc_feature (540)..(549): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtagcaacaactcggccctcgacggggtccctgaccgattctctggctccaagtctggccacctcacgcctccctggccatcactgggctccgaggctggaggatggaggctgactattacngccagtcctatgacatgagctggagttggttcgtagttcgttcttcgggatcggtacgggaccctaagggtcctaaccggttacctaaagtccaacgaccccgaacggcccctaaaccccttcgtcgtccaccttctccgttcccccgcccttccctaccacttaccgtccgttactggacgcgggctcggacaacggcgtcatgnnnnnnnnnn

SEQ ID NO: 124346 - DNA, 486 bp, Homo sapiens
  misc_feature: GYAE6OF01A33XP.18.9.A09.1.454.CMB.1.raw
  modified_base (477)..(486): a, c, t, g, unknown or other
  misc_feature (477)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtctaagtcagcccaagccaaccctctgtcactctcgttcccgccctcctccatactcgtactgacgcggctggcaaggcgcatagnnnnnnnnnn

SEQ ID NO: 124347 - DNA, 535 bp, Homo sapiens
  misc_feature: GYAE6OF01DFR2S.18.9.A09.1.454.CMB.1.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (526)..(535): a, c, t, g, unknown or other
  misc_feature (526)..(535): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaaatcctcatctttggtagcaacaatccggccctcgaggggtccctgaccgattctctggctccaagtctggcacctcagcctccctggccatcactgggcctcaggctgaggntgcgctgactatacngccagtcctatgacatgaggtctggtagtggtttcgtatgttcttcggatcgtacgggaccaaggttccaaccggttacctaagtcaacgccccaagggcccctaaaccccctcgttcgtacctaccttccttcgttcccccaaccccttcctaccctacttacctcgtactggacgccgggtctggacaaggcgcatgcnnnnnnnnnn

SEQ ID NO: 124348 - DNA, 516 bp, Homo sapiens
  misc_feature: GYAE6OF01AE6IU.18.9.A09.1.454.CMB.1.raw
  modified_base (506)..(516): a, c, t, g, unknown or other
  misc_feature (506)..(516): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggagcaacaatcggccctcaggggtccctgaccgattctctggctccaagtctggcacctcagcctccctggccatcactgggcctccaggctgaggatgaggctgacttattactgccagtcctaatgacagtgaggctggagttggttcgtattcgtcttcggatcgtgggaccaggtcaccgtctaagtcacgtcccgaacgccctaaccctctcgtccacctctccgttccccgcccttccctccgtacttactccgtactcggacgtcggcgtggacgacggcgcgatagnnnnnnnnnnn

SEQ ID NO: 124349 - DNA, 504 bp, Homo sapiens
  misc_feature: GYAE6OF01D47XN.18.9.A09.1.454.CMB.1.raw
  modified_base (331)..(331): a, c, t, g, unknown or other
  misc_feature (331)..(331): n is a, c, g, or t
  modified_base (496)..(504): a, c, t, g, unknown or other
  misc_feature (496)..(504): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacagccccccaaaactcctcatctttggtagcaacaatccggccctcaggggtccctgaccgattctctggctccaagtctggcacctcagcctccctggccatcactgggcctccaggctggaggatggaggctgacttattacngccagtcctatgacatgaggctggagtggttctatgtcttcgggatcgtgggaccaaggtcaccgtactaagtcacgcccaaggcccaacccctctcgtccacttcctcgttccccgcccttcctccattacctcgtactgacgcgggctggcaaggcgcatagnnnnnnnnn

SEQ ID NO: 124350 - DNA, 489 bp, Homo sapiens
  misc_feature: GYAE6OF01BYUI8.18.9.A09.1.454.CMB.1.raw
  modified_base (416)..(416): a, c, t, g, unknown or other
  misc_feature (416)..(416): n is a, c, g, or t
  modified_base (481)..(489): a, c, t, g, unknown or other
  misc_feature (481)..(489): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatccactgggctccaggctgaggatgagctgactatactgccagtcctatgacatgaggtctggagtggttctatgtcttcggatgtcgggaccaggtcaccgtctaagtcagcccaaggcccaacccctntcgtcactctccgttcccgccctcctccatacctcgtactgacgcgggctcggcaggcgcatagnnnnnnnnn

SEQ ID NO: 124351 - DNA, 485 bp, Homo sapiens
  misc_feature: GYAE6OF01AYAUB.18.9.A09.1.454.CMB.1.raw
  modified_base (408)..(408): a, c, t, g, unknown or other
  misc_feature (408)..(408): n is a, c, g, or t
  modified_base (474)..(475): a, c, t, g, unknown or other
  misc_feature (474)..(475): n is a, c, g, or t
  modified_base (477)..(485): a, c, t, g, unknown or other
  misc_feature (477)..(485): n is a, c, g, or t
tcagtacgagtatgcacgaccggtgctcgatttagcgagacgcgcagggtcctgggcccagtctttgctgacgcagccgccctcagtgtctggggccccagggcagagggtcaccatctcctgcactgggagcacctccaacatcggggcgggttatgatgtacactggtaccagcagcttccagggacagcccccaaactcctcatctttggagcaacaatcggcctcaggggtccctgaccgattctctggctccaagtctggcacctcagcctcctggccatcactgggctccaggctgaggatgaggctgactatactgccagtcctatgacatgaggctgagtggttcatgtcttcggatcgtggacaggtcaccgtctaagtcagcccaaggcccaaccctntcgtcactctcgttccccgccctcctccatacctcgtactgagccgggctggcaaggccgcatagnncnnnnnnnnn

SEQ ID NO: 124352 - DNA, 499 bp, Homo sapiens
  misc_feature: GYAE6OF01BF7HR.18.9.A09.1.454.CMB.1.raw
  modified_base (332)..(332): a, c, t, g, unknown or other
  misc_feature (332)..(332): n is a, c, g, or t
  modified_base (420)..(420): a, c, t, g, unknown or other
  misc_feature (420)..(420): n is a, c, g, or t
  modified_base (485)..(486): a, c, t, g, unknown or other
  misc_feature (485)..(486): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (494)..(496): a, c, t, g, unknown or other
  misc_feature (494)..(496): n is a, c, g, or t
  modified_base (498)..(498): a, c, t, g, unknown or other
  misc_feature (498)..(498): n is a, c, g, or t
tcagtacgagtatgcacgaccggtgctcgatttagcgagacgcgcagggttcctgggcccagtctgtgctgacgcagccgcctcagtgtctgggccccagggcagagggtcaccatctcctgcactgggagcacctcaacatcggggcggttatgatgtacactggtaccagcagctttccagggtacagcccccgaaatccgtcatctttggtagcaacgatcggccctcgaggggtccctgaccgtattctctggctccgaagtctggccacctcagcctccctggccatcactgggctccaggctggaggatgaggctgacttattacngccagtcctatgacagtgagctgacgttggttcgtatgtcttggatcgtggaccagtcacgtctaagtcagcccaaggcccaaccctntgtcacgtcgtcgtcccgcctcctccatacctcgtactgacgcggtctcggacaggtcgcatcgnncngtcncnnngnc

SEQ ID NO: 124353 - DNA, 479 bp, Homo sapiens
  misc_feature: GYAE6OF01CQENC.18.9.A09.1.454.CMB.1.raw
  modified_base (468)..(469): a, c, t, g, unknown or other
  misc_feature (468)..(469): n is a, c, g, or t
  modified_base (471)..(479): a, c, t, g, unknown or other
  misc_feature (471)..(479): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctcctggccatcactgggctccaggctgagatgagctgactatactgccagtcctatgacatgagctgagtggtctatgtctcgatcgtggacaagtcaccgtctaagtcacgcccaaggccacccctctcgtcactctcgttcccgcctcctccatacctcgtactgacgcggctcggcaaggcgcataggnngnnnnnnnnn

SEQ ID NO: 124354 - DNA, 700 bp, Homo sapiens
  misc_feature: GYAE6OF01DTP5X.18.9.A09.1.454.CMB.1.raw
  modified_base (376)..(376): a, c, t, g, unknown or other
  misc_feature (376)..(376): n is a, c, g, or t
  modified_base (527)..(527): a, c, t, g, unknown or other
  misc_feature (527)..(527): n is a, c, g, or t
tcagtacgagtatgcacgaccggtgctcgatttagcgagacgcgcgacgggtcctcgggcccgagtcctgtgcttgacgcagccgccctcagtgtctgggccccagggcagagggtcaccatctcctgcactgggagcaccgttccaacatcggggacgggtttaatgactgtacactggtaccagcagcttccgagggacgacgccccctaaaactcctcactcgttttcggtagcaaacaatccggcccttcgacggggtcccctgaccgtattcctctcggtctccaagtctcggcacctcacgcctcccgtcggcctaatccgacggtgggcctccggaggtcttgaaggtatggaggtctgtactattacncgacctagtcctagcgactagtggacggtctgtacgtcggtttacgtatacgttaccgtacggactacgtacgggaccctaaaggttccaaacccggtttcctaaaggtaccaaaccggtaccccgaaacggtccccctaaacccccgttntaccggtacctacccgttccgttccggttaccccccgtccctttacccgttaccctacgttacccgttcggttaccgtaggtaccgggccggggtaccttacgggtaacccgaaaggggtccgtaccggttaagttaaccggtctaagtccgacgtacgtacagactgtcacg

SEQ ID NO: 124355 - DNA, 491 bp, Homo sapiens
  misc_feature: GYAE6OF01ATHCZ.18.9.A09.1.454.CMB.1.raw
  modified_base (433)..(433): a, c, t, g, unknown or other
  misc_feature (433)..(433): n is a, c, g, or t
  modified_base (453)..(453): a, c, t, g, unknown or other
  misc_feature (453)..(453): n is a, c, g, or t
  modified_base (481)..(491): a, c, t, g, unknown or other
  misc_feature (481)..(491): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctcctggccatcactgggctccaggctgaggatgaggctgactattactgccagtcctatgacatgagctggagtggttcgtatgtcttggatcgtgggaccaggtcaccgtctaagtcacgcccaaggcccaaccctctcgtcactctcgttccccncctcctccatacctcgtacnggagcggctggacgtaaggcgacatagnnnnnnnnnnn

SEQ ID NO: 124356 - DNA, 481 bp, Homo sapiens
  misc_feature: GYAE6OF01ENOP2.18.9.A09.1.454.CMB.1.raw
  modified_base (322)..(322): a, c, t, g, unknown or other
  misc_feature (322)..(322): n is a, c, g, or t
  modified_base (474)..(481): a, c, t, g, unknown or other
  misc_feature (474)..(481): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtcccctgaccgattctctggctccaagtctggcacctcagcctccctggccatcactgggctccaggctgaggatgagctgacttanactgccagtcctatgacatgaggctgagtggttctatgtcttcggatctgggaccaaggtcaccgtctaagtcagcccaaggcccaaccctctgtcactctcgtcccaccctcctccatacctcgtactgagcggctggcaaggcgcatagnnnnnnnn

SEQ ID NO: 124357 - DNA, 566 bp, Homo sapiens
  misc_feature: GYAE6OF01CST7N.18.9.A09.1.454.CMB.1.raw
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
  modified_base (558)..(566): a, c, t, g, unknown or other
  misc_feature (558)..(566): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtancaacaatcggccctcaggggtccctgaccgattctctggctcccaagtctggcacctcacgcctccctggccatccactgggcctccaggctgaggntgacggctgactattactcgcctagtcctaatcgactagtgaggtctggtaagttggtttacgtagtcgttcgttcggacttcgtacgggtacctaagggtccaaccgttcccttaaaggtccaacggccccaacggaccctaacccctcgtacgtcctaccctcttaccgttccccgcccttcccgtcctactacctcgtacgtgacggccggactcggacgtaacggccgacgtaataggctannnnnnnnn

SEQ ID NO: 124358 - DNA, 489 bp, Homo sapiens
  misc_feature: GYAE6OF01DBQK7.18.9.A09.1.454.CMB.1.raw
  modified_base (367)..(367): a, c, t, g, unknown or other
  misc_feature (367)..(367): n is a, c, g, or t
  modified_base (458)..(458): a, c, t, g, unknown or other
  misc_feature (458)..(458): n is a, c, g, or t
  modified_base (481)..(489): a, c, t, g, unknown or other
  misc_feature (481)..(489): n is a, c, g, or t
tcagtacgagtatgcacgaccggtgctcgatttagcgagacgcgcagggtcctgggcccagtctgtgctgacgcagccgccctcagtgtctggggtcccagggcagagggtcaccatctcctgcactgggagcacctccaacatcggggcgggttatgatgtacactggtaccagcagcttccagggacagcccccaaaatcctcatctttggtagcaacaatcggccctcaggggtccctgaccgattctctggctccaagtctggcacctcagcctccctggccatcactgggctccaggctgaggatgaggctgactatactgccagtcctatgacatgaggctgagtggtttcatgtctcggntcgtgggaccaaggtcaccgtctaagtcacgcccaaggcccaaccctctcgtccactccttcgttccccacccttcctccatcctcgtacngacgcggctggcaggcgcatagnnnnnnnnn

SEQ ID NO: 124359 - DNA, 506 bp, Homo sapiens
  misc_feature: GYAE6OF01AVLSR.18.9.A09.1.454.CMB.1.raw
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (502)..(506): a, c, t, g, unknown or other
  misc_feature (502)..(506): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggagcaacaatcggccctcaggggtccctgaccgattcnctggctccaagtctggcacctcacgcctccctggccatcactgggctccaggctgagatgaggctgactatactgccagtcctangacatgagctgagtgttcgtatgtcttcggatcgtgggaccaaggtccaccgtctaagtcacgcccaaggccaaccctntgtccactctcgttcccgcccttccnccatacctcgtactggacgccgggtctgggaccaagggccgactagtacggnacgncgcncnnnnn

SEQ ID NO: 124360 - DNA, 608 bp, Homo sapiens
  misc_feature: GYAE6OF01C894D.18.9.A09.1.454.CMB.1.raw
  modified_base (262)..(262): a, c, t, g, unknown or other
  misc_feature (262)..(262): n is a, c, g, or t
  modified_base (589)..(589): a, c, t, g, unknown or other
  misc_feature (589)..(589): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagtacgagtatgcacgaccggtgctcgatttagcgagacgcgcagggtcctgggcccagtctcgtgcttgacgcagcccgcccttcgagtgtctggggccccagggcagagggtcaccatctcctgcactgggagcacctccaacagttcggggcgggttatgattgtacactggtaccagcagcttccgagggacacgcccccaaactccgtcatctttcggtagcaacgaactccggccctcacgggtccctgaccgntctctggctccagtctggctacctcacgcctccctggccatccgactcgggcctccgaggcgtggaggatggagtctagactattactgcctagttcctatagaacatgagtctagtagttggtttcgtagttgtacgttcggtatcgtacgggacctaagtcccaaccgtcgtaagccacgaccccgaacgcccctaaccccttcgtacgttacctaccttccgttaccgttcccccgcccttacctacctacttaccgtccgtacgttcggacggtccgggtctacgggacctaaggggcccgtaacgtaggtaaggcttacggngacgtcgacgtgcngngcg

SEQ ID NO: 124361 - DNA, 480 bp, Homo sapiens
  misc_feature: GYAE6OF01DZVBR.18.9.A09.1.454.CMB.1.raw
  modified_base (339)..(339): a, c, t, g, unknown or other
  misc_feature (339)..(339): n is a, c, g, or t
  modified_base (433)..(433): a, c, t, g, unknown or other
  misc_feature (433)..(433): n is a, c, g, or t
  modified_base (474)..(480): a, c, t, g, unknown or other
  misc_feature (474)..(480): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctcctggccatcactgggctccaggctgaggatgagctgactattactgccagtcctatgacntgagctgagtgtcgtatgtcttcggatcgtgggaccaaggtcaccgtctaagtcacgcccaaggcccaaccctctcgtccactctccgttcccnccctcctccatctcgtactgacgcggctggcaagcgcatannnnnnn

SEQ ID NO: 124362 - DNA, 610 bp, Homo sapiens
  misc_feature: GYAE6OF01EM29R.18.9.A09.1.454.CMB.1.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (326)..(326): a, c, t, g, unknown or other
  misc_feature (326)..(326): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
  modified_base (607)..(608): a, c, t, g, unknown or other
  misc_feature (607)..(608): n is a, c, g, or t
  modified_base (610)..(610): a, c, t, g, unknown or other
  misc_feature (610)..(610): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactggaaccagcagtgacgttggtggttataactatgtctcctggtaccaacagcacccaggcaaagccccaaactcatgatttatgatgtcactaatcgcctnagggtttctaatcgcttctctggctccaagtctggacaacacggcctccngaccatctcgtggctccgaggctggaggacgaggctgtattattacgtnacagtctacataactacaagcacagctaactctctatgtcgttacggaacgtcggacctaagggtccaacccggttccgttaacgggtccaaccggaccccgaaacggacccccaaacccccgtcgtacgtccctaaccttcccgttacccgttacccccaccccttcccgttacctaaccgttaccgtacccgtttaacgtcggaaccggtccggggaccgttagggaacccggtaaacgggccgtaccgtaaacgttagccgtgcgtacgctcncancnngn

SEQ ID NO: 124363 - DNA, 496 bp, Homo sapiens
  misc_feature: GYAE6OF01BCGY1.18.9.A09.1.454.CMB.1.raw
  modified_base (486)..(487): a, c, t, g, unknown or other
  misc_feature (486)..(487): n is a, c, g, or t
  modified_base (489)..(490): a, c, t, g, unknown or other
  misc_feature (489)..(490): n is a, c, g, or t
  modified_base (492)..(496): a, c, t, g, unknown or other
  misc_feature (492)..(496): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcactcagcctcctggccatcactggggcctccaggctgaggatgaggctgactattactgccagtcctatgacagtgaggctgagtggttcgtatgtcgttggatcgtggaccaggtccaccgtctaagtcacgacccacggcccaaccctctcgtcactctcgttccccaccctcctccactacctcgtactgacgcggctggacgacggcgcatagnngnncnnnnn

SEQ ID NO: 124364 - DNA, 597 bp, Homo sapiens
  misc_feature: GYAE6OF01EBSPR.18.9.A09.1.454.CMB.1.raw
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(585): a, c, t, g, unknown or other
  misc_feature (584)..(585): n is a, c, g, or t
  modified_base (593)..(597): a, c, t, g, unknown or other
  misc_feature (593)..(597): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcaacttccaggaacacgccccaaattgtcatctatggtaacaataatccggccctcgacggggtccctgcccgtattcctcgtcggctccaagttctggccacctcacgcctcctggccatcacgtcgggctccgaggctgatgatgagctgattattactcgcctagtcctagtcgaactactaatctacgtaggtgggtcgtgggggttcttcggggcgggacgggaccgtaggcgtcggaccggtcggtcgggtccacggacccgaacggtcccgtccgtcccccgttcggtccctaccgttcccttccgtttcccctaccccgttccctaccctaacttaccgttccgtaccgttcggacggtccgggtcgtcgggaccgtaacgggccgacgtagtcgatncncnncgtcgacnnnnn

SEQ ID NO: 124365 - DNA, 491 bp, Homo sapiens
  misc_feature: GYAE6OF01EM45I.18.9.A09.1.454.CMB.1.raw
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
  modified_base (482)..(491): a, c, t, g, unknown or other
  misc_feature (482)..(491): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccacgggacagcccccaaaactcctcatctttggtagcaacaatcggccctcaggggtccctgaccgattctctggctccaagtctggcacctcagcctccctggccatcactgggctccaggctgaggatgagctgactattactgccagtcctatgacatgaggctgagttggttcgtatgtcttcggatcgtgggaccaggtcaccgtcctaagtcacgcccaagcccaacccctntcgtcactctcgttcccnccctcctccatacctcgtactgacgcggctggcaaggcgcatagnnnnnnnnnn

SEQ ID NO: 124366 - DNA, 589 bp, Homo sapiens
  misc_feature: GYAE6OF01BB2FQ.18.9.A09.1.454.CMB.1.raw
  modified_base (313)..(313): a, c, t, g, unknown or other
  misc_feature (313)..(313): n is a, c, g, or t
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
  modified_base (584)..(589): a, c, t, g, unknown or other
  misc_feature (584)..(589): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacacgcccccaaaactcctcatctttggtagcaacaatcggccctcgacggggtccctgaccgattctctggctccaagtctggcacctcagccctcctggccatcactgggctccaggctgagntgagctgactattactgccagtcctatgactatggaggcttggaggttcgggttcgtagttcgtcgtttcgggattcggtagggaaccctaggtcctaaccgttacctaacgtcaacgaccccgaagggcccctaaaccccttcgtacgtaccctaccgttccttccggttcccccgccccttccctaccctacgtttacccgttccgttacctggaccgggtccggggtcttacggggaccaaacggggccacgtaattacggnncngcnnnnnn

SEQ ID NO: 124367 - DNA, 480 bp, Homo sapiens
  misc_feature: GYAE6OF01BIVK1.18.9.A09.1.454.CMB.1.raw
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
  modified_base (473)..(480): a, c, t, g, unknown or other
  misc_feature (473)..(480): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtacctgaccgattctctggctccaagtctggcacctnagcctccctggccatcactgggctccaggctgaggatgaggctgactattacngccagtcctatgacatgaggctgagtggttcgtatgtcttcggatcgtgggaccaggtcaccgtcctaggtcagcccagcccaacccnctttcactctcgttcccnccctcctccatacctcgtactgagcggctggcaggcncatgnnnnnnnn

SEQ ID NO: 124368 - DNA, 503 bp, Homo sapiens
  misc_feature: GYAE6OF01DS9D2.18.9.A09.1.454.CMB.1.raw
  modified_base (332)..(332): a, c, t, g, unknown or other
  misc_feature (332)..(332): n is a, c, g, or t
  modified_base (444)..(444): a, c, t, g, unknown or other
  misc_feature (444)..(444): n is a, c, g, or t
  modified_base (493)..(495): a, c, t, g, unknown or other
  misc_feature (493)..(495): n is a, c, g, or t
  modified_base (497)..(503): a, c, t, g, unknown or other
  misc_feature (497)..(503): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggcctccaagtctggccacctcacgccctccctggccatccactgggcctccgaggctgaggatgaggctgactatacngccagtcctatgacagtgagctgagtgttcgtatgtcttcggatcgtggacctaggtcaccgtctaagcacgcccaagcccaacccctctcgtccaccttcttccgtccccnccctcctccactacctcgtactcgacgccggctcggcaacggcgcatgnnncnnnnnnn

SEQ ID NO: 124369 - DNA, 488 bp, Homo sapiens
  misc_feature: GYAE6OF01DILON.18.9.A09.1.454.CMB.1.raw
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(488): a, c, t, g, unknown or other
  misc_feature (481)..(488): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgccccccaaactcctcatctttggtagcaacaatcggcccctcgaggggtccctgaccgattctctggctccaagtctggcaccctcacgccctcccgtggccatccacgtggggcctccgaggctgaggatggaggctgactattactgccagtcctangacntgagctgngtggttctntgtctcggntcgtggaccaagtcaccgtctaagcacgacccagcccaccctntcgtcactctccgtcccncctccncctatctcgtacngngcggcngcgagcgnangnnnnnnnn

SEQ ID NO: 124370 - DNA, 490 bp, Homo sapiens
  misc_feature: GYAE6OF01CJEA9.18.9.A09.1.454.CMB.1.raw
  modified_base (417)..(417): a, c, t, g, unknown or other
  misc_feature (417)..(417): n is a, c, g, or t
  modified_base (481)..(490): a, c, t, g, unknown or other
  misc_feature (481)..(490): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagccctccctggccatcactgggcctccaggctgaggatggaggctgactattactgccagtcctatgacatgagctgagtggttcgtatgtcttcggatcgtgggaccaggtcaccgtctaagtcagcccaaggcccaaccctntcgtcactctcgttccccaccctcctccatactctactgacgcggctcggcgaaggcgcatagnnnnnnnnnn

SEQ ID NO: 124371 - DNA, 479 bp, Homo sapiens
  misc_feature: GYAE6OF01CS70U.18.9.A09.1.454.CMB.1.raw
  modified_base (322)..(322): a, c, t, g, unknown or other
  misc_feature (322)..(322): n is a, c, g, or t
  modified_base (471)..(479): a, c, t, g, unknown or other
  misc_feature (471)..(479): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctcctgccatcactgggctccagctgaggatgaggctgactattacngccagtcctatgacatgagctgagtggttcgtatgtcttcggatcgtgggaccaaggtcaccgtctaagtcagcccagcccaaccctctgtcactctcgttcccaccctcctccactactcgtactgagcggctggcaggcgacatagnnnnnnnnn

SEQ ID NO: 124372 - DNA, 678 bp, Homo sapiens
  misc_feature: GYAE6OF01BMGUD.18.9.A09.1.454.CMB.1.raw
  modified_base (665)..(666): a, c, t, g, unknown or other
  misc_feature (665)..(666): n is a, c, g, or t
  modified_base (668)..(668): a, c, t, g, unknown or other
  misc_feature (668)..(668): n is a, c, g, or t
  modified_base (670)..(672): a, c, t, g, unknown or other
  misc_feature (670)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcgggggcgggttatgatgtacactggtaccagcagcttccagggacacgcccccaaactcctcatctttggtagcaacaatccggccctcgacggggtccctgaccgattctctggctccaagtctggcacctcacgcctccctggccatccacgtgggctccgaggctaggaggatggaggctagacttattacctgcctagttacctatacgacagtggaggcttggtaaggttgggtttaccgtagttcggttaccgtttacgggtacgttcggttacggggaacccgtaacgggttacccaacccggttacccgttaacggttccgaaaccggtacccccgtaaacgggtaccccctaacccccgttcctacggttacccttaccttcccgtttaacccgtttccccctaaccccttcccctaccctaaccgtttacccgttccgttaaccgtcgggtaccgggtcccggggtccgtacggggaccgtaaaccggggccgtacgtaggtaacgcgtanncncnnncngngn

SEQ ID NO: 124373 - DNA, 484 bp, Homo sapiens
  misc_feature: GYAE6OF01DEYWG.18.9.A09.1.454.CMB.1.raw
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (474)..(484): a, c, t, g, unknown or other
  misc_feature (474)..(484): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccccaaaactcctcatctttggtagcaaacaatccggccctcgacggggtccctgaccgattctctggctccaagtctggcacctcagcctccctggccatcactgggctcgagctgagatgagctgactatactgcagtcctatgacactaatctcagttggtcgtggggtcttcgggcggagggccaggctgaccgtcgtgggtcacgccagctcgccctcggtcnctctcgtcccnccctcctccatactcgtctgagcggcnggcaggcgnagtagnnnnnnnnnnn

SEQ ID NO: 124374 - DNA, 497 bp, Homo sapiens
  misc_feature: GYAE6OF01E4UZ8.18.9.A09.1.454.CMB.1.raw
  modified_base (481)..(481): a, c, t, g, unknown or other
  misc_feature (481)..(481): n is a, c, g, or t
  modified_base (488)..(490): a, c, t, g, unknown or other
  misc_feature (488)..(490): n is a, c, g, or t
  modified_base (492)..(497): a, c, t, g, unknown or other
  misc_feature (492)..(497): n is a, c, g, or t
tcagtacgagtatgcacgaccggtgctcgatttagcgagacgcgcagggtcctgggcccagtctgtgctgacgcagccgccctcagtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactggaccaagtcaccgtctaggtcacgcccaaggcccaaccccactgtccactctcgttccccgccctccctccatacctctactcggacggccgggtctcggacgaacgggcncaagtgnnncnnnnnn

SEQ ID NO: 124375 - DNA, 469 bp, Homo sapiens
  misc_feature: GYAE6OF01DY83N.18.9.A09.1.454.CMB.1.raw
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
  modified_base (464)..(469): a, c, t, g, unknown or other
  misc_feature (464)..(469): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaaactcctcatctttggtancaacaatcggccctcaggggtccctgaccgattctctggctccaagtctggcacctcagcctccctgccatcactgggctccaggctgagntgagctgactattactgccagtcctatgacatgagctgagtgttctatgtcttcggatcgtggaccaaggtcaccgtctaagtcagcccaagccaaccctntcgtcactctcgtcccacctcctcatctcgtacngagcggctgcaggcgcatagnnnnnn

SEQ ID NO: 124376 - DNA, 498 bp, Homo sapiens
  misc_feature: GYAE6OF01D4OAS.18.9.A09.1.454.CMB.1.raw
  modified_base (332)..(332): a, c, t, g, unknown or other
  misc_feature (332)..(332): n is a, c, g, or t
  modified_base (489)..(498): a, c, t, g, unknown or other
  misc_feature (489)..(498): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagccccccaaactcctcatctttggtagcaacaatccggccctcgagggggtccctgaccgattctctggctccaagtctggcacctcacgcctccctggccatccactgggcctccgaggctgaggatgagctgactattacngccagtcctatgacatgagctgagttggttcgtatgttcttcggatcgtggaccaggtcaccgtctaagtcacgcccaagcccaaccctctcgtccactctcgttccccgcccttccctcactcctcgtactggacgcggctggcaaggcgcatagnnnnnnnnnn

SEQ ID NO: 124377 - DNA, 533 bp, Homo sapiens
  misc_feature: GYAE6OF01DJGTU.18.9.A09.1.454.CMB.1.raw
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (435)..(435): a, c, t, g, unknown or other
  misc_feature (435)..(435): n is a, c, g, or t
  modified_base (523)..(523): a, c, t, g, unknown or other
  misc_feature (523)..(523): n is a, c, g, or t
  modified_base (525)..(533): a, c, t, g, unknown or other
  misc_feature (525)..(533): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacacgcccccaaaactcctcatctttggagcaacaatccggccctcgaggggtccctgaccgtattctctggctccaagtctggcacctcacgccctccctggccatccacgtcgggcctccgaggctggaggatggaggctgaactatacngccagtcctatgacngtgaggctgagtgttacgtatgtcttcggatcgtgggacctaaggtccaaccgttctaagtcacgccccaagccctaaccctntcgtcctacttcctccgttccccacccttccctacctacttaccgtccgtactggacggcggtcctggaccgtaagggccacataggnannnnnnnnn

SEQ ID NO: 124378 - DNA, 513 bp, Homo sapiens
  misc_feature: GYAE6OF01D4MYK.18.9.A09.1.454.CMB.1.raw
  modified_base (216)..(216): a, c, t, g, unknown or other
  misc_feature (216)..(216): n is a, c, g, or t
  modified_base (502)..(502): a, c, t, g, unknown or other
  misc_feature (502)..(502): n is a, c, g, or t
  modified_base (504)..(513): a, c, t, g, unknown or other
  misc_feature (504)..(513): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtancaacaatcggccctcgacggggtccctgaccgattctctggctccaagtctggcacctcagcctccctgccatcacgtggctccgaggctggaggatggagctgactattactgccagtcctatgacagtgaggtctgaggttggttcgtatgttcttacgggatcgtagggaccaaggtccaccgtctaagtcacgcccaacgcccaaccctctgtcactcctcgttccccaccctcctacctactacctacgtactggacgcgggactcggacgaaggcgacangnnnnnnnnnn

SEQ ID NO: 124379 - DNA, 502 bp, Homo sapiens
  misc_feature: GYAE6OF01EKLF0.18.9.A09.1.454.CMB.1.raw
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
  modified_base (413)..(413): a, c, t, g, unknown or other
  misc_feature (413)..(413): n is a, c, g, or t
  modified_base (486)..(486): a, c, t, g, unknown or other
  misc_feature (486)..(486): n is a, c, g, or t
  modified_base (494)..(502): a, c, t, g, unknown or other
  misc_feature (494)..(502): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggcccctcgaggggtccctgaccgattctctggctccaagtctggcacctcagcctccnggccatcactgggctccaggctgagatggagctgactattacngccagtcctatgacatgagctgagttggtcgtatgtctcggatcgtgggaccaggtccacgtctaagcagcccaaggccaaccctctntcctacttcctcgtccccgcccttcctaccctattaccgtcgtaactcggacggtcggctggccaaggccganatagcagnnnnnnnnn

SEQ ID NO: 124380 - DNA, 495 bp, Homo sapiens
  misc_feature: GYAE6OF01AFIMJ.18.9.A09.1.454.CMB.1.raw
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
  modified_base (486)..(495): a, c, t, g, unknown or other
  misc_feature (486)..(495): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgattattactgccagtcctatgacactaatctcagtggtcgtgggggtcttcgggcggagggaccnggctgaccgtgtgggtcagcccgaaggccncgccccgtgtccactctcgttcccaccctcctcctactcctcgtactgacgccgggctggcacggcgcgagtgnnnnnnnnnn

SEQ ID NO: 124381 - DNA, 551 bp, Homo sapiens
  misc_feature: GYAE6OF01B1HU9.18.9.A09.1.454.CMB.1.raw
  modified_base (326)..(326): a, c, t, g, unknown or other
  misc_feature (326)..(326): n is a, c, g, or t
  modified_base (537)..(537): a, c, t, g, unknown or other
  misc_feature (537)..(537): n is a, c, g, or t
  modified_base (539)..(540): a, c, t, g, unknown or other
  misc_feature (539)..(540): n is a, c, g, or t
  modified_base (542)..(551): a, c, t, g, unknown or other
  misc_feature (542)..(551): n is a, c, g, or t
tcagtacgagtatgcacgaccggtgctcgatttagcgagacgcgcagggtcctgggcccagtctgtgctgacgcagccgccctcagtgtctggggccccaggggcagagggtcaccatctcctgcactgggagcacctccaacagtcggggcgggttatgatgtacactggtaccagcagcttccagggacacgacccccaaactcctcatctttaggagcaaacaatccggccctcgagggggtccctgacccgattctctggctccaagtctggccactcacgccctcctcgaccatcactgggctccaggctgagatggagcngtactattactgcctagtcctatcgactatggagtctggtagttgggttacttatggttcttacgggtatcgtagggaaccaaggtccaacccgttactaagtccacgacccgaacggacccctaccctcgttgtcccacttccgtccgttaccccaccctaccctcaacttacctcgtactcggacgtcgggctcggacgaaggccgtananncnnnnnnnnnn

SEQ ID NO: 124382 - DNA, 547 bp, Homo sapiens
  misc_feature: GYAE6OF01EB7L2.18.9.A09.1.454.CMB.1.raw
  modified_base (535)..(547): a, c, t, g, unknown or other
  misc_feature (535)..(547): n is a, c, g, or t
tcagtacgagtatgcacgaccggtgctcgatttagcgagacgcgcagggtcctgggcccagtctgtgctgacgcagccgccctcagtgtctgggccccagggcagaggtcaccatctcctgcactgggagcacctccaacatcggggcgggttatgatgtacactggtaccagcagcttccagggacacgcccccaaacttgtcatctataggtaacaataatcggccctcgacggggtccctgcccgattctctggcctccaagtctggcacctcacgcctccctggccatccactgggcctccaggctgatgagtgagctgtattattactgccagtcctatcgaactactaatctcgaggttcggtcgttgggggttcttcggggacgggacgggaccgtacggtcgtcggtaccggtcggtcgggtcacggcccgaacggccgtccgccccgttcggtcctaccgttccttcgttccccacccttccactactacctcgtactgacggcggtcgtggcgaggcgagacgtnnnnnnnnnnnnn

SEQ ID NO: 124383 - DNA, 536 bp, Homo sapiens
  misc_feature: GYAE6OF01ASJGD.18.9.A09.1.454.CMB.1.raw
  modified_base (327)..(327): a, c, t, g, unknown or other
  misc_feature (327)..(327): n is a, c, g, or t
  modified_base (528)..(528): a, c, t, g, unknown or other
  misc_feature (528)..(528): n is a, c, g, or t
  modified_base (530)..(531): a, c, t, g, unknown or other
  misc_feature (530)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggagcaacaatccggccctcgaggggtccctgaccgattctctggctccaagtctggcacctcagcctccctggccatcactgggctccaggctgaggatgaggctgactattacngccagtcctatgacagtgaggtctggagtgttacgtatcgtcgttcggattcgtgggacctaaggtcaccgtctaagtcacgcccaagccctaaccctctcgtccaccttcttccgttccccaccttcctcctactaccttcgtactggacggccggtctcgggaccaacggggccgtacgaagttacggctcgcgtgacncnncngnc

SEQ ID NO: 124384 - DNA, 724 bp, Homo sapiens
  misc_feature: GYAE6OF01CZXZW.18.9.A09.1.454.CMB.1.raw
  modified_base (221)..(221): a, c, t, g, unknown or other
  misc_feature (221)..(221): n is a, c, g, or t
  modified_base (713)..(713): a, c, t, g, unknown or other
  misc_feature (713)..(713): n is a, c, g, or t
  modified_base (715)..(717): a, c, t, g, unknown or other
  misc_feature (715)..(717): n is a, c, g, or t
  modified_base (719)..(724): a, c, t, g, unknown or other
  misc_feature (719)..(724): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagccacctccaacagtcgggggcgggtttatgatgtacactggtaccagcagccttccgagggacacgcccccaaatcctcatctttggtancaacactccggcccttcgacggggtcccctgaccgtactttctcgtcggcctaccaagtccgtcggccaccctcaccgtccctcccgtggccttatcctaccgtcggggccttccgaggcttacggaggtagtggaaggtctaggtacttacgttacgtcgacctacgttacctagtacgactagtcggaacggtctgggtacgtttcgggtttacgttagtttggttaccgttcgggttacgttaccggttaacggggacccgtaacggttcccgtaacccggttacgttaacgggtaccgaacccggtaaccccgaacccgggacccctaaccccgtacgttacccggttacccaccgttttccgtaccccggtttccccccgtaccccctttacccgtaccccttaagtttaccccgttaccgtttaccggtacgggcccgggtacggggtaccgtacgggaccgaaacgggccaaccggtattacggngnnncnnnnnn

SEQ ID NO: 124385 - DNA, 629 bp, Homo sapiens
  misc_feature: GYAE6OF01BXQGE.18.9.A09.1.454.CMB.1.raw
  modified_base (335)..(335): a, c, t, g, unknown or other
  misc_feature (335)..(335): n is a, c, g, or t
  modified_base (617)..(617): a, c, t, g, unknown or other
  misc_feature (617)..(617): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(629): a, c, t, g, unknown or other
  misc_feature (626)..(629): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactgtaccagcagcttccagggacacgcccccaaactcctcatctttggtagcaacaatccggccctcacggggtccctgaccgtattctctggctccaagtcctggcacctcacgccctccgtggccatcactcgggctccgaggctgaggatgaggctgaacttattacncgcagtcctatgactagtggaggcttaggagttggtttccgtagttcgttcgtttcggattcggtacgggaacctaagggtcctaccgtaccgtaagtccgaacgtacccgaacgggtcccctaaaccccgtcgttacgttaccctcctttcgttcccggtttaccccccaaccccctttacccgttcccctaacgtttaacccgttacccggttaactcggggtaccggaccgggggtcccttacggggacccgaaacgggcccgtaccgtaggtaccggncgncncnannnn

SEQ ID NO: 124386 - DNA, 508 bp, Homo sapiens
  misc_feature: GYAE6OF01E09XN.18.9.A09.1.454.CMB.1.raw
  modified_base (215)..(215): a, c, t, g, unknown or other
  misc_feature (215)..(215): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (498)..(508): a, c, t, g, unknown or other
  misc_feature (498)..(508): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatcttggtancaacaatcggccctcaggggtccctgaccgattctctggctccaagtctggcacctcacgccctccctggcccatccacgtcgggcctccaggctggaggntggagctgactattacngccagtcctatgacatgaggctggagttggttcgtatgttctcggatcgtggacaggtctaccgtctaagtcagcccaacgcccaaccctntctctacttcctcgttcccncccttcctcctactactccgtactcggacggcggcgtcggacacggcgcatagnnnnnnnnnnn

SEQ ID NO: 124387 - DNA, 578 bp, Homo sapiens
  misc_feature: GYAE6OF01D6DCI.18.9.A09.1.454.CMB.1.raw
  modified_base (330)..(330): a, c, t, g, unknown or other
  misc_feature (330)..(330): n is a, c, g, or t
  modified_base (457)..(457): a, c, t, g, unknown or other
  misc_feature (457)..(457): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (572)..(578): a, c, t, g, unknown or other
  misc_feature (572)..(578): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacagtcggggcgggttatgatgtacactggtaccagcagcttccagggacacgcccccaaaactcctcatctttggtagcaacaatcggccctcacggggtccctgaccgattctctggctccaagtctggccacctcagcctccctgccatcactgggctccgaggctggagatggagctgactattacngccagtcctagtcgacagtgaggtcttggagttggtttctagtcgttcgttacggatcggtacgggaaccaaggttccaaccggttaccgtaagtccaacgtaccccaacggtcccctaaacccctntcgtacctaccttccttccttcccctaccccttcccgtacctaacgttaccttaccggttacttcggacggtcccgggtcttcggaccgaacgggtccgtacgtatcggnngncnnnnnnn

SEQ ID NO: 124388 - DNA, 645 bp, Homo sapiens
  misc_feature: GYAE6OF01ALZ10.18.9.A09.1.454.CMB.1.raw
  modified_base (630)..(630): a, c, t, g, unknown or other
  misc_feature (630)..(630): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(645): a, c, t, g, unknown or other
  misc_feature (643)..(645): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttggtagcaaacaatccggccctcgacggggtcccctgaccgtattcctctggcctccaagtcctggccacctcacgccctccctggccatccacgtcgggcctccgaggctggaggatggaggctgacttattactgcctagtcctagtcgacagtggaggtcgtggaggtttggttacgtagttcgttcgttcgggtattccggtagggaaccctaagggttcccacccggttactaaacgtccgaaccggtaccccaaccgggccccctaaaccccgttcgtaccggttccctaaccgtttcccgttacccgttacccccctacccctttccccttaccctaactttacccgttaccgttaccgtacggaccgggtccggggtctacgggaccgtaacgggccgtaacagttacgnacgnacncnancnnn

SEQ ID NO: 124389 - DNA, 519 bp, Homo sapiens
  misc_feature: GYAE6OF01A7GQD.18.9.A09.1.454.CMB.1.raw
  modified_base (325)..(325): a, c, t, g, unknown or other
  misc_feature (325)..(325): n is a, c, g, or t
  modified_base (487)..(487): a, c, t, g, unknown or other
  misc_feature (487)..(487): n is a, c, g, or t
  modified_base (509)..(519): a, c, t, g, unknown or other
  misc_feature (509)..(519): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattacngccagtcctatcgacatgaggctggagttggttcgtatgtcttggatcgtacgggaccaggtccaccgtctaagtcacgcccacggacccaacccctctacgtccactcgtccgtttccccgccccttcctccgtactacctccgtactcggacgcgggtcncgggcgaaggccgactatacgnnnnnnnnnnn

SEQ ID NO: 124390 - DNA, 693 bp, Homo sapiens
  misc_feature: GYAE6OF01EMTOX.18.9.A09.1.454.CMB.1.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (687)..(689): a, c, t, g, unknown or other
  misc_feature (687)..(689): n is a, c, g, or t
  modified_base (691)..(693): a, c, t, g, unknown or other
  misc_feature (691)..(693): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacagtcgggggcgggttatgatgtacactggtaccagcagcttccgagggacacgcccccaaactcctcattcgttggtanacaaacactccggccctcggacggggtccctgaccgtntttcctcgtggcctccgaagtcctcggccacctcacgtccctcccgtggccatccgacgtcgggcctccgaggtccgtggacggagtcggacggtctaggtaacctttattaccgcgtacccgtaagttccctaagtacgaactagtaggacggtcgttaggtagggtttcggtttacgtagttcggttccgttgggacgttcggtacgggtaaccctaacgggtccctaaccggttacctaacggttccgaacccgtaaccccggaacccggtcccctaacccgttcgttacggtaccctacccgtttcccgttcccgttcccccgtccccttaccctaccctaagttacccgttaccgtacgtacgggacggtcccgggtacgtacgggaacccgtacggccgtacgaagtcgcaggtcacgtcnnncnnn

SEQ ID NO: 124391 - DNA, 483 bp, Homo sapiens
  misc_feature: GYAE6OF01A0CJJ.18.9.A09.1.454.CMB.1.raw
  modified_base (410)..(410): a, c, t, g, unknown or other
  misc_feature (410)..(410): n is a, c, g, or t
  modified_base (472)..(483): a, c, t, g, unknown or other
  misc_feature (472)..(483): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccccaaactcctcatctttggtagcaacaatcggccctcaggggtccctgaccgattctctggctccaagtctggcacctcagcctccctgaccatctctgggcctccaggctggaggacgaggctgattatactgcagctcatatacaagcaccagcactctctatgtctcggaactggaccagtcaccgtctagtcacgcccaaggcccaacccnctgtcactctcgttccccgcctcctccactacctcgtactgacgcggctggcaggcgcagtnnnnnnnnnnnn

SEQ ID NO: 124392 - DNA, 496 bp, Homo sapiens
  misc_feature: GYAE6OF01A7QAR.18.9.A09.1.454.CMB.1.raw
  modified_base (328)..(328): a, c, t, g, unknown or other
  misc_feature (328)..(328): n is a, c, g, or t
  modified_base (419)..(419): a, c, t, g, unknown or other
  misc_feature (419)..(419): n is a, c, g, or t
  modified_base (488)..(496): a, c, t, g, unknown or other
  misc_feature (488)..(496): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcagggggtccctgaccgattctctggctccaagtctggccacctcagcctccctggccatcactgggctccaggctgaggatgaggctgactattacngccagtcctatgacatgaggctggagtggttcgtagtgtcttcggatcgtgggactaggtcaccgtctaggtcacgcccaggcccaacccngtcgtcactctcgtccccaccctcctccatcctcgtactggacgcgggctggccaagggcgcataggcnnnnnnnnn

SEQ ID NO: 124393 - DNA, 695 bp, Homo sapiens
  misc_feature: GYAE6OF01CQC28.18.9.A09.1.454.CMB.1.raw
  modified_base (216)..(216): a, c, t, g, unknown or other
  misc_feature (216)..(216): n is a, c, g, or t
  modified_base (335)..(335): a, c, t, g, unknown or other
  misc_feature (335)..(335): n is a, c, g, or t
  modified_base (686)..(686): a, c, t, g, unknown or other
  misc_feature (686)..(686): n is a, c, g, or t
  modified_base (689)..(695): a, c, t, g, unknown or other
  misc_feature (689)..(695): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcgggggcgggttatgatgtacactggtaccagcagcttccagggacacgccccaaatcctcatctttggancaacatccggcctcgacggggtccctgaccgtattctctggctacaagtctggcacctcacgcctccgtggcctatcacgtcgggcctcgaggctgaggatggagtctagactattacncgctacgtctagtgaactagtggaagtcgtaggtaggtttcggttactagttcggttcgttacggtagttaccggtacgggtaaccgtaacgggttacccgtaacccggttacccgttaaacggtaccgtaaacccggacccggtaaacccgggtaaccccctaaaccccccgtttcgttacccggttacccttaacccgtttcccgtttacccccgtttccccccggttacccccctttaccccgttaacccttaaacccgtttaccccgttaccggttacccgttaccgggaccgggtccggggtaccgtacggggaaccgaacgggaccgtacgtaagtacggcagtnacnnnnnnn

SEQ ID NO: 124394 - DNA, 517 bp, Homo sapiens
  misc_feature: GYAE6OF01CBP8I.18.9.A09.1.454.CMB.1.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (429)..(429): a, c, t, g, unknown or other
  misc_feature (429)..(429): n is a, c, g, or t
  modified_base (449)..(449): a, c, t, g, unknown or other
  misc_feature (449)..(449): n is a, c, g, or t
  modified_base (503)..(504): a, c, t, g, unknown or other
  misc_feature (503)..(504): n is a, c, g, or t
  modified_base (507)..(507): a, c, t, g, unknown or other
  misc_feature (507)..(507): n is a, c, g, or t
  modified_base (512)..(517): a, c, t, g, unknown or other
  misc_feature (512)..(517): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacagtcggggcgggttatgatgtacactggtaccagcagcttccagggacacgcccccaaactcctcatctttggtagacaacaatccggccctcgacggggtccctgaccgattctctcggctccaagtctggcacctcagcctccctggccatccactgggcctcgggctgaggntgaggctgactattacngccagtcctatgacatgaggctgagtggttctagtgtcgttcggatcgtagggacctaaggtccaccgtctaagtcacgacccacgcccaaccctntcgtcacttctccgttcccncctcctcctactacctcgtactgcggcggtcgtggacgacggcgactacgtagnnctnacgcnnnnnn

SEQ ID NO: 124395 - DNA, 687 bp, Homo sapiens
  misc_feature: GYAE6OF01BE1M1.18.9.A09.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (536)..(536): a, c, t, g, unknown or other
  misc_feature (536)..(536): n is a, c, g, or t
tcagtacgagtatgcacgaccggtgctcgatttagcgagacgcgcgagggtcctgggcccagtctgtgctgacgcagccgcctcagtgtctgggccccagggcagagggtcaccatctcctgcacgtgggagccacctccaacgagtcgggggcgggttatggatgtaccactggtacccagcagcttccgagggacacgaccccaatcctacagttcttggancaacagtcgcctgacgggtcccngaccgnttcncgtgctcgaagtctgccacctcacgtcctccgtaggcctatccgtacgtcgggccttacccgaggtcctggaggtatcgggtagctagtacttagtacgtgccctagttaccgtatgactagtgacgtcgtaggtagttggtctagttcgttcgtacgtacgtcgtacgggtacctaacggtccgtaacgttccgtaaacggtccaacccggtacccgtaaccggacccctaacccgttcgacgttacccgtaccgtttcccgttcccgggtttccccnccccgttaccccgttaccggttaaaccctccgtttaccggaacgttccgggaaccgggttccgggacggtaaccggtaccggtaaacggggtcccaaggtttaagtacccggcgtacgtacgtacgtacgtacgtacgtacgtcgcgtacg

SEQ ID NO: 124396 - DNA, 607 bp, Homo sapiens
  misc_feature: GYAE6OF01E3CBE.18.9.A09.1.454.CMB.1.raw
  modified_base (593)..(593): a, c, t, g, unknown or other
  misc_feature (593)..(593): n is a, c, g, or t
  modified_base (599)..(600): a, c, t, g, unknown or other
  misc_feature (599)..(600): n is a, c, g, or t
  modified_base (602)..(607): a, c, t, g, unknown or other
  misc_feature (602)..(607): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccagggacacgcccccaaactcctcattctttggtacgcaacaatccggccctgacggggtccctgaccgattctctggcctcaagtctcggcacctcacgccctcccgtggccatccacgtgggcctccgaggctggacggatggaggctgacttattactcgcctagtcctatgactagtggacggtctaggtagtttcgggtttacgtagttcgttccgttcggacgttccgtacgggtaacccgtaacggtccgtaacccgttaccgtaacgtacgtacgaccccgtaacgcccctaaacccctctaccgtacctaccgttcctccgttccccacccgttcctacctacttaccgtcgttacgtcgacgggtccggcgtacgggaccgaacggccgtactagaggtnacgtcnncnnnnnn

SEQ ID NO: 124397 - DNA, 845 bp, Homo sapiens
  misc_feature: GYAE6OF01BTFO7.18.9.A09.1.454.CMB.1.raw
  modified_base (134)..(134): a, c, t, g, unknown or other
  misc_feature (134)..(134): n is a, c, g, or t
  modified_base (276)..(276): a, c, t, g, unknown or other
  misc_feature (276)..(276): n is a, c, g, or t
  modified_base (830)..(830): a, c, t, g, unknown or other
  misc_feature (830)..(830): n is a, c, g, or t
  modified_base (840)..(840): a, c, t, g, unknown or other
  misc_feature (840)..(840): n is a, c, g, or t
  modified_base (842)..(843): a, c, t, g, unknown or other
  misc_feature (842)..(843): n is a, c, g, or t
  modified_base (845)..(845): a, c, t, g, unknown or other
  misc_feature (845)..(845): n is a, c, g, or t
tcagtacgagtatgcacgaccggtgctcgatttagcgagacgcgcagggtcctgggcccagtctgtgctgacgcagcccgccctcagtgtcgtcgggccccagggcagagggtcaccatctcctgcacgtgggncacctccaacagtccggggcggttatgatgtacactggtaccagcagtccttaccgagggaccaccgacccccctaaactcctactattcgttttaggtaagaccaaacaacgtccggccctcgacgggttccctgaccgtnttctcgtcggctccgagttcgtcgccacctcgaccgcccttccgtcggacctacgtccgacgtcgggcctaccgaggtcgtaggaacggtagtacggacggtacttacgtaaccgtttacttaccgtcgtaccctacggttacctaagtacgaaccgtaggtacggtaacgggttccgtttagggtacgggttttacgggttttacggtttacgtttaccgggtttacccgtttaacggggcccgttttaacggggtacccggggtaaaacccgttaaccggttacccccgttaacccggttaacccgttaaacgggtcccgaaaccccggaccccgtaaaacccgggtccccctaaaccccgtttgtacccggttacccgtaccccgttttcccgttccccccggtttaccccccgtaccccctttaccctaacccgtttaaacccgttaacccccggtttccggttaaccgttaccggggacccgggttacccgggggtccgttaccgggggaaccggtaaaccgggcccgtaacgtacggtacggcgtacncgagtcacancnngn

SEQ ID NO: 124398 - DNA, 826 bp, Homo sapiens
  misc_feature: GYAE6OF01BLJ6O.18.9.A09.1.454.CMB.1.raw
  modified_base (218)..(218): a, c, t, g, unknown or other
  misc_feature (218)..(218): n is a, c, g, or t
  modified_base (807)..(807): a, c, t, g, unknown or other
  misc_feature (807)..(807): n is a, c, g, or t
  modified_base (818)..(818): a, c, t, g, unknown or other
  misc_feature (818)..(818): n is a, c, g, or t
  modified_base (820)..(820): a, c, t, g, unknown or other
  misc_feature (820)..(820): n is a, c, g, or t
  modified_base (822)..(822): a, c, t, g, unknown or other
  misc_feature (822)..(822): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctacattctttggtancaacaactcggccctcgacggggtccctgaccgtattcgtctggctccaagtctggccacctcacgcctccctggccatccacgtcgggcctccgagggcctggaggtatgggacggtctacgtaacttactttaccgtcgacccttacgttcccttaagttacgaactagttaggacgggtacgttaggtacggtttacggggttttccgtttaaagtttccggtttaccggttttaccgggtaaagtttcccggggttaacgggggtaaaacccccgttaaaccgggggtttacccctaaacccccggggttttaacccttaaaacgggtacccggtaaacccggtaacccccccggtaaaccggggtacccccccttaaaaccccccgtttcggtttacccgttacccgttaaccccgttttcccggtttccccgggttttacccccccggtcccccttttaaccccgtaccccttaaccgtttaccccggttaacccgggtttaaccgttacggggtaaccgggtcccggggtaccttaccggggaacccgtaaccggggtaccgtacccgtttaaggacggtcncgtcactcganancngcgc

SEQ ID NO: 124399 - DNA, 501 bp, Homo sapiens
  misc_feature: GYAE6OF01BTUMY.18.9.A09.1.454.CMB.1.raw
  modified_base (217)..(217): a, c, t, g, unknown or other
  misc_feature (217)..(217): n is a, c, g, or t
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (448)..(448): a, c, t, g, unknown or other
  misc_feature (448)..(448): n is a, c, g, or t
  modified_base (492)..(501): a, c, t, g, unknown or other
  misc_feature (492)..(501): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtancaacaatcggccctcaggggtccctgaccgattctctggctccaagtctggcacctcacgcctcctggccatcactgggcctcaggctgagntgagctgactattacncgccagtcctatgactagtgaggctgaggttgttcgtatgtcttggatcgtgggaccaggtcaccgtctaagtcacgcccaaggccctaaccctctcgtcctactctcgtccccacccttccnccatacctcgtactgacgcgggctcggacaaggccgacatacgnnnnnnnnnn

SEQ ID NO: 124400 - DNA, 493 bp, Homo sapiens
  misc_feature: GYAE6OF01ECRLB.18.9.A09.1.454.CMB.1.raw
  modified_base (484)..(485): a, c, t, g, unknown or other
  misc_feature (484)..(485): n is a, c, g, or t
  modified_base (487)..(493): a, c, t, g, unknown or other
  misc_feature (487)..(493): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaatcctcatctttggtagcaacaatcggccctcaggggtccctgaccgattctctggctccaagtctggcacctcagcctccctgccatcatgggctccaggctgaggatggagctgactattactgccagtcctatgacatgaggctgagtggttctatgtcttcggatcgtgggaccaaggtcaccgtctaagtcacgacccaacggcccaacccctctcgtccacttcctcgtccccgccctcctcctactacctcgtactggacgcggctggcaggcgcatagnngnnnnnnn

SEQ ID NO: 124401 - DNA, 677 bp, Homo sapiens
  misc_feature: GYAE6OF01DSMUR.18.9.A09.1.454.CMB.1.raw
  modified_base (132)..(132): a, c, t, g, unknown or other
  misc_feature (132)..(132): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (664)..(664): a, c, t, g, unknown or other
  misc_feature (664)..(664): n is a, c, g, or t
  modified_base (668)..(668): a, c, t, g, unknown or other
  misc_feature (668)..(668): n is a, c, g, or t
  modified_base (670)..(675): a, c, t, g, unknown or other
  misc_feature (670)..(675): n is a, c, g, or t
  modified_base (677)..(677): a, c, t, g, unknown or other
  misc_feature (677)..(677): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtggganccacctccaacagtcgggggcgggttatgatgtacactggtaccagcagcttccgagggacacgcccccaaatcctacattcgttttggacgcaactaacgtccggcctcgacggggttcccngaccgtattctcnggcctcaagtcnggccacctncncctccgtgccatcgacgtggccnccgaggctaggaggtatcgacgtactacgaactttacgttacgtcggaccttacgtccttagtacgaacctaggtacggcgggtacttagggtaggtttcgggtttaccgtagtttcggttcgtttcggggaacttccgggtaccgggtaaacccgtacgggttaccctaacccggttaccgttaaaccgtccgaaccccggtacccgaacccgggacccccttaaccccgttacgtccttaccccgttaacttccgttccccgttacccccgtccccttacctaccctacgttacccgtaccgttacgcggtacggccggtcgtcgacggacggtcgcgtaagtcggcngacncnnnnnngn

SEQ ID NO: 124402 - DNA, 689 bp, Homo sapiens
  misc_feature: GYAE6OF01BGLUE.18.9.A09.1.454.CMB.1.raw
  modified_base (349)..(349): a, c, t, g, unknown or other
  misc_feature (349)..(349): n is a, c, g, or t
  modified_base (675)..(675): a, c, t, g, unknown or other
  misc_feature (675)..(675): n is a, c, g, or t
  modified_base (680)..(681): a, c, t, g, unknown or other
  misc_feature (680)..(681): n is a, c, g, or t
  modified_base (683)..(689): a, c, t, g, unknown or other
  misc_feature (683)..(689): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacagtcggggcgggttatgatgtacactggtaccagcagcttccagggacacgcccccaaactcctcattctttggtagcaacaatccggccctcgacggggtccctgaccgtattcctctggcctccaagtcctggcacctcacgccctcctcggcctatcacgtcggcctccgaggctggagacgtggacgtctagacttagttaccngacctagttcctatcgactagtcggaacggtcgtaggtacggtttggttaccgttaggttcgttccggtttagggtaaccttccgggttacgggaaacccgttaacgggttacccgtaaccccgggtttaaccgttaaacggtccccgaaccggtaacccccgtaaaccgggtacccccttaaacccccgttcgttacggttcccctaacccgtttcgttaccccggttcccccgtcccccttaccttaccctacgttaacccgttcggttaacgtccgggacggtccgggaccgtacgggacgtaaccgggccggactagtacgngtacnncnnnnnnn

SEQ ID NO: 124403 - DNA, 490 bp, Homo sapiens
  misc_feature: GYAE6OF01AZDR4.18.9.A09.1.454.CMB.1.raw
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (480)..(490): a, c, t, g, unknown or other
  misc_feature (480)..(490): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgacttattactgccagtcctatgacatgaggtctgagttggttcgtatgtcttggatcgtgggaccaaggtcaccgtctaagtcagcccaaggcccaaccctntgtcactctcgttccccnccctcctccatacctcgtactgacgcggctggcaggcgcatagnnnnnnnnnnn

SEQ ID NO: 124404 - DNA, 676 bp, Homo sapiens
  misc_feature: GYAE6OF01B95EW.18.9.A09.1.454.CMB.1.raw
  modified_base (258)..(258): a, c, t, g, unknown or other
  misc_feature (258)..(258): n is a, c, g, or t
  modified_base (661)..(661): a, c, t, g, unknown or other
  misc_feature (661)..(661): n is a, c, g, or t
  modified_base (664)..(664): a, c, t, g, unknown or other
  misc_feature (664)..(664): n is a, c, g, or t
  modified_base (670)..(671): a, c, t, g, unknown or other
  misc_feature (670)..(671): n is a, c, g, or t
  modified_base (673)..(674): a, c, t, g, unknown or other
  misc_feature (673)..(674): n is a, c, g, or t
  modified_base (676)..(676): a, c, t, g, unknown or other
  misc_feature (676)..(676): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacagtcggggcgggttatgatgtacactggtaccagcagcttccgagggaccacgacccccaaactcctcatcgtttggtagcaacaatccggccctcgacgggtccctgaccgattcnctggctccaagtctggccacctcagccctccctggccatcacgtcgggcctccgaggctggacggagtggacggtctacgtaacttacttacgtcaccgtacgttccctagtacgacagtggacggtcgtcggtagggttcgttacgttagttcggttcgtttcggtacgttcggtaccgggaaccgtacgggttaccgtacccggtaccgtaacggtccgaaccgtacccgaacggacccctaaaccccgttctacgtacccttacgtccctttaccccgtttacccccaaccccttaccccgttaccctaactttaccccgttaccgttacccgtacgggtaccgggtaccggggttccggtacgggacccgtaaagggccccgtaacgtaaggaccggtnagngctcanncnngn

SEQ ID NO: 124405 - DNA, 606 bp, Homo sapiens
  misc_feature: GYAE6OF01DEY2U.18.9.A09.1.454.CMB.1.raw
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (597)..(606): a, c, t, g, unknown or other
  misc_feature (597)..(606): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacacgcccccaaaactcctcatctttggagcaacaatccggccctcgacggggtccctgaccgtattctctggctccaagtctggcacctcacgcctcctgccatccacgtgggcctcgaggctgagntgagctgactatacngccagtcctatgacagtggagtctagtaggttggtttacgtagttcgttcgttacgggattcgtacgggacctaacggttccgtaacccgttacctaacgtccgaaccggaccccgaaccgggcccctaaacccccgttcgtacgttccctaccttccgtttcccgttaccccctaaccccgttcccttacccgtacttacccgttaccgtacgttcgggacggtccgggtccgtacgggtacccgaaggtccgtaactaagttacgcnnnnnnnnnn

SEQ ID NO: 124406 - DNA, 688 bp, Homo sapiens
  misc_feature: GYAE6OF01CXUA5.18.9.A09.1.454.CMB.1.raw
  modified_base (137)..(137): a, c, t, g, unknown or other
  misc_feature (137)..(137): n is a, c, g, or t
  modified_base (220)..(220): a, c, t, g, unknown or other
  misc_feature (220)..(220): n is a, c, g, or t
  modified_base (678)..(678): a, c, t, g, unknown or other
  misc_feature (678)..(678): n is a, c, g, or t
  modified_base (680)..(681): a, c, t, g, unknown or other
  misc_feature (680)..(681): n is a, c, g, or t
  modified_base (683)..(688): a, c, t, g, unknown or other
  misc_feature (683)..(688): n is a, c, g, or t
tcagtacgagtatgcacgaccggtgctcgatttagcgagacgcgcagggtcctgggcccagtctgtgctgacgcagcccgccctcagtgtcgtcgggccccagggcaggagggtccaccatctcctgcacgtggganccacctccaacagtcggggcggttatgatgtacactggaccagcagcttccgagggacacgcccccaaatcctcatcttggancaaacactccggccctcgacgggtcccctgaccgtattcgtcgtcggcctaccgaacgttccgtcggacctaccctcgaccgtcccttcccgtcggacccctacgtccgaacgtcggggtacccttaccggagggtccgttaggaacgggtagttcgggacggacttacgtaacctttaacttaccgtccgtacctaccgttaccttaagtacgtaacgtaagtcggagtccgttaggtaaggtttcggtttacgtagtttcggttaccgttcggtacgttccggtaccgggaacccgtacggtacccgaccgttaaccgtaacgtacgaaccgtacccgaaccgtacccctacccgtcgtccgtacctaccgttccgttacccttaccctaccttcccttccgtacctactaccgttgtaaccgtcggacggtcgtcggcggacgacgcgatagagnanncnnnnnn

SEQ ID NO: 124407 - DNA, 509 bp, Homo sapiens
  misc_feature: GYAE6OF01BF8W6.18.9.A09.1.454.CMB.1.raw
  modified_base (329)..(329): a, c, t, g, unknown or other
  misc_feature (329)..(329): n is a, c, g, or t
  modified_base (484)..(484): a, c, t, g, unknown or other
  misc_feature (484)..(484): n is a, c, g, or t
  modified_base (495)..(495): a, c, t, g, unknown or other
  misc_feature (495)..(495): n is a, c, g, or t
  modified_base (502)..(509): a, c, t, g, unknown or other
  misc_feature (502)..(509): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccccaaaactcctcatctttggtagcaacatcggccctcaggggtccctgaccgattctctggctccaagtctggccacctcagccctccctggccatcactgggctccaggctgaggatgaggctgactattacngccagtcctatgacatgaggctgagttgtcgtatgtcttcggatcgtgggacctaggtccaccgtcctaagtccacgcccgaaggcccctaacccctcgttcgtccaccttctccgttcccgccccttcctcccattacctcgtactgacgcggntggccaaggcnctatagnnnnnnnn

SEQ ID NO: 124408 - DNA, 803 bp, Homo sapiens
  misc_feature: GYAE6OF01DJDHS.18.9.A09.1.454.CMB.1.raw
  modified_base (193)..(193): a, c, t, g, unknown or other
  misc_feature (193)..(193): n is a, c, g, or t
  modified_base (793)..(793): a, c, t, g, unknown or other
  misc_feature (793)..(793): n is a, c, g, or t
  modified_base (797)..(797): a, c, t, g, unknown or other
  misc_feature (797)..(797): n is a, c, g, or t
  modified_base (799)..(803): a, c, t, g, unknown or other
  misc_feature (799)..(803): n is a, c, g, or t
tcagtacgagtatgcacgaccggtgctcgatttagcgagacgcgcagggtcctgggcccagtctgtgctgacgcagccgccctcagtgtctgggccccagggcaggagggtcaccatctcctgcacgtgggagcacctccaacagtcggggcgggttatgatgtacactggtaccagcagcttccgagggacncgccccaaactcctcatctttggacgacaacagtccggcctcgacgggtcctagaccgtattcgtcgtcggctaccgaagtctacggcctacccgtacgacgtccctcccgtacggccagtccgacgtcggggtcctacccggtaggcgttaggaacggtacgttgggaacgggtcccttaaggtaaaccgttttcgtaaccgttccgggaccctaaggtttaccctttaagtaccggaacctaggtttagggaaccgggttccgtagggtttaacgggttccgggttttacgttaacggtttcggttaacccgttttacggggtaccgtttacgggttaaccgggggaacccgtttaaaacccggggttacccttaaaccccggggttaaccccgtttaaaacgtaccccgttaaacccgggaacccccgttaaacccggggaccccctttaaaccccccgttcgtacccgtttaccgtacccttttacccgtccccgtttaccccgcccctttcccttaacccgtacgtttaccgtaccggtcgtacgggaccggtacggtccggtaggaccgtaacgggctaacgtagtagcaggtnactnannnnn

SEQ ID NO: 124409 - DNA, 772 bp, Homo sapiens
  misc_feature: GYAE6OF01DE08E.18.9.A09.1.454.CMB.1.raw
  modified_base (765)..(767): a, c, t, g, unknown or other
  misc_feature (765)..(767): n is a, c, g, or t
  modified_base (769)..(770): a, c, t, g, unknown or other
  misc_feature (769)..(770): n is a, c, g, or t
  modified_base (772)..(772): a, c, t, g, unknown or other
  misc_feature (772)..(772): n is a, c, g, or t
tcagtacgagtatgcacgaccggtgctcgatttagcgagacgcgcagggtcctgggcccagtctgtgctgacgcagccgccctcagtgtctcggggccccagggcaggagggtcaccatctcctgcacgtgggagccaccctccaacgaggtcgggggtcgggttatgatgtacacgttcggtaccagcacgtccttccgagggaccacccgacccccctaaaactccctactactttcgttttagggacaccaaactaacgtcccggaccctcggtaccggggtccctacggaccgtctttcctcgtcggccttaccgaagttccgcggacctaccctccgaccggtcccttcccgtggaccctactaccgtaccggtcgggtcctacccggagggtcctagggaggtacgttcggacggtcttacggtaactttacttacgtccgaccgtacgttaccgtatacggtactagtagggacggttcgttaggttacgggtttcgtttacggtattcggtttacgtacggtcgttacggtaccgggaaccgtaacgtaccgtacccggttaactaacggtccgaaccggaccccgtaaaccggtccccctaaacccgtttcgtaccgttacccttaccgtttccgttaccccgttcccccgtccccttaccgtacccgttacgtttaccccgttacggtacgtacggtaccgggtccggtaccgtacgggaccggtacgggtaccgtacgtatacgcgatgctacnnncnngn

SEQ ID NO: 124410 - DNA, 806 bp, Homo sapiens
  misc_feature: GYAE6OF01CJ73K.18.9.A09.1.454.CMB.1.raw
  modified_base (799)..(801): a, c, t, g, unknown or other
  misc_feature (799)..(801): n is a, c, g, or t
  modified_base (803)..(803): a, c, t, g, unknown or other
  misc_feature (803)..(803): n is a, c, g, or t
  modified_base (805)..(806): a, c, t, g, unknown or other
  misc_feature (805)..(806): n is a, c, g, or t
tcagtacgagtatgcacgaccggtgctcgatttagcgagacgcgcagggtcctgggcccagtctgtgctgacgcagccgccctcagtgtcgtgggccccagggcagagggtcaccatctcctgcacgtgggagccacctccaacagtcggggcgggttatgatgtacactggtaccagcagctccgagggacacgaccccaaactcctcacttcgtttggtacgacaaacgaacgtccggtcccgtcgtacggggtccctacgtaccgtacgttcctcgtcggcctaccgtaagtccgtcgggacctaccgtccgaccgtcccgttccgtcggacctaccgtaccgtaccggttcggggacctaccggacggtccgtagggaaccggtagttacgggacggtaccgttaacggtaacctttaacgttaccggtacgtacccgttaacgggttacccttaagtaccggtaaacgtacggttacgggtaaccggttacgttacggggttaacggggttttcgggtttaacgtttacgtttcgggtttaccgttacgggtacgttaccgggtaaccgggtaaccgttaacgggttacccgtaaccccggttaacgtaacgtaccgtaaacccgacccgaaccggtacccccttaaaccgttcgtaccgtacctaccgttaccttccccgttacccctaccccttccttaacccgtacctttaccggtaccggttaccgttacgggaccgggtccggtcggacgggtaaccgacgggtacgtactaagtacggcagtcacgtnnncngnn

SEQ ID NO: 124411 - DNA, 558 bp, Homo sapiens
  misc_feature: GYAE6OF01CXMT6.18.9.A09.1.454.CMB.1.raw
  modified_base (371)..(371): a, c, t, g, unknown or other
  misc_feature (371)..(371): n is a, c, g, or t
  modified_base (530)..(530): a, c, t, g, unknown or other
  misc_feature (530)..(530): n is a, c, g, or t
  modified_base (546)..(546): a, c, t, g, unknown or other
  misc_feature (546)..(546): n is a, c, g, or t
  modified_base (550)..(558): a, c, t, g, unknown or other
  misc_feature (550)..(558): n is a, c, g, or t
tcagtacgagtatgcacgaccggtgctcgatttagcgagacgcgcagggtcctgggcccagtctgtgctgacgcagccgccctcattgtctggggccccagggcagagggtcaccatctcctgcactgggagcacctcaacatcggggcgggttatgatgtacactggtaccagcagcttccagggacacgcccccaaactcctcattcttggtagcaaacaatccggcctcgaggggtccctgaccgtattctctcggcctaccgtaacgtctcggcctacctcgaccgtccctacccgtggcccaatcgaccgtgggcctccgaggctgaggactggaggtctgtactactactcgccagtcctagtanacagtgagtctgaggttgttacgtagtcgtcgttaggctcggtacgggtaacacggtctaccgtactaagtcacgaccgacgtacccaaccctctcgacctctcctccgttaccccacccttccctccctaacttccgtacgacgttcggacgccgggntcggactaggcgcagngcannnnnnnnn

SEQ ID NO: 124412 - DNA, 607 bp, Homo sapiens
  misc_feature: GYAE6OF01A9DW7.18.9.A09.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(607): a, c, t, g, unknown or other
  misc_feature (602)..(607): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaatcctcattctttggacncaacaatccggccctcgacggggtccctgacccgatttcnctggcctccaagtctggccacctcacgcctccctggccatcacgtcgggctccgaggctaggaggatggagctgactattactcgcctagttcctatacgactagtggacgcgtaggtaggtttggttctagttcgttcgttacggcttcggtacgggaaccctaaggttcctacccgttacgtaacgtccgaaccgaccccgaaccggcccctaacccctcgtacgtccctaccgttcccttcccgttccccctcccgttccctacccgtacttacccgttaccgttacgcggtacggtccggtacgtcgggaccgtaacgggccgtactagacngcctancncnnnnnn

SEQ ID NO: 124413 - DNA, 745 bp, Homo sapiens
  misc_feature: GYAE6OF01E2S49.18.9.A09.1.454.CMB.1.raw
  modified_base (357)..(357): a, c, t, g, unknown or other
  misc_feature (357)..(357): n is a, c, g, or t
  modified_base (733)..(733): a, c, t, g, unknown or other
  misc_feature (733)..(733): n is a, c, g, or t
  modified_base (739)..(743): a, c, t, g, unknown or other
  misc_feature (739)..(743): n is a, c, g, or t
  modified_base (745)..(745): a, c, t, g, unknown or other
  misc_feature (745)..(745): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacacgcccccaaactcctcattctttggtagcaaacaactccggccctcgacggggtccctgaccgtattctctggctccgaagtctggccacctcacgtcctcccgtggccatccacgtcgggcctccgaggtccgtggacggtatggacggtctagtacttacttaccgngaccctagtcctatcgaactagtggaggtcttaggtagtttggttccgttagttcggtttacgtttcggggatttcccggtacggggtaacccgtaaacgggttccccgttaaaccccgggtttaacccgttaaacggttcccgaaacccgggtaaccccccgtaaaaccggggtaccccccttaaacccccgttcgtttaccggttacccctaacccgttttaccccgttccccgtttacccccctaaccccttcccccttacccgttaacctttacccggttcccggtttaccggtacgggtaacccggggtccggggacccgtttaccgggggaacccaacggggttcctaaccgtaaagttcggactccgancctagnnnnngn

SEQ ID NO: 124414 - DNA, 560 bp, Homo sapiens
  misc_feature: GYAE6OF01DSX0M.18.9.A09.1.454.CMB.1.raw
  modified_base (216)..(216): a, c, t, g, unknown or other
  misc_feature (216)..(216): n is a, c, g, or t
  modified_base (334)..(334): a, c, t, g, unknown or other
  misc_feature (334)..(334): n is a, c, g, or t
  modified_base (383)..(383): a, c, t, g, unknown or other
  misc_feature (383)..(383): n is a, c, g, or t
  modified_base (549)..(549): a, c, t, g, unknown or other
  misc_feature (549)..(549): n is a, c, g, or t
  modified_base (551)..(560): a, c, t, g, unknown or other
  misc_feature (551)..(560): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtancaacaatcggccctcgacgggtccctgaccgattctctggctccaagtctggccacctcacgcctccctggccatccacgtgggcctccgaggctggaggatggagctgactattacngccagtcctatcgacagtgaggctgagttggttctatgttcgttcggtntcgtacgggacctaaggtccacccgtacgtaagtccaacggccccaacggcccctaaccccttcgtacgtcctacttccttccgttccccgtccccttccctaccgtacttacccgtcgttactcggacggtcggggtcctcgggacgtaacggcgtactaagacncnnnnnnnnnn

SEQ ID NO: 124415 - DNA, 756 bp, Homo sapiens
  misc_feature: GYAE6OF01BSTJ9.18.9.A09.1.454.CMB.1.raw
  modified_base (746)..(746): a, c, t, g, unknown or other
  misc_feature (746)..(746): n is a, c, g, or t
  modified_base (748)..(748): a, c, t, g, unknown or other
  misc_feature (748)..(748): n is a, c, g, or t
  modified_base (751)..(756): a, c, t, g, unknown or other
  misc_feature (751)..(756): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtgggagcacctccaacagtcggggcggttatgatgtacactggtaccagcagcttccagggacacgcccccaaactcctcattcgtttggtagcaacaatccggccctcgacggggtccctgaccgtattcctcgtcggcctaccgaagtcgtacggccaccttccgacgtccctcccgtcggcccacgtccgaccgttcggggccttcccgaagggtccttaggaaggtacgttacgggaacgggtccttacgggtaacctttaacgtttaaccgtccgggtaccctaacggttccccttaagttacggaaaccctagttacgggacggtaccgttggtaaccggtttcgggtttaccgttaagtttcggttccgttacgggtacgtttacgtacggggtaaccgtaacgggttacccgtaacccggttacccgttaaacggtccgaacccggtaaccccgtaaccgggtacccctaacccccgttcgtacgttacccaccgtttcccttcccgtttcccccgacccctttccctacccgttaacgttacccgttcccgttaacgtccgggtaccggtccgggtcgtaccggaccgtaacggccgactaggtacgcgcngngcnnnnnn

SEQ ID NO: 124416 - DNA, 665 bp, Homo sapiens
  misc_feature: GYAE6OF01BSLI1.18.9.A09.1.454.CMB.1.raw
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (653)..(653): a, c, t, g, unknown or other
  misc_feature (653)..(653): n is a, c, g, or t
  modified_base (658)..(658): a, c, t, g, unknown or other
  misc_feature (658)..(658): n is a, c, g, or t
  modified_base (660)..(665): a, c, t, g, unknown or other
  misc_feature (660)..(665): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtagcaaacaatcggccctcgacggggtccctgaccgattctctggctccaagtctggcacctcagcctccctggccatccacgtgggcctccgaggctggaggntggagctgactattacncgccagtcctatcgacagtgaggtctggtaagttgggtttacgtagttgttccgttacgggagttccggtacggggtaaccctaacgggttcctaacccggtttccgtaaacggttccaaccggtaccccccgtaaacggggaccccccttaaacccccgttccgtttaccggtacccttaacccgtttccgttcccggtttaccccccaaccccctttccccgtaccctaactttaacccgttcccgtttaaccgtcgggtaccggccggggttccgtacggggtaccgaaacgggtcccgaaccgtagtaccgcgancgtancnnnnnn

SEQ ID NO: 124417 - DNA, 564 bp, Homo sapiens
  misc_feature: GYAE6OF01AMWNJ.18.9.A09.1.454.CMB.1.raw
  modified_base (557)..(564): a, c, t, g, unknown or other
  misc_feature (557)..(564): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagccccccaaactcctcatctttggtagcaacaatcggccctcaggggtccctgaccgattctctggcctccaagtctggccacctcagcctccctggcccatccacgtggggcctcccaggcctggaggatggaggctgaaccttattactgcccagttccctatcgacagtgaggctggagttggttcgtagtgtcttcgggattcgtagggacctaaggtcctaccgtacctaacgtcaacgtcccaacgggcccaacccctctcgtcctacttccttaccgttcccccacccttccctacctacttaccgtccgttacgtcggacggtcgggtcgtacggccgtaacggccgtcaagtagcagcnnnnnnnn

SEQ ID NO: 124418 - DNA, 606 bp, Homo sapiens
  misc_feature: GYAE6OF01CO29J.18.9.A09.1.454.CMB.1.raw
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (596)..(606): a, c, t, g, unknown or other
  misc_feature (596)..(606): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccgagggacacgacccccaaactcctcatctttggagacaaacatcgccctcgacgggtcctgaccgtattctcgtcggctcctaagtctggcctacctcgacgcccttcccgtggccctatccacgtgggcctccgaggcgtggagngtggagctagtactattcngcctacgtctangacagtggagtcgtggtaggtttcggttactagttcgttcgtcgggtacgtcggtacgggaaccgtaacgggtacccgtacccggttaaccgttaacgtacgaacccggtacccgaaccggtacccctaaccccgtctcgtaaccctcgttacccttcccgtacccctccccgttccctactacttaccgtacgttacgtcggaccggtcggtcgtcgacggtacgcgtcagtcgnnnnnnnnnnn

SEQ ID NO: 124419 - DNA, 516 bp, Homo sapiens
  misc_feature: GYAE6OF01DO6M1.18.9.A09.1.454.CMB.1.raw
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (505)..(516): a, c, t, g, unknown or other
  misc_feature (505)..(516): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacacgcccccaaatcctcatctttggtagcaacaatccggccctcgaggggtcccctgaccgattctctggctccaagtctggcacctcacgcctccctgacctatccttcgtcgggcctccgagggcctggaaggacgaggctagatttattactgcagctnaatataacaagccaacngcactctctatcgtcttacggaactgggaccaaggtccaccgtacctaggtcaacgacccaacggcccaaccnctgccactctcgtccccncctcctctactcctcgtactgacgcggtctacggcaaggccacgatagnnnnnnnnnnnn

SEQ ID NO: 124420 - DNA, 618 bp, Homo sapiens
  misc_feature: GYAE6OF01AUZBI.18.9.A09.1.454.CMB.1.raw
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (605)..(605): a, c, t, g, unknown or other
  misc_feature (605)..(605): n is a, c, g, or t
  modified_base (608)..(609): a, c, t, g, unknown or other
  misc_feature (608)..(609): n is a, c, g, or t
  modified_base (613)..(616): a, c, t, g, unknown or other
  misc_feature (613)..(616): n is a, c, g, or t
  modified_base (618)..(618): a, c, t, g, unknown or other
  misc_feature (618)..(618): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcgaggggtccctgaccgattctctggctccaagtctggcacctcagcctccctggccatcactgggctccaggctgaggatggnggctggattacttacngccagtcctatcgacatgaggtctggagttggttacgtagttgttcgttcggattccggtagggtacccaagggttccaacccggttcccttaaaggtcccaaccgtacccccgaacgggtccccctaaacccccttcttaccggtaccctacctttcccgtacccgtttccccccggtacccctttcccctacccgttactttacccgttccggttaacctcgggaccggtaccggggtcgttcggggacctaacgggccgtcaaggttacggncgnngcannnngn

SEQ ID NO: 124421 - DNA, 637 bp, Homo sapiens
  misc_feature: GYAE6OF01C91NH.18.9.A09.1.454.CMB.1.raw
  modified_base (220)..(220): a, c, t, g, unknown or other
  misc_feature (220)..(220): n is a, c, g, or t
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (634)..(635): a, c, t, g, unknown or other
  misc_feature (634)..(635): n is a, c, g, or t
  modified_base (637)..(637): a, c, t, g, unknown or other
  misc_feature (637)..(637): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtgggagccacctccaacagtcggggcgggttatgatgtacactggtaccagcagcttccgagggaccacgcccccaaactcctcatctttggancaaacaactccggccctcgacggggtccctagaccgtattctcgtcggctccaagtctggcacctcacgccctccgtgcctatccacgtcggcctcgaggctgagtgagtgagtcgtagtacttacttacgtgacctagtcctagtacgactacttaactctacgtaggtcggttcggtcgggggttcttccggggacgggaacgggtaccgtacggacggtaccggtaccggttcgggtcgggtaccgaccggtacccgtaccggtccgttcccgcccccgttcggaccctccgtttccgttcccgttccccctacccttcccttacctacgttacccgtccgtacggtcgaccgggtccggttcgaccggtacgacgggtccgtacgtacgtaggcngtacngctcgnancnngn

SEQ ID NO: 124422 - DNA, 544 bp, Homo sapiens
  misc_feature: GYAE6OF01D40FT.18.9.A09.1.454.CMB.1.raw
  modified_base (213)..(213): a, c, t, g, unknown or other
  misc_feature (213)..(213): n is a, c, g, or t
  modified_base (338)..(338): a, c, t, g, unknown or other
  misc_feature (338)..(338): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (538)..(539): a, c, t, g, unknown or other
  misc_feature (538)..(539): n is a, c, g, or t
  modified_base (541)..(542): a, c, t, g, unknown or other
  misc_feature (541)..(542): n is a, c, g, or t
tcagtacgagtatgcacgaccggtgctcgatttagcgagacgcgcagggtcctgggcccagtctgtgctgacgcagccgccctcagtgtctgggccccagggcagaggttcaccatctcctgcactgggagcacctccaacagtcggggcggttatgatgtacactggtaccagcagcttccagggacagcccccaaatcctcatctttggancaacatcggccctcgacggggtccctgaccgtatttctcgtggctccaagtctcggcacctcacgcctccctggtcatccacgtcgggcctccgaggcctggaggatggagctgaacttattacngcagtctacatatacaagcacgcagccacgtcaacgttctacggaactacggaacctaaggtccaccgttctaggtccacgaccctaacggcccaacccnctcgtacncctctcctacccacccgtcctaccactacctccgtactcgacggtcggtacgcggtacgacggccgacgtaacgtngtcncgtnacgtnacnncnngc

SEQ ID NO: 124423 - DNA, 745 bp, Homo sapiens
  misc_feature: GYAE6OF01CNAFT.18.9.A09.1.454.CMB.1.raw
  modified_base (133)..(133): a, c, t, g, unknown or other
  misc_feature (133)..(133): n is a, c, g, or t
  modified_base (478)..(478): a, c, t, g, unknown or other
  misc_feature (478)..(478): n is a, c, g, or t
  modified_base (703)..(703): a, c, t, g, unknown or other
  misc_feature (703)..(703): n is a, c, g, or t
  modified_base (737)..(738): a, c, t, g, unknown or other
  misc_feature (737)..(738): n is a, c, g, or t
  modified_base (740)..(740): a, c, t, g, unknown or other
  misc_feature (740)..(740): n is a, c, g, or t
  modified_base (742)..(742): a, c, t, g, unknown or other
  misc_feature (742)..(742): n is a, c, g, or t
  modified_base (745)..(745): a, c, t, g, unknown or other
  misc_feature (745)..(745): n is a, c, g, or t
tcagtacgagtatgcacgaccggtgctcgatttagcgagacgcgcagggtcctgggcccagtctgtgctgacgcagccgccctcagtgtcgtcgggccccaggcagagggtcaccatctcctgcacgtgggancacctccaacagtcggggtcggttatgatgtactactggtaccagcagtccttaccgaacgggaccaaccgacccccctaaacttccctactactttccgtttaggtacgactaaaaccgtaacgttcccggtcccttcggaccggggttcccgtacgtacccgtacttcctcgtcggtcctaccgtaagtcgtcggacctacctcctaccgccctcccgtcggacctactccgaccggtcgggtacccttccggacggtcgtggaaggtcgtggacggtactacgtaactttaacttcgtacgtacgactcttaacaattaaccgaaacaacgaccaaccgacncctactacttacttacgttcgttaccgttacgggaaccgttacggaaccgttacggtacctacccggtacgtacgtacgacccgtaacccgacctacccgtaacccgtgtaccgtaccgtaactttcccgtccccgttaccccctaccccgttaaccttacccgtaccttaccgttacggtccgtacggaccggtccgggtaccggtaccggtaacgggtaaccncggtacccgtaagttacgcggctaccactcgacnncngngtn

SEQ ID NO: 124424 - DNA, 897 bp, Homo sapiens
  misc_feature: GYAE6OF01DLOUM.18.9.A09.1.454.CMB.1.raw
  modified_base (883)..(883): a, c, t, g, unknown or other
  misc_feature (883)..(883): n is a, c, g, or t
  modified_base (892)..(892): a, c, t, g, unknown or other
  misc_feature (892)..(892): n is a, c, g, or t
  modified_base (894)..(894): a, c, t, g, unknown or other
  misc_feature (894)..(894): n is a, c, g, or t
  modified_base (896)..(896): a, c, t, g, unknown or other
  misc_feature (896)..(896): n is a, c, g, or t
tcagtacgagtatgcacgaccggtgctcgatttagcgagacgcgcagggtcctgggcccagtctgtgctgacgcagccgccctcagtgtcgtcgggccccagggcaggagggtcaccatctcctgcacgtgggagccacctccaacagtcgggggtcgggttatgatgtacacgtcggtaccagcagtccttaccgaacgggaccaccgaccccctaaactcctctactttcgttttaggacgaccaaacctaacgtcccggacccttcggtaccggggtccctacggaccgtacttcctcgtcggcctaccgaagtcgtcggcctacctcgccgccctaccgtcggacctactaccgacggttcgggacctaccggaggtccgtagacggtagtcggacggtcttagtaacttacttcgtcgacccgttacgttaccttagaccgtaagtacggttaggtaccgggttacgtgggttaacggggttttcggtttacgggtttaacgtttcgggtttaccggttacgggtaccggtttacccgggtaacggggaaaccccgttaaccggggtttaccccgttaacccgggtttaaccgtaaacccggtacccgggtaaaccccgtaaccccggtaaacccccgggtaaccccccttaaacccccgtttccggttacccgttaaccccgtttaccccccggttttacccgtttaccccccggtttaccccccgtttaacccccctttaccctaaccccgtttaacccgtttaaccccgtttaccggttaacccggttaccggggaccgggttacccgggggtaccttaccggggaaacccgggttacggggacccccgttaacgtaagggtccgttagcccganacgacacancngnc

SEQ ID NO: 124425 - DNA, 756 bp, Homo sapiens
  misc_feature: GYAE6OF01DUWHO.18.9.A09.1.454.CMB.1.raw
  modified_base (135)..(135): a, c, t, g, unknown or other
  misc_feature (135)..(135): n is a, c, g, or t
  modified_base (741)..(741): a, c, t, g, unknown or other
  misc_feature (741)..(741): n is a, c, g, or t
  modified_base (747)..(748): a, c, t, g, unknown or other
  misc_feature (747)..(748): n is a, c, g, or t
  modified_base (750)..(750): a, c, t, g, unknown or other
  misc_feature (750)..(750): n is a, c, g, or t
  modified_base (752)..(756): a, c, t, g, unknown or other
  misc_feature (752)..(756): n is a, c, g, or t
tcagtacgagtatgcacgaccggtgctcgatttagcgagacgcgcagggtcctgggcccagtctgtgctgacgcagcccgccctcagtgtcgtcgggccccagggcagagggtcaccatctcctgcacgtggganccacctaccaacgagtcgggggcgggttatgatgtacactcggtaccagcgacgccgttccgaagggaccaaccgacccccctaaacttccctactacgtttcgttttaggacgacaaaccgtaacgtcccggcccctacggtaccgggtccctacggtacccgttactttccgtcgtcggtcctaccgaacgttccgtacggcctacctccaccgtccctcccgtcgccactaccgtcggtccggcctaccggacgtacgtaggagtacgtggacggtcgtacgtaacttacgttaccgcgtacctacgtaccttagacgtacgagtcggacggtcgtaggttaggttcggtttacgttagttccggttacgttacggacttccgggaaccgggtaaccgtacgggtaaccccttacccgtacgttaacgcccgaaccgaaccccgaacccggtacccctaaccccgtttctacccggtaccttacccgtttacccgtccctttaccccccgaacccctttccccaaccgtttaccgtaccgtttacccggtacgtacgggtacccggccggttgtaaccccggagaaaccggtccgaactagancgactnncncnnnnn

SEQ ID NO: 124426 - DNA, 673 bp, Homo sapiens
  misc_feature: GYAE6OF01BDE1Z.18.9.A09.1.454.CMB.1.raw
  modified_base (337)..(337): a, c, t, g, unknown or other
  misc_feature (337)..(337): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcggttatgatgtacactggtaccagcagcttccagggacacgcccccaaactcctcatctttggagcaacaatccggccctcgacggggtccctagaccgtatttcctctcggctaccaagtctggccacctcagcctccctggccatcacgtcgggctccaggctgaggatgagctagacttattacngcctagtcctagtcgactagtgaggtctaggaggttggttcgtagttcggtacgtttacgggacttcggtacgggtaacctaacgggtacctacccggttaccgtaaacggttccgaaccggtacccccgaaacgggtacccccctaaacccccgttcgttacgggttaccctaaccgtttcccgttcccgttaccccccgtccccttaccccgtacccgtaactttaccccgttccggttaaccgttcgggaccgggtccgggtacgttaccggggaccgtaaacggggtcccgtacgtaacggttacggactcgacgtagtccatagacngngc

SEQ ID NO: 124427 - DNA, 609 bp, Homo sapiens
  misc_feature: GYAE6OF01BSA3M.18.9.A09.1.454.CMB.1.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacacgcccccaaactcctcatctttggtagcaacaatcggccctcgacgggtccctgaccgattctctggctccaagtctggcacctcacgcctcctggccatcactcggctccaggctgaggatgagctgactattacngaccagtcctancgacagtggaggctggagttggttcgtagttggttcgttcggattccgtagggaaccctaaggtccgtaccgttacctaagtcgaacgacccgaacggaccctaacccctctacgtacctaccttccttccgttacccctaccccttacccgttaccctaacgttacccgttaccggttaaccgtcgggtaacgggtcccggggtaccgttaccggggaccgtaaaccgggccgtaacgtaacgttaggcgtacgnacgtnacnncngngn

SEQ ID NO: 124428 - DNA, 259 bp, Homo sapiens
  misc_feature: GYAE6OF01AYMN9.18.9.A09.1.454.CMB.1.raw
  modified_base (229)..(229): a, c, t, g, unknown or other
  misc_feature (229)..(229): n is a, c, g, or t
  modified_base (231)..(259): a, c, t, g, unknown or other
  misc_feature (231)..(259): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcttgttctggaagcagctccaacatcggaagtcagcccaaggctgccccctggtcactctgttcccaccctcctcatactcgtactgagcgggctggcaaggcgcatagnannnnnnnnnnnnnnnnnnnnnnnnnnnnn

SEQ ID NO: 124429 - DNA, 703 bp, Homo sapiens
  misc_feature: GYAE6OF01EKLGQ.18.9.A09.1.454.CMB.1.raw
  modified_base (688)..(688): a, c, t, g, unknown or other
  misc_feature (688)..(688): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
  modified_base (698)..(703): a, c, t, g, unknown or other
  misc_feature (698)..(703): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacagtcggggcgggttatgatgtacactggtaccagcagcttccgagggacacgacccccaaactcctcattcgtttggtagacaaacaacgtccggccctcgacggggtccctgaccgtattcctcgtcggcctaccgaagtctcggccacctcacgccctcccgtcggccactcctacgtcgggcctccgacggtctagggaggtagtggacggtctacgtacttacgttaccgtcgtaccgtacgttcctagtacgaacgtagtaggtacggtcgttaggtacggtttcgggtttacgttacgttcggtttaccgttcgggtacgttccggtaccgggtaacccgtaacgggtccccgtaacccgttccgtaaacgtccgaaccggacccccgaaccggtaccccctaaccccgttctaccgttaccctaccgtttccgttcccgttcccccgtcccttaccctacctacgttacccggttacggtaccggtaccgggtaccggggccgtacgggtaccgaacgggaccgtacgtaccgtaggtcncgangngtcnnnnnn

SEQ ID NO: 124430 - DNA, 793 bp, Homo sapiens
  misc_feature: GYAE6OF01C75LN.18.9.A09.1.454.CMB.1.raw
  modified_base (780)..(780): a, c, t, g, unknown or other
  misc_feature (780)..(780): n is a, c, g, or t
  modified_base (784)..(785): a, c, t, g, unknown or other
  misc_feature (784)..(785): n is a, c, g, or t
  modified_base (788)..(790): a, c, t, g, unknown or other
  misc_feature (788)..(790): n is a, c, g, or t
  modified_base (792)..(793): a, c, t, g, unknown or other
  misc_feature (792)..(793): n is a, c, g, or t
tcagtacgagtatgcacgaccggtgctcgatttagcgagacgcgcagggtcctgggcccagtctgtgctgacgcagccgccctcagtgtcgtgggccccagggcaggagggtcaccatctcctgcacgtgggacgcacctccaacagtcgggggcgggttatgatgtacacgtggtaccagcagtcttccgagggaccaccgacccccaaactcctctattcgttttaggtacgacaaacgaacgttcccggccctccggacggggtccctacggacccgtactttcctcgtcggacctaccgtaacggttcgtcggacctaccctccgacgtcccctacccgttcggacctaacgtcccgtaccggtcgggcccgtacccggtacgggtaccgttagggaacgggtacggttacgggaacggttccgttaacggttaaaccgtttaccgttttaaccggtccgtacccgttacggttaacccttaggtacgtaaccttacgggtacggtaacggtcggttacggttagggtttcgggttttacgtaacgttcggtttaccggttacggtacgttacggtaacgggaccgttacgtacccgtaaccgtaccgtaagtaccgaaccggaccctaacgcccccttaacccgttcgtacgtacccttacccgttcccgtttcccgtcccccgtaccccttaccgtaccctaacgtttccgtaacggttccgtacgggcgggtaccggtcgacgggtaccgacggtaccgtacgtaggtacgcngacnncannngnn

SEQ ID NO: 124431 - DNA, 865 bp, Homo sapiens
  misc_feature: GYAE6OF01CAGP4.18.9.A09.1.454.CMB.1.raw
  modified_base (542)..(542): a, c, t, g, unknown or other
  misc_feature (542)..(542): n is a, c, g, or t
  modified_base (834)..(834): a, c, t, g, unknown or other
  misc_feature (834)..(834): n is a, c, g, or t
  modified_base (841)..(841): a, c, t, g, unknown or other
  misc_feature (841)..(841): n is a, c, g, or t
  modified_base (863)..(863): a, c, t, g, unknown or other
  misc_feature (863)..(863): n is a, c, g, or t
tcagtacgagtatgcacgaccggtgctcgatttagcgagacgcgcagggtcctgggcccagtctgtgctgacgcagccgccctcagtgtcgtcggggccccagggcaggaggtcaccatcctcctgcacgtgggagcctaccctaccaaacgacggtccggggggtcgggtttaatggtaagttacggtacctaacgttacggtaccacggctacgtccgttaccggaacgggaccaccgaccccctaaactcctctacgttcgtttaggacgaccaaactacgtccggaccgtcggaccgggtcctacgtaccgtcttcgtcgtcgctaccgagttccgacggcctaccgtcaccgtccctccggtcgaccctacgtccgaccggtcggtacctaccggacggcgtagggaacggtcgttacgggacgggtacctcggttaaacctttcgtaccggtaccgtaccgttaaccgtttctaagtacgtaaccgaggtttacgggaccggttaggtacgggttacggtttcggtttaacggttntttacccgggtttcgtaaccgggtcgtttaaccggggaaccggggtaaccgttaaaccggttccccggtaacccgtttaccggtaaacgccccggtaaacccggaacccgtaaccccgtccccgttaaacccttggtaacccgtcctttaacccgttccttaacccccgttcccttacccccgtaaccgttcccgttaaaccttcccgggttaaccgtccgggtaaccgggtcgggttacccggttaaccggtcggggaaaacccgtcggttaacccggcttaaaggtccgngtaccgntaccgtctacgacgcgtcgtcncg

SEQ ID NO: 124432 - DNA, 732 bp, Homo sapiens
  misc_feature: GYAE6OF01COG0O.18.9.A09.1.454.CMB.1.raw
  modified_base (221)..(221): a, c, t, g, unknown or other
  misc_feature (221)..(221): n is a, c, g, or t
  modified_base (716)..(716): a, c, t, g, unknown or other
  misc_feature (716)..(716): n is a, c, g, or t
  modified_base (720)..(720): a, c, t, g, unknown or other
  misc_feature (720)..(720): n is a, c, g, or t
  modified_base (728)..(732): a, c, t, g, unknown or other
  misc_feature (728)..(732): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagccacctccaacagtcgggggcgggttatgatgtacactggtaccagcagcttccgagggaccacgaccccaactcctcatctttgganacaacatccgcctcgacgggtcctcgaccgtcttctcgtcgctacaagtctcggcctacctcgaccgtccctccgtcggactactccgacggtcgggtccttccgaggtccgttaggaggtacgttaggacggtcttacggtaacctttacgttaccgaccgtacctaccgttcctaagtacgacgtagtacggacggtcgttaggttacggttcgggttttacgtacgtttcggtttccggttacggtacgtttcggtaaccgggtaaacccgttaacgggttacccctaacccggttaccgttaaccgaccgtaaacccggaccccggtaaacccggtacccccttaaaccccgttaccgttcgttaacccttcccgttcccgtttacccccgttccccttccccgttacctacccgttaccgttacgttacccgttacggacggtcgggtccgggtcgttacggacggtaacccgtaccgacgttaaggtgnacgngacgtcannnnn

SEQ ID NO: 124433 - DNA, 721 bp, Homo sapiens
  misc_feature: GYAE6OF01BUN5K.18.9.A09.1.454.CMB.1.raw
  modified_base (136)..(136): a, c, t, g, unknown or other
  misc_feature (136)..(136): n is a, c, g, or t
  modified_base (614)..(614): a, c, t, g, unknown or other
  misc_feature (614)..(614): n is a, c, g, or t
  modified_base (702)..(702): a, c, t, g, unknown or other
  misc_feature (702)..(702): n is a, c, g, or t
  modified_base (708)..(708): a, c, t, g, unknown or other
  misc_feature (708)..(708): n is a, c, g, or t
  modified_base (716)..(716): a, c, t, g, unknown or other
  misc_feature (716)..(716): n is a, c, g, or t
tcagtacgagtatgcacgaccggtgctcgatttagcgagacgcgcagggtcctgggcccagtctgtgctgacggcagcccgccctcgagtgtcgtcgggccccagggcagagggtcaccatctcctgcagtgggancacctccaacgtacgtcggggcggtttatcgtagtagtacacgtcggtaaccagcacgtccttaccggagggaccgaccgacccccgtaaacgttcctactacttccgtttagggaacgtaccaaacctaacgtcccggtccccttacggaccgggttccctaggaccgtacttccgtcggtacggaccttaccgtaacggttcctcggcctaacctcggaccgtccctacggtcggacctagtccgagtcgggacttccgaggtcctagggacgtacgtcgggaactcgttaacgtacttacgttaccgcggaaccttaacggttacttagacggtaaacctggtacggtaccggttacgtagggtacggttttacgggtactacggtttcgtacccgttaggtacttcgggtaaccgtaaccgtacgtccgtaaaccgtacgaactacgaacgtaccgaacccgtacctacccgtnttaccgctaccgttcgtcccgtcctaccgtacctcgacgttccgtcgtacgtggtacgtccgtcgaacggtcgtaacggcgacgtgangacgtnctacatcntgtcg

SEQ ID NO: 124434 - DNA, 749 bp, Homo sapiens
  misc_feature: GYAE6OF01DH9UE.18.9.A09.1.454.CMB.1.raw
  modified_base (729)..(729): a, c, t, g, unknown or other
  misc_feature (729)..(729): n is a, c, g, or t
  modified_base (734)..(734): a, c, t, g, unknown or other
  misc_feature (734)..(734): n is a, c, g, or t
  modified_base (737)..(737): a, c, t, g, unknown or other
  misc_feature (737)..(737): n is a, c, g, or t
  modified_base (744)..(745): a, c, t, g, unknown or other
  misc_feature (744)..(745): n is a, c, g, or t
  modified_base (747)..(749): a, c, t, g, unknown or other
  misc_feature (747)..(749): n is a, c, g, or t
tcagtacgagtatgcacgaccggtgctcgatttagcgagacgcgcagggtcctgggcccagtctgtgctgacgcagccgcctcagtgtcgtcgggcccagggcaggagggtcaccatctcctgcacgtgggacgccacctaccaacaggtcgggggcgggttatgatcgtacacgtacggtaccagcacgtcttaccgacgggacaccgacccctaaactccgtactacttcgtttaggacgacaaactacgtccggccgtcggacgggtccgtacgtaccgtacttcgtcgtcggtcctaccgtacgttccgcggtacctacctacgtaccgtccctccgtcggtacctacgtccgtacggtcggtcctccggacggtacgtggtaacggtgtacggtacggtctacgtacttaacgtacgtccgtaccgtacgttactacgtacgtacgtagtacggggacgtcgttagggtacgtttcggttacgtttacggttcggtttccgttacgtaccgggttacggtaccggggtaaaaccttccggttaaccgtaccccgtttaacggtaccgaacgtaacccgggaacccgtaacccgtaccccgaaccctttcgtacgtaaccctcccgtttccgtaacccgttacccccaccgttacctaccgtacgtttaccgtacggtacgttccgggacggtacggtcgtaccgggactaaccgggctaaacgngtcgngcngctcacnncnnn

SEQ ID NO: 124435 - DNA, 851 bp, Homo sapiens
  misc_feature: GYAE6OF01CS6NV.18.9.A09.1.454.CMB.1.raw
  modified_base (839)..(839): a, c, t, g, unknown or other
  misc_feature (839)..(839): n is a, c, g, or t
  modified_base (842)..(842): a, c, t, g, unknown or other
  misc_feature (842)..(842): n is a, c, g, or t
  modified_base (844)..(851): a, c, t, g, unknown or other
  misc_feature (844)..(851): n is a, c, g, or t
tcagtacgagtatgcacgaccggtgctcgatttagcgagacgcgcagggtcctgggcccagtctgtgctgacgcagccgccctcagtgtcgtggggccccagggcaggagggtcaccattcctcctggcacggtgggacgccaccctaccaacgtagtcggggggtccgggttatgtagttcgtaacctacgtcggtaaccaggtccacgtccttccgaaggggacctaccggacccccctaaaacttccctactaacgtttcggtttacgggtaacacccgtaaaaccgtaacgtccccgggtaccccctacgggtaccggggggttccccttaacgggtaacccttacgtttccgttacgttccggacccttaccgtaaccggttccgttcggggacccttacccgtccgtacccggtacccttccccggacggtccctaacgttccgacggtcggggtaccctcggacgtccgtagggaacggtacgtagggacggttactacggtttaactcgttaccgaccggtccttaccgttacttaaggacgtacgtaaggtcgggaagtcgtggtaaggggttttcccggtaacgttgttacgggttctcgggtttacggtaccggtaccgggtaccggtaacgttccccggtaacgttaccgtaccgtacgtaaccccgaccgggtaaccccgaccccgttaacccgtaccgttacggtacccttaccggtttccccttaccccgtcccccttcccctttaccgtaacccttaccgttccgttcccggttagaccgggtccggtacgggtccgtaggaaccggtcgggacgagtacgancgnannnnnnnn

SEQ ID NO: 124436 - DNA, 673 bp, Homo sapiens
  misc_feature: GYAE6OF01B25XK.18.9.A09.1.454.CMB.1.raw
  modified_base (165)..(165): a, c, t, g, unknown or other
  misc_feature (165)..(165): n is a, c, g, or t
  modified_base (263)..(263): a, c, t, g, unknown or other
  misc_feature (263)..(263): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (665)..(673): a, c, t, g, unknown or other
  misc_feature (665)..(673): n is a, c, g, or t
tcagtacgagtatgcacgaccggtgctcgatttagcgagacgcgcagggtcctgggcccagtctgtgctgacgcagccgccctcagtgtcgtgggccccagggcagagggtcaccatctcctgcagtgggagcacctccaacagtcggggcggttatgatgtacnctggtaccagcagcttccgagggacaccgacccccaactcctcattcgtttggtacgactaacaagtccggccctacggtacgggtccctcgaccgtnttctcgtcggcctaccaagtctacggccaccgtcgtaccgtccctccgtcggcctatccgtacgtcgggcctaccggagtcgtggaggtatcggacggtctagtaccttatacgtcgaccgttacgtacctagacgtaacgaggtacggtacggtcgttagggttacgtttcggttacgttcgttcgtacggttacgtacggtacgggtaccggtaaacggtcccggtacctaccggttactaacggaccgtacccgaacccgaccgtaccccctaccgttcgtcccttacgtaccccttccgttccccgtcccccgtcccttacctacctaacgttcccgttacggtacggtggacccggtcgggtaccgtagggaaccggtcgacgagacggtancgngnnnnnnnnn

SEQ ID NO: 124437 - DNA, 720 bp, Homo sapiens
  misc_feature: GYAE6OF01ANH26.18.9.A09.1.454.CMB.1.raw
  modified_base (715)..(720): a, c, t, g, unknown or other
  misc_feature (715)..(720): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacacgtggtaccagcagcttccgagggacacgcccccaaactcctcattctttggtagacaacaactccggccctcgacgggggtccctggaccgtattctcgtggcctccaagtctggacacctcaccgcctcccgtcggcctatccacgtcgggcctccgaggctaggaggacgtggacggtctcgtaactacgttactcgacctacgtacctagtacgtactacgtggaaggtcgtaggtacggtttggtttccggttaagttcgttacgtttaccgggtacgttaccgtacgggggtaaaccctaacggggttaccgttaaccccggttaacccgttaaaacggtcccgaaccggaacccccgtaaccgggtacccccctaaaccccgttcgttacccggtaccttaacccgtttccgttaccccgtttacccccaacccctttaccctacccgtaacctttacccggttaaccggtacgttaccggaccggggtccggtccggtacggaaccggtaacggaccggtactaggtacgactcgatgctnnnnnn

SEQ ID NO: 124438 - DNA, 687 bp, Homo sapiens
  misc_feature: GYAE6OF01CMW3T.18.9.A09.1.454.CMB.1.raw
  modified_base (228)..(228): a, c, t, g, unknown or other
  misc_feature (228)..(228): n is a, c, g, or t
  modified_base (606)..(606): a, c, t, g, unknown or other
  misc_feature (606)..(606): n is a, c, g, or t
  modified_base (676)..(687): a, c, t, g, unknown or other
  misc_feature (676)..(687): n is a, c, g, or t
tcagtacgagtatgcacgaccggtgctcgatttagcgagacgcgcagggtcctgggcccagtctgtgctgacgcagcccgccctcagtgtcgtcgggccccagggcaggagggtcaccatctcctgcacgtgggagcacctccaacagtcggggcgggttatgatgtacactggtaccagcagcttccgagggaccacgacccccaaactcctacattcttttggganacaaacaacgtccggccctcgacgggggttccctaggtacccgtattttcgtggtccttaccgaagttctacggccacctacacgcccctaccgtcggaccacttcaaccgttcggggccttccgaaggtcctaggacgtagtaggacgtcgtagtaccgttatttaccgtgaccccgtagttcccgtaagtcgaacgtagttaggaaggtccgtaggtaaggttcgggttttacgtagttggttaccgttacggtacttacgggttaacgggaaccctaaacgggttccaaccccggttactaaacggtccaaccgggaaccccaacggtacccctaaacccctgtccgtacctaccgtccgtttccggttaccccncccgttacctactaccgttccgtaccgtagtcgggaagtccggtcgacggaccaagggctaccgagtagnnnnnnnnnnnn

SEQ ID NO: 124439 - DNA, 761 bp, Homo sapiens
  misc_feature: GYAE6OF01EVF78.18.9.A09.1.454.CMB.1.raw
  modified_base (135)..(135): a, c, t, g, unknown or other
  misc_feature (135)..(135): n is a, c, g, or t
  modified_base (145)..(145): a, c, t, g, unknown or other
  misc_feature (145)..(145): n is a, c, g, or t
  modified_base (269)..(269): a, c, t, g, unknown or other
  misc_feature (269)..(269): n is a, c, g, or t
  modified_base (743)..(743): a, c, t, g, unknown or other
  misc_feature (743)..(743): n is a, c, g, or t
  modified_base (758)..(758): a, c, t, g, unknown or other
  misc_feature (758)..(758): n is a, c, g, or t
  modified_base (760)..(761): a, c, t, g, unknown or other
  misc_feature (760)..(761): n is a, c, g, or t
tcagtacgagtatgcacgaccggtgctcgatttagcgagacgcgcagggtcctgggcccagtctgtgctgacgcagccgccctcagtgtctcggggccccaggcagagggtccaccatctcctgcacgtgggacncacctccaanagtcggggacggttatgatcgtaactagtcggtaccagctacgtccgttccaagggaccaccgaccccctaaactcctacattcgttggacacgaaactagtccgcccttagaccggggttccnggtacgtcttacggtcctaggtccttaccgaagttcccgtagacctaacccttcgaccgtcccgtaccgtcggacctactacgtcgtcggggaccctccgagggctaggaacggtagtcggtaacggtctaacgttactaacgttctcgtaacccgtagttccgaaactaggacctaagttaggggtacccggttaagtggggttacggttttaccggttaggtttaacttcgggtttaccgttcccgggtaagttaccgggtaacgggtaacccgttaaacggtcccgtaaccgttaaacccggtaacgttaccggaacccgtacccgtaaccgggtaaccccttaaccgttacccgtcgttacccgtacctttacccgtcccgttaccccgtaccttaccctaccgttaccttacgttacgttaaccgcgggtacggtcgttccgacggtacgaacgcggaccttagcgtancagtcaggtcatagntnn

SEQ ID NO: 124440 - DNA, 781 bp, Homo sapiens
  misc_feature: GYAE6OF01D11D9.18.9.A09.1.454.CMB.1.raw
  modified_base (749)..(749): a, c, t, g, unknown or other
  misc_feature (749)..(749): n is a, c, g, or t
  modified_base (756)..(756): a, c, t, g, unknown or other
  misc_feature (756)..(756): n is a, c, g, or t
  modified_base (766)..(766): a, c, t, g, unknown or other
  misc_feature (766)..(766): n is a, c, g, or t
  modified_base (769)..(769): a, c, t, g, unknown or other
  misc_feature (769)..(769): n is a, c, g, or t
  modified_base (771)..(772): a, c, t, g, unknown or other
  misc_feature (771)..(772): n is a, c, g, or t
  modified_base (777)..(778): a, c, t, g, unknown or other
  misc_feature (777)..(778): n is a, c, g, or t
  modified_base (780)..(781): a, c, t, g, unknown or other
  misc_feature (780)..(781): n is a, c, g, or t
tcagtacgagtatgcacgaccggtgctcgatttagcgagacgcgcaggggtccgtgggcccagtctgtgctgacgcagccgccctcagtgtcgtcggggccccagggcagagggtcaccatctcctgcacgtgggagccaccctccaacgaggtcgggggtacggttatgatgtacacgtggtaccagcacgtcctcgagggaccaccgaccccctaaactcctactacgttccgtttaggacgaccaaacgtaacgtcccgggccccttacgggtaccggggttcccctacggtaacccgttacgtttccgttcgtaccgggtacccttaacccgaacggttccgttacggaccctaacccgtccgtaccgtccccgttacccgtccggtaccctaaccgttccgaaccgggttcgggaccctccggaacggtccgtagggaacggtaggtacggacggttcgtacgtaacctttaacgttaccgcgtaccgtaacgtttccgtaagttacgacgtaagttacgggacggttacgtaggttaacggtttcgggtttacgtttaggttcgttacggttacggtacgttcccgggaacggtaaccgtaccgggttcctaaaccgggttacgtaagtcccgaaccgtaaccccggactaccccttacccgttcgtacgttaccctactttcccgttaccctaccccgtcccttaccgtacctacgttccgttacgtcgcggacgtcgtcgnggaccgngccgtagtancgngnngcacnncnn

SEQ ID NO: 124441 - DNA, 661 bp, Homo sapiens
  misc_feature: GYAE6OF01DNT33.18.9.A09.1.454.CMB.1.raw
  modified_base (558)..(558): a, c, t, g, unknown or other
  misc_feature (558)..(558): n is a, c, g, or t
  modified_base (584)..(584): a, c, t, g, unknown or other
  misc_feature (584)..(584): n is a, c, g, or t
  modified_base (651)..(651): a, c, t, g, unknown or other
  misc_feature (651)..(651): n is a, c, g, or t
  modified_base (653)..(654): a, c, t, g, unknown or other
  misc_feature (653)..(654): n is a, c, g, or t
  modified_base (656)..(661): a, c, t, g, unknown or other
  misc_feature (656)..(661): n is a, c, g, or t
tcagtacgagtatgcacgaccggtgctcgatttagcgagacgcgcagggtcctgggcccagtctgtgctgacgcagccgccctcagtgtcgtggggccccagggcaggagggtcaccatctcctgcacgtgggagccaccctaccaacagtcgggggacgggtttatggattcgtaaccactggtaccagcagccttaccgagggaccaccgaccccctaaaactcctactattcgttttaggtacgaccaaactaacgtccggcccgttcggaccgggggttccctacggaacccgttatttcctcgtacggctaccgtaacgtccgtcggcctacccgtcaccggtccctccgtcggccactcctacggcgggtcctccgacggtctacggaggagtaggcgtacgtagtaactttactaccgtcgaccgtacgtaccgtaatcgactagtcggtagtacgtggtacggttgtttcgtagttcgttcgtcggttagtcggtacggacgtaacggtcctaccgtactagtacgaccgacccgacgacccctacctcncgttcctaccgtccttccgtaccccncccttccgtcctactaccgttcgtcgtaggcggtcgggcctaggtacgcggacgtacgaatcggacngnncnnnnnn

SEQ ID NO: 124442 - DNA, 699 bp, Homo sapiens
  misc_feature: GYAE6OF01CQ4NN.18.9.A09.1.454.CMB.1.raw
  modified_base (158)..(158): a, c, t, g, unknown or other
  misc_feature (158)..(158): n is a, c, g, or t
  modified_base (256)..(256): a, c, t, g, unknown or other
  misc_feature (256)..(256): n is a, c, g, or t
  modified_base (682)..(682): a, c, t, g, unknown or other
  misc_feature (682)..(682): n is a, c, g, or t
  modified_base (686)..(686): a, c, t, g, unknown or other
  misc_feature (686)..(686): n is a, c, g, or t
  modified_base (690)..(690): a, c, t, g, unknown or other
  misc_feature (690)..(690): n is a, c, g, or t
  modified_base (695)..(699): a, c, t, g, unknown or other
  misc_feature (695)..(699): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagccacctccaacagtcggggcggttangatgtacactggtaccagcagcttaccgagggacacgcccccaaatcctcatctttaggagacaacaagtccggccgtcgacgggtccctagaccgtnttctcgtcggctaccagtctcggccacctcacgtccctcccgtcggaccacgtccacggtcggggtccctaccggacggtccgtaggaaggtacgtaggacgggtcttacgaactttacgttaccgtcgtacccgtacggttacctaagtcgaacgtagtacgggtaacggtcgtacggttaagggtttcgggtttactaacggttcggtttacgttcgggtacttccgggtaacgggaacccgttaacgggtaccctacccggttaaccgtacggtaccgaccggaccccgaaccggtacccctaacccgttcgtcgtaccctaccttccgttacccggttcccccgtccctacccgtacgttaacctaccgttaccgtacgtacggccggtacgggccgttacggaccgcgacgctaagtacgngtangtancgtannnnn

SEQ ID NO: 124443 - DNA, 643 bp, Homo sapiens
  misc_feature: GYAE6OF01DHJ61.18.9.A09.1.454.CMB.1.raw
  modified_base (150)..(150): a, c, t, g, unknown or other
  misc_feature (150)..(150): n is a, c, g, or t
  modified_base (436)..(436): a, c, t, g, unknown or other
  misc_feature (436)..(436): n is a, c, g, or t
  modified_base (626)..(626): a, c, t, g, unknown or other
  misc_feature (626)..(626): n is a, c, g, or t
  modified_base (630)..(630): a, c, t, g, unknown or other
  misc_feature (630)..(630): n is a, c, g, or t
  modified_base (633)..(639): a, c, t, g, unknown or other
  misc_feature (633)..(639): n is a, c, g, or t
  modified_base (641)..(643): a, c, t, g, unknown or other
  misc_feature (641)..(643): n is a, c, g, or t
tcagtacgagtatgcacgaccggtgctcgatttagcgagacgcgcagggtcctgggcccagtctgtgctgacgcagcccgccctcagtgtcgtcgggccccgagggcaggagggtcaccatctcctgcacgtgggacgcacctccaaacnggtcgggggacgggttatgagtgtacacgttcgaccagcacgtcctccgaacgggaccaaccgaccccctaaactccctactattcgtttaggacaccaaacgtaccgtccggtccccgtacggtaccggggtcccgtacggtaaccgtactttcctacgtccggccttaaccgacgttcgccggacctacctcgcccggttccctacccgtgacctactcgaccggtcggcctaccgagtcgagaggctaggcgtctacgaatttctacgccgctaccgttcaancgactaggtgaagtcggtaagtcgttcgttagtagtttcggtccgttagtacgtacggtacgtaaccgtacgtaccgtaccgtaccgtaagccgacgacccaaccgtcccacctcgtacgctacctccgtccctaccctccctaccgtactaccgtctacgtcgcgtaggtccgcgtcggacgacgacgntagngcnnnnnnncnnn

SEQ ID NO: 124444 - DNA, 717 bp, Homo sapiens
  misc_feature: GYAE6OF01DWLWY.18.9.A09.1.454.CMB.1.raw
  modified_base (708)..(708): a, c, t, g, unknown or other
  misc_feature (708)..(708): n is a, c, g, or t
  modified_base (712)..(714): a, c, t, g, unknown or other
  misc_feature (712)..(714): n is a, c, g, or t
  modified_base (716)..(717): a, c, t, g, unknown or other
  misc_feature (716)..(717): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagccacctccaacagtcgggggcgggttatgatgtacacgtggtaccagcagcttccgagggacacgacccccaaactcctctattcgtttaggtacgacaaactaacgtccggccctcgtaccgggggtccctacggaccgtactttctcgtcggcctaccgtaagtcgtcggcctaccgtctaccgccctccgtcggccactccgtaacgtcggggtcctaccggagggtcgtagggaacggtagtacgggtaggtacttagtacttaacgttacctcgaccgtacgttacctagtacgtaactggtaggacggtacgttagggtaggtttcggttacgttacggttcgttacggtacggttcgttaccggtacgggtaaccgtaaccggtaccgtacccgttaccgtaacgtcccgaaccggtaacccgaaccggtaccccctaacccttcgtacgttcctaccgttaccgttcccgttccccgtcccttacctacctaccgttaccgttaccgttacgtacggacgggtccgggcgtacgggtaccgagggaccgtagtacgacgtgatgacngacnnngnn

SEQ ID NO: 124445 - DNA, 758 bp, Homo sapiens
  misc_feature: GYAE6OF01EW1W0.18.9.A09.1.454.CMB.1.raw
  modified_base (746)..(746): a, c, t, g, unknown or other
  misc_feature (746)..(746): n is a, c, g, or t
  modified_base (752)..(752): a, c, t, g, unknown or other
  misc_feature (752)..(752): n is a, c, g, or t
  modified_base (755)..(758): a, c, t, g, unknown or other
  misc_feature (755)..(758): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacagtcgggggcggttatgatgtacactggtaccagcagcttccgagggaccacgcccccaaactcctactattctttggtagacaacaactccggccctcgacgggtccctagaccgtatttctccgtcggcctaccgaagttcctcggaccacctcgacgtccctcccgtcggacccacttccgaaccgtcgggcctccggtaacggccgtagggaagggagtcgggacggtcttacggtaactttaacgttaccgtcgtaccctacgttacccttaagtacgaacgtataggggaacgtcgttagggtaggttttacgggttacgttagttcggttacgtttacgggttaccgtcggtaacgggtaacccgtacgggttaccctacccgggttacggtaaccggtacgaacccggtaccccgaaacccgggtacccccaaacccccgttacgtaccgttccgtacctttcccggtttaccccgttcccccgttccccttacccgttacccgttaaccttacccggttaccggtttaaccgtcggggtaccggttccgggaccggtaccgggtaccgaacggggtccagttaacgcggatccnacgtcncannnn

SEQ ID NO: 124446 - DNA, 677 bp, Homo sapiens
  misc_feature: GYAE6OF01CYMR9.18.9.A09.1.454.CMB.1.raw
  modified_base (134)..(134): a, c, t, g, unknown or other
  misc_feature (134)..(134): n is a, c, g, or t
  modified_base (168)..(168): a, c, t, g, unknown or other
  misc_feature (168)..(168): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (351)..(351): a, c, t, g, unknown or other
  misc_feature (351)..(351): n is a, c, g, or t
  modified_base (423)..(423): a, c, t, g, unknown or other
  misc_feature (423)..(423): n is a, c, g, or t
  modified_base (668)..(677): a, c, t, g, unknown or other
  misc_feature (668)..(677): n is a, c, g, or t
tcagtacgagtatgcacgaccggtgctcgatttagcgagacgcgcagggtcctgggcccagtctgtgctgacgcagccgccctcagtgtcgtcgggcccagggcagagggtcaccatctcctgcacgtgggacncacctccaacgagtcggggcggttatgatgtacncgtgtaccagcagtcttaccgagggaccacgtaccccctaaaattgcatctataggaaacaatacgtccgcctcgacgggtccctcgcccgtattcgcgttaggctaccgagtctggcctaccnccgacgtccctccgcgtacccagtcncgtcggacctaccggaggtcctagaagttgagnggtacggtacttaggtatttaacgttcgacgtccctaaggttcctaagttacggaaactactttaaaccgtntaaccgtgggttacccgggtttgggttaaccgggggttccgttccggggacgggggtaaccgaccgttcggtacggttaccgggtaccggttgggttaccggttacgaccgaaaccccggttggcccttcccccggaccccgttcggtacctcccgttattcccccgtaccctacccttcccgtactacctacgttacctcgtaacggtccgagggtcctcggaacgtcgacgttagcagtcgcnnnnnnnnnn

SEQ ID NO: 124447 - DNA, 817 bp, Homo sapiens
  misc_feature: GYAE6OF01BB283.18.9.A09.1.454.CMB.1.raw
  modified_base (138)..(138): a, c, t, g, unknown or other
  misc_feature (138)..(138): n is a, c, g, or t
  modified_base (238)..(238): a, c, t, g, unknown or other
  misc_feature (238)..(238): n is a, c, g, or t
tcagtacgagtatgcacgaccggtgctcgattttagcgagacgcgctagggttccgtgggcccagtctgtgctgacgcagccgcctcagtgtcgtcgggccccagggcagagggtcaccatctcctgctacgtggganccaccgtccaacagtcggggcggttatgactgtactacgtggtaccagctagtccttcgagggacacgacccccaaacttccgtgagttcgtttgggtanacctaaactacgtccggccctcggacggggtcccctggaaccgtatttccgtcgtggccttaccgaagttccgttcggcctaccttcgaccgtccctaccgtacggacccacgtacctaccgtggggacccttacccggaggtccgttaggacggtagttacggacggtcgttacttaacgttaacgttacgccgtaccgttagttaccagtacgacgtaagtcggtagtaccgtaggtaggtttacggttacctaggtttcggttcgttaccgggtagtaccggtaacgggaacccgttaaccggtaccgtacccgtttaacccgtaacggtaccgtaaccgggtaacccccgtaacgggtaccccctttaaaccccggttcgtttaacccgttacccgttaaccgttcccgtttaacccgtttacccccgtaacccttaccgttaaccttaacccgttaaccggttaccgttaaccgttacggggaccggtcccggggaccgttaccggggtacgaaaccgggttaccgaacgtttaacgaggttccaacggactaggactacgactacgtgctacg

SEQ ID NO: 124448 - DNA, 700 bp, Homo sapiens
  misc_feature: GYAE6OF01EXG2V.18.9.A09.1.454.CMB.1.raw
  modified_base (266)..(266): a, c, t, g, unknown or other
  misc_feature (266)..(266): n is a, c, g, or t
  modified_base (679)..(679): a, c, t, g, unknown or other
  misc_feature (679)..(679): n is a, c, g, or t
  modified_base (686)..(686): a, c, t, g, unknown or other
  misc_feature (686)..(686): n is a, c, g, or t
  modified_base (695)..(695): a, c, t, g, unknown or other
  misc_feature (695)..(695): n is a, c, g, or t
  modified_base (697)..(697): a, c, t, g, unknown or other
  misc_feature (697)..(697): n is a, c, g, or t
  modified_base (699)..(700): a, c, t, g, unknown or other
  misc_feature (699)..(700): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtgggagcacctccaaacagtcggggcgggttatgatgtacactggtaccagcagtcttccgagggacacgacccccaaactcctctattctttggtacgcaaacaactccggccctcgacggggtccctgacctatttcnctcggctaccaagtctggccacctcacgcctcccgtcggccatccacgtcgggcctccgaggtcgtggacggagtggacggtctacgtacttagttaccgcgtacctacgttaccgtatacgactagtggacggtacttaggtacggtttacgggtttcgtttaagtcgtttaccgtttacggtacgttcggtacgggtaaccgtaacgggtcctaacccgttactaacgtaccgaccggacccgaaccggaccctaaccccgttcgtaccgtaccctaccttccgttccccttacccccgtacccttaccccgtacccttaaccgttacccgttaccgtttacccgttcgggaccgggtcccggggacggttaccgggacgtaaacccgggtcggtaccgtaacgttacggngcgtacncgtacacgncngnn

SEQ ID NO: 124449 - DNA, 757 bp, Homo sapiens
  misc_feature: GYAE6OF01DJAOU.18.9.A09.1.454.CMB.1.raw
  modified_base (452)..(452): a, c, t, g, unknown or other
  misc_feature (452)..(452): n is a, c, g, or t
  modified_base (728)..(728): a, c, t, g, unknown or other
  misc_feature (728)..(728): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
  modified_base (749)..(749): a, c, t, g, unknown or other
  misc_feature (749)..(749): n is a, c, g, or t
  modified_base (752)..(752): a, c, t, g, unknown or other
  misc_feature (752)..(752): n is a, c, g, or t
  modified_base (754)..(757): a, c, t, g, unknown or other
  misc_feature (754)..(757): n is a, c, g, or t
tcagtacgagtatgcacgaccggtgctcgatttagcgagacgcgcagggtcctgggcccagtctgtgctgacgcagcccgccctcagtgtcgtcgggccccagggcagagggtcaccatctcctgcacgtgggagccacctaccaacagtcgggggacggtttatgatcgtaccacgtaggtaccagcagtccttaccgagggaccaccgtaccccccaaaattcctactattccgttttaggaacaccaaactaacgtccggaccctacggaccggggtaccctaggtaccgttattccgtcgtcggaccttaccgtaagtccgttcggacctacctccgtacccgtcccgttacccgtcggaacctacgtaccgtacgggtaccgggtacctacgacgggttactagacgttacggaaggtggtaacggtctaagttactttaacgttcncggtaaccgtacttaccttaagactaaacctacgttactcgacgttacgggtgggttaccggttcgggggttactccggggacgggtaacgggaccgtacggtacgtaccgggtaccgggtccgggtacggtacccaacgggtaacccgcggtcccgtccccgtacccccggtacgttccgtaacccgttccgttccccggttccccctacgttcccctacgttaaccgttaccgtcgtaacggtcgaccggtgggtacccagggaccgtacggtnaacgtacgagtctncngtacngtnannnn

SEQ ID NO: 124450 - DNA, 689 bp, Homo sapiens
  misc_feature: GYAE6OF01ANPNH.18.9.A09.1.454.CMB.1.raw
  modified_base (677)..(677): a, c, t, g, unknown or other
  misc_feature (677)..(677): n is a, c, g, or t
  modified_base (684)..(685): a, c, t, g, unknown or other
  misc_feature (684)..(685): n is a, c, g, or t
  modified_base (687)..(689): a, c, t, g, unknown or other
  misc_feature (687)..(689): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctcaacatcggggcgggttatgatgtacactggtaccagcagcttccagggacacgcccccaaactcctcatctttggtagcaacaactccggccctcgacggggtccctgacccgattcctcgtcggcctccgaagtccttcgggcctaccctcgacggtccctcccgttggcccatccaccgtcggggcctcccgagggtcctggacggattcggacgggtctagacttattaccgtgcccgtagttcccgtatcgaccagttcggaaggtctaggtagttcgggtttacgtagttcggttcgtttcgggaacttccggtacgggaacccgtaacggttcccgtaacccgttacccgttaaacggtccgtaaccgaccccgtaaccggccccctaaaccccttcgttacgtccctaaccttcccttcccgtttacccccctaccccttccccttacccgtacgttaacccgttccggttaaccgtcggtaccgggtccgggtccgttacgggacccgaacggcccgtacctaagtcgcagngcacgcnncnnn

SEQ ID NO: 124451 - DNA, 768 bp, Homo sapiens
  misc_feature: GYAE6OF01AJQ9T.18.9.A09.1.454.CMB.1.raw
  modified_base (264)..(264): a, c, t, g, unknown or other
  misc_feature (264)..(264): n is a, c, g, or t
  modified_base (758)..(758): a, c, t, g, unknown or other
  misc_feature (758)..(758): n is a, c, g, or t
  modified_base (762)..(762): a, c, t, g, unknown or other
  misc_feature (762)..(762): n is a, c, g, or t
  modified_base (768)..(768): a, c, t, g, unknown or other
  misc_feature (768)..(768): n is a, c, g, or t
tcagtacgagtatgcacgaccggtgctcgatttagcgagacgcgcagggtcctgggcccagtctgtgctgacgcagccgcctcagtgtctgggccccagggcaggagggtcaccatctcctgcactgggagcacctccaacagtcgggggcgggttatgatcgtacactcggtaccagcagtcttcgagggcacgcccccctaaactcctcgattcgtttaggacgcaaacagtccggccctcgacgggggtcccctggacctnttcctgtcggcctaccgaagtctcggccaccttcgaccgtcctcccgtggccctagtccacggtcgggacctccgaggctaggaggtagtcggacggtcttacgaacgtttacttccgtacgtacctacgttacctacgtgaacgtgtacgggtcggcgttacggtagggttcgggtttcgttaacgttgtttacccggtttcggtaccgttacggtaccgggtaacccgtaacgggttcccgtacccgttaccgttaaggtacccgtaccggtaaccccgtaacccgggtaccccctaaccccgttcgtaccggttacccttacccgttcccggtttacccgtttcccccggtaccccttccccgtttaacccgactttacccggtaccggttaccgtacggggtacccgggtaccccggggtagtacccgggtaccgggtaaaccggtcccgtaaccggtacgttaacggcttaacggcttcgcggtaactncgtnttcggn

SEQ ID NO: 124452 - DNA, 856 bp, Homo sapiens
  misc_feature: GYAE6OF01D3PRE.18.9.A09.1.454.CMB.1.raw
  modified_base (844)..(844): a, c, t, g, unknown or other
  misc_feature (844)..(844): n is a, c, g, or t
  modified_base (848)..(848): a, c, t, g, unknown or other
  misc_feature (848)..(848): n is a, c, g, or t
  modified_base (850)..(850): a, c, t, g, unknown or other
  misc_feature (850)..(850): n is a, c, g, or t
  modified_base (852)..(856): a, c, t, g, unknown or other
  misc_feature (852)..(856): n is a, c, g, or t
tcagtacgagtatgcacgaccggtgctcgatttagcgagacgcgcagggtcctgggcccagtctgtgctgacgcagcccgccctcagtgtcgtcgggccccagggcagagggtcaccatctcctgcacgtgggagccaccctccaacgaggtcgggggtcgggttataggattgtacacgtcggtaaccagacgacgtcttaccgacgggaaccaccgacccccaaactcctctacgttcgtttaggtacgacaaacgaaccgttcccggccctacggaccggggttcccctacggtacccgttacgttccgttcgtccggtaccttaccgtaaggttcccgtccggtaccctacccgtaccgtacccgtcccttcccggtacggtccctaacgttaccgtaaccgggttccggggtaccctaccgggacggtacccggttagggacgggtactacgggaccggttacgttacgtaaacctttacgttaccgccttacgtaaccggttctacgacgtacgaaggtggtacggtcgttaggtacgggtttcgggttacttaacggttcggtttacggttaacgggtaccgttacggggtaacccggtaaccggttaaccggttaccccggttaaccggttaaccccgttaacgggtacccgaaccccggtaaaccccggtaacccggtaccccctttaccggttccgttaaccgttaccctacccgtttcccgtacccccgtttacccctccccttaacccgtacccttaaccgttacctttaccgggtaccgtacggtaccgggccgggtaccgtacgggaccggtacggctacgtaagcagcngtcncncnnnnn

SEQ ID NO: 124453 - DNA, 803 bp, Homo sapiens
  misc_feature: GYAE6OF01EAQGO.18.9.A09.1.454.CMB.1.raw
  modified_base (129)..(129): a, c, t, g, unknown or other
  misc_feature (129)..(129): n is a, c, g, or t
  modified_base (784)..(784): a, c, t, g, unknown or other
  misc_feature (784)..(784): n is a, c, g, or t
  modified_base (792)..(792): a, c, t, g, unknown or other
  misc_feature (792)..(792): n is a, c, g, or t
  modified_base (796)..(797): a, c, t, g, unknown or other
  misc_feature (796)..(797): n is a, c, g, or t
  modified_base (799)..(799): a, c, t, g, unknown or other
  misc_feature (799)..(799): n is a, c, g, or t
  modified_base (801)..(801): a, c, t, g, unknown or other
  misc_feature (801)..(801): n is a, c, g, or t
  modified_base (803)..(803): a, c, t, g, unknown or other
  misc_feature (803)..(803): n is a, c, g, or t
tcagtacgagtatgcacgaccggtgctcgatttagcgagacgcgcagggtcctgggcccagtctgtgctgacgcagcccgcctcagtgtcgtcgggcccggaggcagaggtcacatctctgcagtgganccacctaccaacgtaggtcgggggtacggttagtgtatgtactacgtacggtacagcacgtccgttaccgacgggaccaccgacccctaactcctactacgttcgttaggaacaacgaaacgtaacgtcccggtacctaccggggtaccggttacccctacggtaccttacgttttccgtcggtaccggtaccttaaccggtaacggttccgtacgtaccctacccgttaaccgacccgtcccttacccggttaccgacctcgtaaccggtacgttccggccggtacgacggtacgtaggaccggtagtcggacgtcgttaagtaccttaacgttaccggtactaccggttaacttacgttaacgtaacggtaaaccttgggtaacggtcgttaaggttaggtttaaccggtttacggtacgtttacggtttacgtccggtttacggtacggttacggtaaccggtacccggttaacggtaccccgtaacgttaaccgtaacgaccgtacgtaaccccgaaccgtaaccctaaccgttccgtactaccctacggttacccttccccggtccctacccttaccctacccgttacttaccgttaccggacgttagggccgtaacggtcgtaaggtaccacggacggtaccagtacgncgacgacngacnncngngn

SEQ ID NO: 124454 - DNA, 997 bp, Homo sapiens
  misc_feature: GYAE6OF01BZZZN.18.9.A09.1.454.CMB.1.raw
  modified_base (971)..(971): a, c, t, g, unknown or other
  misc_feature (971)..(971): n is a, c, g, or t
  modified_base (988)..(988): a, c, t, g, unknown or other
  misc_feature (988)..(988): n is a, c, g, or t
  modified_base (995)..(995): a, c, t, g, unknown or other
  misc_feature (995)..(995): n is a, c, g, or t
tcagtacgagtatgcacgaccggtgctcgatttagcgagacgcgcagggtcctgggcccagtctgtgctgacgcagcccgccctcagtgtcgtcgggccccagggcagagggtccaccatcctcctgcacgtgggagccaccctaccaactaggtcgggggtacgggttatgattacgtacacgttacggtaccagcagtccgttacgaacgggaccacccgaccccctaaactccctactattcgtttaggacgtacaactaaccgtccgtccctcggtaccgggtccctagtaccgttacttaccgtcgtcggtacctaccgtaggttccgtcggaccctacccgtcctaccgtcccttccccggaggtcccctacgtaccccgtacggtcgggtacccgtaccggtacggtaccgtttaggggaacggtacggtaaccgggtacggttacccgttacggtttaaaacctttacgtttaaccccggtcggttaaaccggttaccctttaaccgttaaaggttcccggtaaaggtaccgtttaaggggaacggtttccggtcgggtttaacgggggttttacccgttttacggggttttaaaccgttcgggttttaacccgtttttccgggtaaaccggtttccgggttaacccggggttaaacccggtaaccccgggtttaccccggttaaacccgggttttaaaccccttaaaccgggtaccccgtaaaaccccgggtaaccccccgtaaaccccgggttacccccccgttaaccccggtttccctttacccggttaccccctttacccgtttacccccgtttaccccgttacccccctttaaccccccgttacccggttacccttaaccccgttacccggtttaacccggtttaccgaaccgggtacccgggtccgggttacccggaccgggttaccgacccgggtaaccgaacggttgttaacggntacctcgtacaggtacncctagcngc

SEQ ID NO: 124455 - DNA, 808 bp, Homo sapiens
  misc_feature: GYAE6OF01C84D2.18.9.A09.1.454.CMB.1.raw
  modified_base (775)..(775): a, c, t, g, unknown or other
  misc_feature (775)..(775): n is a, c, g, or t
  modified_base (781)..(781): a, c, t, g, unknown or other
  misc_feature (781)..(781): n is a, c, g, or t
  modified_base (796)..(796): a, c, t, g, unknown or other
  misc_feature (796)..(796): n is a, c, g, or t
  modified_base (799)..(799): a, c, t, g, unknown or other
  misc_feature (799)..(799): n is a, c, g, or t
  modified_base (802)..(802): a, c, t, g, unknown or other
  misc_feature (802)..(802): n is a, c, g, or t
  modified_base (805)..(805): a, c, t, g, unknown or other
  misc_feature (805)..(805): n is a, c, g, or t
  modified_base (807)..(807): a, c, t, g, unknown or other
  misc_feature (807)..(807): n is a, c, g, or t
tcagtacgagtatgcacgaccggtgctcgatttagcgagacgcgcagggtcctgggcccagtctgtgctgacgcagcccgccctcagttgtccgtcggggccccagggcaggaggtccaccatctcctgcacgtgggagccacctaccaacgagtcgggggtacgggtttatggaatcgtaacacgtggtaccagcgagtcttaccgagggaccacccgaccccctaaactcctactagttcgtttaggtacacctaaacgtaaccgtcccggtaccccgtccggtacgggttcccgtaacgtaccgttacttccttacgcggtcctaccgaagtccgtacggacctacccgtcaacccgtccctcccgtaccggcctacgttaccaacggtcggtaccgccggtaacggccggttaggaggtacgtaggtccgggtacgttacgtaacgtttaacgttccgtacggacccgtttaaaccgttccgttaacggtaagtacccgtaagttggggtaacggtacgtttaggtacggtttacggtttcggtatttccggtacggtttcgtacgtacgggtacccgggtaacgtacggttacccgttaaccggttacccgtacgtaccaaccgtaacccggacccgtaaccccgtacccgttactccgttaccctccgttcccgttcccgtaccccctccttcccgttaactccgtttaacccgcggttaccgtacgggtccggcgttacgggtccgtaaacgggtcgtaccggtaacnggtacncgtcgacctggtccncgngcncgngng

SEQ ID NO: 124456 - DNA, 691 bp, Homo sapiens
  misc_feature: GYAE6OF01BFIKX.18.9.A09.1.454.CMB.1.raw
  modified_base (143)..(143): a, c, t, g, unknown or other
  misc_feature (143)..(143): n is a, c, g, or t
  modified_base (261)..(261): a, c, t, g, unknown or other
  misc_feature (261)..(261): n is a, c, g, or t
  modified_base (679)..(679): a, c, t, g, unknown or other
  misc_feature (679)..(679): n is a, c, g, or t
  modified_base (684)..(689): a, c, t, g, unknown or other
  misc_feature (684)..(689): n is a, c, g, or t
  modified_base (691)..(691): a, c, t, g, unknown or other
  misc_feature (691)..(691): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtgggagcacctccaacngtcggggcggttatgatgtacactggtaccagcagtcttccgagggaccacgcccccaactcctacattcgtttggtagacaacactccgggccctacgacggggtccctgaaccgtnttccgtctggcctaccgaaggtcctggacctccgtcacggcccttcccgtggccctacgtccgtaccgtggggccttaccggagggtcctagggacggagttacggacggtcttacggtaccttagttaccgtcgaccgtacgttacctagtacggactcgtaggaggtacgtgagggtttcggtttacgttagtcggttaccgttcgggtagttaccggtcgggtaacccgtaggtaccggttacccgttcggtaacggtacccgaaccggtaccccggaacgggtaccccctaaacccgtaccgtttccgtaccttctaccccggttcccgttaccccgtccccttaccgttaccctacgttaccttcgtaccgtcggtacggcccggtcgacggtaccgacggctacgacgtgcngctannnnnngn

SEQ ID NO: 124457 - DNA, 725 bp, Homo sapiens
  misc_feature: GYAE6OF01C7YVE.18.9.A09.1.454.CMB.1.raw
  modified_base (718)..(718): a, c, t, g, unknown or other
  misc_feature (718)..(718): n is a, c, g, or t
  modified_base (720)..(721): a, c, t, g, unknown or other
  misc_feature (720)..(721): n is a, c, g, or t
  modified_base (725)..(725): a, c, t, g, unknown or other
  misc_feature (725)..(725): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcacgtggagccacctccaacagtcggggcggttatgatgtacacgtgtaccagcagtctcgaggacacgacccccaactcctcatcgtttggacgacaacacgtccggaccttcgacgggtccctgaccgtattccgtcgtggccttaccgaagtcgtcggcctaccctacgaccgcccgttccgtacggacctactccgtaacgtcgggtacctaccgacggtccgttaggaaggtacgttacgggacggtactacgttaacgttaactaccgtcgacctaccgttcaacgtgaactaggcgtaggtctcggtaggttcgggtttaatcggttcgtttccgtacggttacgtacggtaccgggtaacgtaaccgttaccggtacccgttacggtaacgacccaacccggacccgaacgtaacccccgtaccgtactaccggtacctacccgtttccgtacccccgttaccctaccccttacccggttaacacccgtttaccgttaccggtaccgtacgggttacgggacccgggtactaccggggaacccgtaccgggttacgtaacgtaacgtaggtcacggtaccagcgacancnncgtn

SEQ ID NO: 124458 - DNA, 852 bp, Homo sapiens
  misc_feature: GYAE6OF01EBD07.18.9.A09.1.454.CMB.1.raw
  modified_base (133)..(133): a, c, t, g, unknown or other
  misc_feature (133)..(133): n is a, c, g, or t
  modified_base (834)..(834): a, c, t, g, unknown or other
  misc_feature (834)..(834): n is a, c, g, or t
  modified_base (847)..(849): a, c, t, g, unknown or other
  misc_feature (847)..(849): n is a, c, g, or t
  modified_base (851)..(852): a, c, t, g, unknown or other
  misc_feature (851)..(852): n is a, c, g, or t
tcagtacgagtatgcacgaccggtgctcgatttagcgagacgcgcagggtcctgggcccagtctgtgctgacgcagccgccctcagtgtcgtcgggcccagggcagaggtcaccatctcctgcacgtgggacncacctccaacagtcggggcggttatgatgtacactggtaccagcagtcctacgaggaccacgacccccaaactcctcagttcgtttggaagaccaactacgtccggtaccctcgacggggttccctaggacctatttcctcgtcggtcctaccgtaaggtccgtcgggaccctaccgtccgtaccgtcccttcccgtacggtacctaacttcccgtaaccggtcggggtccttacccgggaagggtccgttagggacggtaacgttcgggaaccggttcttacgttaaactttacgtttaccgtacggtacccgtaaccgtttaccgtaacgtacgtaaaccggtgttacggggtaaacggttaccggtttagggttaaccggttttggggtttacctttaaggtttcccggtttacccggtttaaccgggtacggtttaccccggggttaaccggggtaaacccgttaaaccggggttcccttaaaccccgggttttaacgttaaaaccgggtaccccggaaaacccggggtaacccccgtaacccggttaaccccccgttaaacccgttcggtacggttaccctacccgtttacccgttccccgttacccccaaccctttcccgtactaaccggtttccttaaccgtccgggagtaccgggccggtacggtaacccggcgtaaacggtccaacgttgancgatccgatcacnnngnn

SEQ ID NO: 124459 - DNA, 818 bp, Homo sapiens
  misc_feature: GYAE6OF01C0X04.18.9.A09.1.454.CMB.1.raw
  modified_base (800)..(800): a, c, t, g, unknown or other
  misc_feature (800)..(800): n is a, c, g, or t
  modified_base (804)..(804): a, c, t, g, unknown or other
  misc_feature (804)..(804): n is a, c, g, or t
  modified_base (806)..(806): a, c, t, g, unknown or other
  misc_feature (806)..(806): n is a, c, g, or t
  modified_base (813)..(813): a, c, t, g, unknown or other
  misc_feature (813)..(813): n is a, c, g, or t
  modified_base (815)..(816): a, c, t, g, unknown or other
  misc_feature (815)..(816): n is a, c, g, or t
tcagtacgagtatgcacgaccggtgctcgatttagcgagacgcgcagggtcctgggcccagtctgtgctgacgcagccgccctcagtgtctcggggccccagggcagagggtccaccatctcctgcacgtgggacgacctacctaccaacaggtcgggggtacgggttatggatgtacacgtggtaccagcagtctacgagggaccaccgaccccctaactcctctacttcgtttaggtacaccaaactacgtcccggacccgtacggaccgggtccctaggaccgtacttccgtcgtacggtaccttaccgtaacggttccgtacggtacctaccctaccgtaccgtcccctccggtacggaccctagtacccgtacggttcgggtccctaaccggtggtaccgtagggaacggtacgtagggacgtacgttacggttaacctttacgttaccggaccgtaccgttaacgttacctttaaggtacaacggttacggtacgggtacggtttcggtacgggttttacggtttacgggttttaacgttacggttttcccgggtttacgggttacggttaacgttcccgggtaacggggtaaacccggttacggttacccccggtaaaccgttaacccgtttggaaacccacccggtaaccccggtaccggtacccctaccgtttccgccgtttacccttacgtttaccccggttccctaccccttacccgttcctaaccgttacttaccgtacgtcggtacggaccgtcgggtaactacggacgtccgacgttacagcgtancgtnanacgctancnnac

SEQ ID NO: 124460 - DNA, 835 bp, Homo sapiens
  misc_feature: GYAE6OF01EUFO3.18.9.A09.1.454.CMB.1.raw
  modified_base (140)..(140): a, c, t, g, unknown or other
  misc_feature (140)..(140): n is a, c, g, or t
  modified_base (822)..(822): a, c, t, g, unknown or other
  misc_feature (822)..(822): n is a, c, g, or t
  modified_base (826)..(826): a, c, t, g, unknown or other
  misc_feature (826)..(826): n is a, c, g, or t
  modified_base (828)..(835): a, c, t, g, unknown or other
  misc_feature (828)..(835): n is a, c, g, or t
tcagtacgagtatgcacgaccggtgctcgatttagcgagacgcgcagggtcctgggcccagtctgtgctgacgcagcccgccctcagtgtcgtcggggccccagggcaggagggtccaccatcctcctgcacgtgggacncctaccctaccaacgaggttcggggggtacgggtttatgattcgtaacctacgtacggtaccagcacgtccgttaccgaagggaccacccgacccccctaaaactccctacgtactttcgttttagggaacaccaaacaaccggttcccggccccgttacggaccgggggttccccctacggtaacccgttacttttcctccggtggtaccccttaacccgtaacggttccgtaccggaccctacccgttccgacccgtcccccgttcccgtacggcccctaacgttcccgaaccggggttcgggaccccttacccggaagggttccgtagggaaggtacgtggggaacggtcttacggttaaactttacgttaccgcgtaccgttaacgtctaagttacgacgtagtggacgttcggttagtcggttttggttacgttcgttcgggtttccgtacgggttacgttacgggtaacccgggtaacccgtaccggtttaccgaacccggtttaactaaaccggaccaaccggtaaccccccgaaccggtaccccttaaccccgttgttacccgtacctttacccgttcccccgtttcccgttaccccccctcccttacccgtaccttaacttacccgttcggtacgttcggacgggtccggacgtccggaagtaccgacgatangcangnnnnnnnn

SEQ ID NO: 124461 - DNA, 694 bp, Homo sapiens
  misc_feature: GYAE6OF01BW5RX.18.9.A09.1.454.CMB.1.raw
  modified_base (140)..(140): a, c, t, g, unknown or other
  misc_feature (140)..(140): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (684)..(686): a, c, t, g, unknown or other
  misc_feature (684)..(686): n is a, c, g, or t
  modified_base (688)..(694): a, c, t, g, unknown or other
  misc_feature (688)..(694): n is a, c, g, or t
tcagtacgagtatgcacgaccggtgctcgatttagcgagacgcgcagggtcctgggcccagtctgtgctgacgcagcccgccctcagtgtcgtcggggccccgagggcaggagggtccaccatcctcctgcacgtggganccaccctaccaacagtcgggggtcgggttatgatgtacacgtggtaccagcacgcttccgagggaccacgacccccaactcctcattcgtttgagacaacacgtccggccctcgaccgggtccctcgaccgtnttcnctcgcctccagtcngccnccacnccgccctcccgtcggcctcgtaccgacggtcgggtcctacccggaggtcgtagggtacggagtcgggaacggtgtacggtaactttacgttacgtcgaccctacgttacctagtacacgtagtacggagggtccgtaggtaagggtttcgggtttaccgttagtttccggtaacgtttcggacgttcggtacgggtaccgtacggttacccgtacccgttaccgtaacgtaccgaccgaccccggtaacccgaccccttaaccccgtctaccgtccctaccgttccttaccccgttcccctacccttccctaccttaccgttacccgttcggtccgttagggccgtcgggccggtccggacggtacgacggtactagtacggcnnncnnnnnnn

SEQ ID NO: 124462 - DNA, 924 bp, Homo sapiens
  misc_feature: GYAE6OF01C07Z1.18.9.A09.1.454.CMB.1.raw
  modified_base (920)..(920): a, c, t, g, unknown or other
  misc_feature (920)..(920): n is a, c, g, or t
tcagtacgagtatgcacgaccggtgctcgatttagcgagacgcgcagggtcctgggcccagtctgtgctgacgcagcccgccctcagtgtctcggggccccagggcagagggtcaccatcctcctgcacgtgggacgccaccctccaaacgagttcggggggccgggtttaatcggtagttcggtaacctacgttcgggtaaccagcaagtcctttccgacggggaccaccggaccccccaaaacttcctacctagttccgttttgggtaacacaaacaacgtcccggtccctcggtacggggtccctacggtaccgtacttccgttcgtcggtccttacccgaacggttccgtcgggtaccctaacccgttaccgaaccggtccccgttcccggttcgggtaccccaacgttcccggtaaccggttcgggggtaccccttacccggtacgggtccgttagggaaccggtagtaccgggacggttccgttacggtaaccgtttaaccttaccggtccgtaccgtacggtttacctacggtacgtaaccgttacggtacgggtacggttccggtagggttaacgggttccgggttttaacggttacgtttccggtttaccggttaccgggtacgtttaccgggtaacccggggaacccgttaaccgggttaccccgttaacccgttaccggttaacgtacccgaacccgggtaccccggtaacccggtacccccttaaccccggttccgtacccggtacctttcccggttcccttacccggtttccccccgtaccctttacccgtacccgttaacgtttaccccgtttccggtaaccggttcgggaccggggtacccggttaccggtacgggaccgttaacggggcccttacggtaagtgctgatcgtactctaggcctgntccg

SEQ ID NO: 124463 - DNA, 868 bp, Homo sapiens
  misc_feature: GYAE6OF01BB2Q1.18.9.A09.1.454.CMB.1.raw
  modified_base (134)..(134): a, c, t, g, unknown or other
  misc_feature (134)..(134): n is a, c, g, or t
  modified_base (852)..(852): a, c, t, g, unknown or other
  misc_feature (852)..(852): n is a, c, g, or t
  modified_base (861)..(861): a, c, t, g, unknown or other
  misc_feature (861)..(861): n is a, c, g, or t
  modified_base (863)..(864): a, c, t, g, unknown or other
  misc_feature (863)..(864): n is a, c, g, or t
  modified_base (866)..(868): a, c, t, g, unknown or other
  misc_feature (866)..(868): n is a, c, g, or t
tcagtacgagtatgcacgaccggtgctcgatttagcgagacgcgcagggtcctgggcccagtctgtgctgacgcagccgccctcagtgtcgtcgggccccagggcagagggtcaccatctcctgcacgtggganccacctccaacagtcggggcgggttatgactagtacacgtacggtaccagacgagtccgttaccgacgggaccacccgaaccccctaaactcctactagtttccgtttaggtaacgacaaaccgtacgtacccggtccccgttaccggtaccggggtccccgtacgaccgttactttccgtccggtacggacccttaccgtaacggttccgttcgggaccctacccgtaccgacccgttcccgtcccgttacggacctacgtacccgtaccgggtcgggtaccctaccggtacgggtaccgtaggaagggtagtacgggacggtacgtacgtaacgtttactaccgtcgtacctacggttccgtaagtacgacggttacgtgggtacggtacggttaggttacggtttcgggtttaacgttacggtttacgtttccgggttacggttaccggtttacccggggtaaccgggttaacccgggttaaaccgggttaaccccgttaaccccgggttttaacccggtaaccgtaaccggtaaccccgggtaaacccccgtaaccccggaaccccgtttaaaccccgtccgtttacccgtaccgtttaccccgttcccgttaccccgttccccgttacccccgttaccttaccccttacgttacccgttcgtacggtacggacggttaccggcggtacggcgggaacggtccgtagtcgtagngagcagtcncnngnnn

SEQ ID NO: 124464 - DNA, 816 bp, Homo sapiens
  misc_feature: GYAE6OF01BTCSP.18.9.A09.1.454.CMB.1.raw
  modified_base (138)..(138): a, c, t, g, unknown or other
  misc_feature (138)..(138): n is a, c, g, or t
  modified_base (795)..(795): a, c, t, g, unknown or other
  misc_feature (795)..(795): n is a, c, g, or t
  modified_base (800)..(800): a, c, t, g, unknown or other
  misc_feature (800)..(800): n is a, c, g, or t
  modified_base (806)..(806): a, c, t, g, unknown or other
  misc_feature (806)..(806): n is a, c, g, or t
  modified_base (811)..(811): a, c, t, g, unknown or other
  misc_feature (811)..(811): n is a, c, g, or t
  modified_base (813)..(814): a, c, t, g, unknown or other
  misc_feature (813)..(814): n is a, c, g, or t
tcagtacgagtatgcacgaccggtgctcgatttagcgagacgcgcagggtcctgggcccagtctgtgctgacgcacgccgccctcagtgtcgtcggggccccgagggcaggagggtcaccatctcctgcacgtggganccacctccaacgagtcgggggtacggtttaatgatagtaccacgttcggtaaccagactacgtccgttaccggaagggaccaacccgtaacccccctaaacttccctactactttcgtttacggtacgaacctaaacgtaacgtcccgggtaccctacggtaccgggtcccctacggtaccgtactttccgtcgtacggtacctacgtaacgtcgtcggacctctcgaccgtcctaccgcgacctacgtccgtacgcggtacctcggaggtccgtaggaggtacgtagggaaccgtcgttacgtaaactttacgttacggcgtacctacgtacttaactaaagtaaaccgtacgaaccggtacccgaacctagtaaccctacttacgttacgtttacgtaccgggtttaacgtaacgggtaaccgggtaccggtaacccgtaaccgggttccgttaacccggttaccggaaccgttaacccgaacccgtaacccggaacccgtcccccttaaacccggtcgttaaccgttacccttacccgtttccctacccccgtacccgtttaaccccctcccgttaaccttaccgttaccgttaacccggttcggtaccgggaccgtaccgggccgttacggaccgtaaccgaccgtacgtaanccgtnccgtantcagncnnga

SEQ ID NO: 124465 - DNA, 709 bp, Homo sapiens
  misc_feature: GYAE6OF01ANFXA.18.9.A09.1.454.CMB.1.raw
  modified_base (133)..(133): a, c, t, g, unknown or other
  misc_feature (133)..(133): n is a, c, g, or t
  modified_base (348)..(348): a, c, t, g, unknown or other
  misc_feature (348)..(348): n is a, c, g, or t
tcagtacgagtatgcacgaccggtgctcgatttagcgagacgcgcagggtcctgggcccagtctgtgctaacgcagccgccctcagtgtctggggccccagggcagagggtcaccatctcctgcactgggacncaccctccaacgactcgggggtcgggttatggatgtacactggtaccagcagcttccagggacacgaccccaaactcctcattctttggtagcaaacgaactccggccctcgaggggtccctgaaccgattctcgtggtcctccgaagttctggccacctcgacgccctcccgtggccacttccgacgtcggggcctccgaggtctaggacggtntggacggtctgaacttattaactgtacctagtcctaagtacgactagtcggtaggcttgggaggtttcggttacgtagttccggttcgttacggtacttcggacggtaacccgtaaggtacctaccggttaccgtaacggtccaaccggtaccccgaaaccgggtacccctaacccccgttcgtaccgtacccgtaaccgttcccgttacccgtttacccccctaacccgttccccgttaaccgtaccgtttaaccgttcccggttaaccgtacggtaacgggtcccgggtacttacgggaacgtaaccgggtccgtaaccgttaagtaccgagtcgacgtcgacgcgtagctgtgtcgac

SEQ ID NO: 124466 - DNA, 764 bp, Homo sapiens
  misc_feature: GYAE6OF01BAJU5.18.9.A09.1.454.CMB.1.raw
  modified_base (744)..(744): a, c, t, g, unknown or other
  misc_feature (744)..(744): n is a, c, g, or t
  modified_base (748)..(748): a, c, t, g, unknown or other
  misc_feature (748)..(748): n is a, c, g, or t
  modified_base (757)..(757): a, c, t, g, unknown or other
  misc_feature (757)..(757): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
tcagtacgagtatgcacgaccggtgctcgatttagcgagacgcgcagggtcctgggcccagtctgtgctgacgcagcccgccctcagtgtcgtcggggccccagggcagagggtcaccatctcctgcacgtgggagcacctccaacagtcggggcggttatgatgtacacgtggtaccagcagtcttccgaagggaccacgacccccaaactcctctattctttggatacaaactaacgtcggccctcgacggggtcctacgaccgtacttccgtctcgggtcctaccgtaggtcctggacccacgtccgtaccgtccccttccgtacggaccctacttccgcgtcggggtcctacccgagggtccgtacggaggtacgtcggtacggtcttacggtaccttaacgttccgtaacgtccttaacggtccttaagacgtactaggtcggacggtcgttaggtaccgggtttgttaacgtttcgtacgttcggtacgggtagtccggtaacgggaccggttaacggtaccccgtaccggttaaccgtacgttacccacggaaccccggtaacccgtaccccttaaccccgtcttaccgttaccgttacccgtttacccggttcccgttccccccgtacccttaccccgtttaccgtaacccgttaacccggttacggtaccggggtaacccggaccggggttccgtaacgggtacccgaacggtccggacggttaaagtcggacgngtcngcgtcacgnacngngc

SEQ ID NO: 124467 - DNA, 751 bp, Homo sapiens
  misc_feature: GYAE6OF01DG9IU.18.9.A09.1.454.CMB.1.raw
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (715)..(715): a, c, t, g, unknown or other
  misc_feature (715)..(715): n is a, c, g, or t
tcagtacgagtatgcacgaccggtgctcgatttagcgagacgcgcagggtcctgggcccagtctgtgctgacgcagccgccctcagtgtctgggcccagggcagaggtcaccatctcctgcactgggagcacctccaacagtcgggcgggttatggatgtacactggtaccagcagcttaccagggacacgccccaaatcctcatctttggaancaacaancggtccncgagggtcccngacgtattctctggctaccaagtctgcacctnacgcctcctaggcctatccgactcggggcctaccgacggcttggacgtaggtgaacggtctcggtaactnttaaccgngtacccgtaggttaccgtagtaccgtaactacggtgaagggaccttagggaggttaccgggttttctaaaccgtttgggtttccgtaaggttaccgttaccggtttaacggggacctttaaaaccgggtccgtaaaccccgtttacgtaagggttaacccgaggtaccccccgaaagggtccccaaaccccccgtttgacgtttaaccccgtacgtccccgtttaccggttacccccttaacctaccccggtttaccaaaccgtttccttaaccccgggttttagacccgggtacggggtccccgggtaacccggttagggaaacccgtaaccgggacccgttaaccggtaacggttaacccgggngtaacgccgttagacccgtaatcgagtcgtcgtacg

SEQ ID NO: 124468 - DNA, 791 bp, Homo sapiens
  misc_feature: GYAE6OF01DHBOC.18.9.A09.1.454.CMB.1.raw
  modified_base (121)..(121): a, c, t, g, unknown or other
  misc_feature (121)..(121): n is a, c, g, or t
  modified_base (139)..(139): a, c, t, g, unknown or other
  misc_feature (139)..(139): n is a, c, g, or t
  modified_base (776)..(776): a, c, t, g, unknown or other
  misc_feature (776)..(776): n is a, c, g, or t
  modified_base (779)..(779): a, c, t, g, unknown or other
  misc_feature (779)..(779): n is a, c, g, or t
  modified_base (781)..(782): a, c, t, g, unknown or other
  misc_feature (781)..(782): n is a, c, g, or t
  modified_base (784)..(787): a, c, t, g, unknown or other
  misc_feature (784)..(787): n is a, c, g, or t
  modified_base (789)..(789): a, c, t, g, unknown or other
  misc_feature (789)..(789): n is a, c, g, or t
  modified_base (791)..(791): a, c, t, g, unknown or other
  misc_feature (791)..(791): n is a, c, g, or t
tcagtacgagtatgcacgaccggtgctcgatttagcgagacgcgcagggtcctgggcccagtctgtgctgacgcacgcccgcctcagtgtcgtcgggccccagggcaggacggtccacctntctcctgctagtgggacncctaccaccaaacgtggtccgggggtaggttatgactgtactacgttcggaccagtcagtcctacggacggacctacccaccccctaactcctactcgttcgtttacgaacgtaccaaacgtaccggttcccggcccgtcgggtaaccgggttcccgtaacggtacccgttacttccgtcgttcggtaccctaaccgtaacggtccgtccggaacccttcccctagccccgttccctccggaagtccccgtaatccggtccgggtcggtccctaccggcgggacgttaacggggaggtaacgtgggtaaccgtccgtttaacttaaacgggtttccctacggttaaccggcctttaaccgtaacgtttacggtcgtaaaagccggtttagggaaccggtttggtttaacgggtttgggtttaccgtttccgtgtttccgtacggttccggtaacgtcggtacgtacggtaccgttaccgtacgtacgtactcgacccgtaccgaaccctcccgtacctacgttcctaaccgtccgttcccttaccccggtcccttaaccccctcgtacccttccgttaccgtacggtaccggtaccgggccgtacggccgttacggaccggaacgtcctcgaagtcncgngnncnnnngngn

SEQ ID NO: 124469 - DNA, 831 bp, Homo sapiens
  misc_feature: GYAE6OF01CV0TT.18.9.A09.1.454.CMB.1.raw
  modified_base (164)..(164): a, c, t, g, unknown or other
  misc_feature (164)..(164): n is a, c, g, or t
  modified_base (807)..(807): a, c, t, g, unknown or other
  misc_feature (807)..(807): n is a, c, g, or t
  modified_base (815)..(815): a, c, t, g, unknown or other
  misc_feature (815)..(815): n is a, c, g, or t
  modified_base (822)..(822): a, c, t, g, unknown or other
  misc_feature (822)..(822): n is a, c, g, or t
  modified_base (824)..(824): a, c, t, g, unknown or other
  misc_feature (824)..(824): n is a, c, g, or t
  modified_base (827)..(827): a, c, t, g, unknown or other
  misc_feature (827)..(827): n is a, c, g, or t
tcagtacgagtatgcacgaccggtgctcgatttagcgagacgcgcagggtcctgggcccagtctgtgctgacgcagccgccctcagtgtctgggcccagggcagagggtcaccatctcctgcacgtgggagccacctaccaacgagtccgggggcgggtttaanggaatgtaaccacgttggtaaccagcagccttaccgagggacctacgacccccaaaactcctacgattcgttttggaacacaaacgaacgtccggaccccttacgaacggggtccctacggtaacccgtactttcgtcctacggacttacccgaaagttccgtcgggaccctaacccgtcgtaaccgtcccgttcccgtaacgggacccttaacgttacccaaccgggtttccgggggtaccctcccggtaacgggtacgttacggtaacgttggtaaggttacggaacggttaccgttaagtttacttttaaaccgttaccgaccggtacctaacggtttcctaaagttacggaaaccttaacttaaaccgttctacgggtaacgggtttcgggtttaccgggttcggggggttacccttacgggggaaccgggtacgggaacccggtaacggtccggtaccgggtaccggttcgggacggtaccgaacgtaacccggaacggtcctacccggtcccccgttacgttacccgtacgttccctaccccgttaccccgtcccttacccgtaccgttaactacccgttacgtaccgttcgacgggtcgtaccggacggtacggaacggcctacgacggtaacgtncaacgcanccgtacnancgngtac

SEQ ID NO: 124470 - DNA, 1063 bp, Homo sapiens
  misc_feature: GYAE6OF01A1KL4.18.9.A09.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (1038)..(1038): a, c, t, g, unknown or other
  misc_feature (1038)..(1038): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccgagggacacgcccccaaactcctnattcttggancaacatccggccctcgacgggtccctgaccgtattccgtcgtcggtcctaccaacgttcgtaggccacccgttcaccggtcccctcccgtcggtaccccacttcccgacggttccggggtcccttacccgaaggggtccttaggggaacgggtagtacggggtaccgggtaccttacggttaaaccgtttaagttttaaccgtacccggtaaccccggtaaccgttttacccgttaaacgttacgggtaaccgtaacgggtttaaggggtaaccccggggttacggttttaaggggttacgggtttttaccgggggtttttaaccgggttttaaaccggttttccgggtttaaccccgggttttaaaccccgggggttaaacccggggtttaacccgggggtaaaaccccggggttaaacccgggtttaacccccggtaacccccggggttttaaccccggtttaaacccgggggttacccgaaacccccgggggtaaaacccccggtaaaccccccggggtaaccccccctaaaaaccccccccgggttacccggtttaaccccggttaaccccgtttaacccccggttacccccccgggtttttccccggttttaaccccccccccccgggttcccccggtttttaaccccccttacccccggtttaaacccccgtttaaacccgggtttcccccggttttaaaccggggtccccggggttaaccggggtacccgggggttacccggtacccggggggttaaaccggaacccgggttacccgggttaacgttaaaccgttacccggacgtaccggtacnccggacgtcacgacgcgtcgcgtcg

SEQ ID NO: 124471 - DNA, 872 bp, Homo sapiens
  misc_feature: GYAE6OF01DE5AA.18.9.A09.1.454.CMB.1.raw
  modified_base (153)..(153): a, c, t, g, unknown or other
  misc_feature (153)..(153): n is a, c, g, or t
  modified_base (427)..(427): a, c, t, g, unknown or other
  misc_feature (427)..(427): n is a, c, g, or t
  modified_base (856)..(856): a, c, t, g, unknown or other
  misc_feature (856)..(856): n is a, c, g, or t
  modified_base (860)..(860): a, c, t, g, unknown or other
  misc_feature (860)..(860): n is a, c, g, or t
  modified_base (864)..(864): a, c, t, g, unknown or other
  misc_feature (864)..(864): n is a, c, g, or t
  modified_base (868)..(868): a, c, t, g, unknown or other
  misc_feature (868)..(868): n is a, c, g, or t
  modified_base (871)..(871): a, c, t, g, unknown or other
  misc_feature (871)..(871): n is a, c, g, or t
tcagtacgagtatgcacgaccggtgctcgatttagcgagacgcgcagggtcctgggcccagtctgtgctgacgcagcccgccctcagtgtcgtcgggccccagggcaggagggtccacctatcctcctgcacgtggacgtccacctccaacgngtcggggcggtttatgaatcgtactacgtcggtaccagccagtcctaccggaagggaccaacccgacccccctaaacgttcctactagtttccgttttaagggaacacctaaaccacggttcccccggccgtttaccgggaccgggttcccctacgtaaccggttcttccgtcgtcgaccttaccgtaacgtccgttcgacctacccgtcctaccgtccctccgtccggacctactccggtaaccggtcgggtccctaccggtacggtaccggnggtacggggtacttccgggtacgggtacctttacggttaacctttaccgttaccggtccgtaccgttaaccgttacgttacgttaaccggtaccgtaggttacggtaacggtaccggtttaggtttaccgggttccgggtttaacgtttacggttcgggttttacccgtagggttacccggttaccgggtaaccgtaacccggtaccgttacccgtaaccggttaaccgtacgtaaccgtaaacccgccccggtaaccccgttacccccgtaccgtttaccgacccgttacccgtacctttccccgttacccccttacccccggttaacccttcccgttaacccgtttaacccgttacgttcccggtacgtaccggggtccggtaccggtccgggtacggaccgttacgggcgtacttaacgtgcgtancgtntcanagantgng

SEQ ID NO: 124472 - DNA, 773 bp, Homo sapiens
  misc_feature: GYAE6OF01ESKGT.18.9.A09.1.454.CMB.1.raw
  modified_base (758)..(758): a, c, t, g, unknown or other
  misc_feature (758)..(758): n is a, c, g, or t
tcagtacgagtatgcacgaccggtgctcgatttagcgagacgcgcagggtcctgggcccagtctgtgctcgacgcagccgccctcagtgtcgtcgggccccagggcaggaggtcaccatcctcctgcacgtgggacgccacctccaaacgaggtcgggggcgggttaatgacttgtacacgtggtaccagccagtccttcgaggaccaccgaccccaaactcctactattcgtttggaagaccaactaaccgtccggtaccctcggacgggttaccctcgaccgttacgttcgtcgtacggcctacgtaacgttccgtcggaccacctacaccgtcccgttaccgtacggcctaacgtaccgtaccggtcggtacctccggtaagggtccgttagggaacgggtagtcgggtaacggtacgtacgttaacgtttacttacgtccgtaaccgttaaccgttcgtaaacgttacgacgtaacggtggtaaccggtcgttaggttggttacggttaacgttcgtaacggttccggttacggtacgttacggtaccggtacgtaacgtccgtaacgtaccgtagtaaccgccgtaaccgtaccggtaaccccacgttcctacggtaacctccttaccccgttccgtacccctaccccgtttcctaccgtaaaccggtttcctaccggtacggtacgttccgggacgggtcgtacccggagttacccggacggttacctaggtacgccgttagcgtcaacggnaacggctcaagttcg

SEQ ID NO: 124473 - DNA, 481 bp, Homo sapiens
  misc_feature: GYAE6OF02HUDLQ.18.9.A09.1.454.CMB.1.raw
  modified_base (326)..(326): a, c, t, g, unknown or other
  misc_feature (326)..(326): n is a, c, g, or t
  modified_base (472)..(481): a, c, t, g, unknown or other
  misc_feature (472)..(481): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatccggccctcaggggtccctgaccgattctctggctccaagtctggcacctcagcctccctggccatcactgggctccaggctgagatgaggctgactattacngccagtcctatgacatgagctgagtgttcgtatgtcttcggatctgggacaaggtcaccgtctaagtcagcccaagccaaccctctcgtccactctcgttcccgccctcctccatcctcgtactgagcggctggcaggcgcatagnnnnnnnnnn

SEQ ID NO: 124474 - DNA, 481 bp, Homo sapiens
  misc_feature: GYAE6OF02I754C.18.9.A09.1.454.CMB.1.raw
  modified_base (473)..(481): a, c, t, g, unknown or other
  misc_feature (473)..(481): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagctgagtgttcgtatgtcttcggatctgggaccaaggtcaccgtctaagtcagcccaaggccaaccctctcgtcactctcgttcccgccctcctccaactcgtactgacgcggctggcaggcgcatagnnnnnnnnn

SEQ ID NO: 124475 - DNA, 484 bp, Homo sapiens
  misc_feature: GYAE6OF02F6MQQ.18.9.A09.1.454.CMB.1.raw
  modified_base (475)..(484): a, c, t, g, unknown or other
  misc_feature (475)..(484): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggccaaccctctgtcactctgttcccaccctcctccatacctcgtactgagcggctggcaaggcgcatagnnnnnnnnnn

SEQ ID NO: 124476 - DNA, 486 bp, Homo sapiens
  misc_feature: GYAE6OF02F6UHR.18.9.A09.1.454.CMB.1.raw
  modified_base (478)..(486): a, c, t, g, unknown or other
  misc_feature (478)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtcttggatctgggaccaaggtcaccgtctaagtcagcccaaggcccaaccctctcgtccactctcgttcccaccctcctccatacctcgtactgacgcggctggcaaggcgcatagnnnnnnnnn

SEQ ID NO: 124477 - DNA, 492 bp, Homo sapiens
  misc_feature: GYAE6OF02HUWAB.18.9.A09.1.454.CMB.1.raw
  modified_base (416)..(416): a, c, t, g, unknown or other
  misc_feature (416)..(416): n is a, c, g, or t
  modified_base (482)..(492): a, c, t, g, unknown or other
  misc_feature (482)..(492): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgagatgaggctgacttattactgccagtcctatgacatgaggctgagtggttcgtaatgtactttcggatctgggaccaaggtcaccgtctaagtcagcccaagccaaccctntgtcactctcgttcccgccctcctccacttacctcgtacctgagccgggctggcaaggcgcatagnnnnnnnnnnn

SEQ ID NO: 124478 - DNA, 484 bp, Homo sapiens
  misc_feature: GYAE6OF02FMLVJ.18.9.A09.1.454.CMB.1.raw
  modified_base (475)..(484): a, c, t, g, unknown or other
  misc_feature (475)..(484): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtctttcggatctgggaccaaggtcacgtctaagtcagcccaaggccaaccctctgtccactctcgttcccaccctcctccatactcgtactgacgcggctggcaaggcgcatagnnnnnnnnnn

SEQ ID NO: 124479 - DNA, 529 bp, Homo sapiens
  misc_feature: GYAE6OF02H5ZE8.18.9.A09.1.454.CMB.1.raw
  modified_base (296)..(296): a, c, t, g, unknown or other
  misc_feature (296)..(296): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
tcagtacgagtatgcacgaccggtgctcgattttagcgagacgcgcagggggtcctgggcccagtcctgtgactgacgcagccgccctcagtgtcctggggccccagggcagagggtcaccatcgtcctggcacgtgggagccacctccaacgagtcggggcgggttatggactgtacgactggtaccagcaggcttccagggacagcccccaaatcctcatcgtttggtagcaacaagtcggccctcgacggggtccctgacgattctctggctcaagtctggcacctcagtccncctggccatcactgggctcaggcngacggntgaggctgactatactgcagtcctatcgacagtgaggctagagtgttcgtatgtcttgggatcgtgggaccaaggtcaccgtctaagtcagccaaggccaccctgtgtccacgtctcgttcccgcccttacctcctagtactcgtactggacgcgggctgggcctaaggtcgcagtacggctaccgngcggcgctgcgtngcg

SEQ ID NO: 124480 - DNA, 490 bp, Homo sapiens
  misc_feature: GYAE6OF02HNAVE.18.9.A09.1.454.CMB.1.raw
  modified_base (481)..(490): a, c, t, g, unknown or other
  misc_feature (481)..(490): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtctttcggatcgtgggaccaaggtcaccgtcctaagtcagcccaaggccaacccctctgtccactctcgttcccaccctcctccatactcgtactgacgcggctggcaaggcgcatagnnnnnnnnnn

SEQ ID NO: 124481 - DNA, 484 bp, Homo sapiens
  misc_feature: GYAE6OF02GZKAR.18.9.A09.1.454.CMB.1.raw
  modified_base (477)..(484): a, c, t, g, unknown or other
  misc_feature (477)..(484): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgatgtcttcggatcgtgggacaaggtcaccgtctaagtcagcccaaggcccaaccctctcgtcactctcgttcccaccctcctccatacctcgtactgacgcggctggcaggcgcatagnnnnnnnn

SEQ ID NO: 124482 - DNA, 501 bp, Homo sapiens
  misc_feature: GYAE6OF02GJ7JJ.18.9.A09.1.454.CMB.1.raw
  modified_base (491)..(492): a, c, t, g, unknown or other
  misc_feature (491)..(492): n is a, c, g, or t
  modified_base (494)..(501): a, c, t, g, unknown or other
  misc_feature (494)..(501): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtcttcggatcgtgggaccaaggtcaccgtcctaagtcacgcccaaggcccaaccctctcgtcactcctcgttcccgccctcctccacttacctcgttactcgacgccgggctggcaacggcgcagtacgnngnnnnnnnn

SEQ ID NO: 124483 - DNA, 485 bp, Homo sapiens
  misc_feature: GYAE6OF02JAVWE.18.9.A09.1.454.CMB.1.raw
  modified_base (475)..(485): a, c, t, g, unknown or other
  misc_feature (475)..(485): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagctgagtggttctatgtcttcggatctgggaccaaggtcacgtctaagtcagcccaaggcccaaccctctcgtccactctcggttcccgccctccccatacctcgtactgagcggctggcaggcgcatagnnnnnnnnnnn

SEQ ID NO: 124484 - DNA, 488 bp, Homo sapiens
  misc_feature: GYAE6OF02GD98X.18.9.A09.1.454.CMB.1.raw
  modified_base (478)..(488): a, c, t, g, unknown or other
  misc_feature (478)..(488): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatcggccctcaggggtccctgaccgattctctggctccaagtctggcacctcagcctccctggccatcactgggctccaggctgaggatggaggctgactattactgccagtcctatgacatgaggctgagttggttcgtatgtcttggatctgggaccaaggtcaccgtcctaagtcagcccaaggcccaaccctctgtcactctcgttcccgccctcctccatacctcgtactgagcggctggcaaggcgcatagnnnnnnnnnnn

SEQ ID NO: 124485 - DNA, 491 bp, Homo sapiens
  misc_feature: GYAE6OF02H85YN.18.9.A09.1.454.CMB.1.raw
  modified_base (482)..(491): a, c, t, g, unknown or other
  misc_feature (482)..(491): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagccctcctggccatcactgggctccaggctgaggatgaggctgactattactgccagtcctatgacatgaggctgacgttggttcgtatgtctttcggatcgtgggaccaaggtcaccgtctaagtcagcccaaggccaacccctctgtccactctcgttccgccctcctccatactcgtactgacgcggcgtgcaaggcgcatcgannnnnnnnnn

SEQ ID NO: 124486 - DNA, 486 bp, Homo sapiens
  misc_feature: GYAE6OF02GMI3K.18.9.A09.1.454.CMB.1.raw
  modified_base (477)..(486): a, c, t, g, unknown or other
  misc_feature (477)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgagactgactattactgccagtcctatgacatgaggctgagtggttctatgtcttcggatctgggaccaaggtcaccgtctaagtcagcccaaggccaaccctctgtcactctcgttcccgccctcctccatacctcgtactgacgcgggctggcaaggcgcatagnnnnnnnnnn

SEQ ID NO: 124487 - DNA, 492 bp, Homo sapiens
  misc_feature: GYAE6OF02HR6XV.18.9.A09.1.454.CMB.1.raw
  modified_base (480)..(492): a, c, t, g, unknown or other
  misc_feature (480)..(492): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccctgaccgattctctggctccaagtctggcacctcagcctccctggccatcactgggctccaggctgaggatgaggctgactattactgccagtcctatgacactaatctcagtggtctgggggtcttcgggcggagggaccaggctgaccgtcgtgggtcagcccaggctcgcccctcgtcactctcgttcccaccctcctccactactcgtactgacgcgggctggcaggcgcagtagnnnnnnnnnnnnn

SEQ ID NO: 124488 - DNA, 488 bp, Homo sapiens
  misc_feature: GYAE6OF02F4AOB.18.9.A09.1.454.CMB.1.raw
  modified_base (479)..(488): a, c, t, g, unknown or other
  misc_feature (479)..(488): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtctggatctgggaccaggtcaccgtctaagtcacgcccaaggccaacccctctcgtccactctcgttcccgccctcctccatacctcgtactcgacgcggctggcaaggcgcatagnnnnnnnnnn

SEQ ID NO: 124489 - DNA, 486 bp, Homo sapiens
  misc_feature: GYAE6OF02HIWYK.18.9.A09.1.454.CMB.1.raw
  modified_base (478)..(486): a, c, t, g, unknown or other
  misc_feature (478)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttctatgtctttcggatcgtgggaccaaggtcaccgtcctaagtcagcccaaggccaaccctctcgtcactctcgttcccaccctcctccatactcgtactgacgcggctggcaggcgcatagnnnnnnnnn

SEQ ID NO: 124490 - DNA, 487 bp, Homo sapiens
  misc_feature: GYAE6OF02GH2V0.18.9.A09.1.454.CMB.1.raw
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (477)..(478): a, c, t, g, unknown or other
  misc_feature (477)..(478): n is a, c, g, or t
  modified_base (480)..(480): a, c, t, g, unknown or other
  misc_feature (480)..(480): n is a, c, g, or t
  modified_base (482)..(487): a, c, t, g, unknown or other
  misc_feature (482)..(487): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcacggggtccctgaccgattctctggctccaagtctggcacctcagcctcctggccatcactggctccaggctgagatgaggctgactatactgccagtcctatgacatgagctgagtggttcgtatgtcttggatcgtgggaccaaggtcacgtcctaagtcacgcccaaggcccaaccctctcgtccactctcgttccccncctcctccatctcgtangacgcggctcggcaacggcgctatagnngncnnnnnn

SEQ ID NO: 124491 - DNA, 472 bp, Homo sapiens
  misc_feature: GYAE6OF02GZL1U.18.9.A09.1.454.CMB.1.raw
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
  modified_base (463)..(472): a, c, t, g, unknown or other
  misc_feature (463)..(472): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctccctggccatcactgggctacaggctgatgatgagctgattatactgcagctcatatacaagcacagctactctctatgtctcgactggaccagtcaccgtctagtcacgcccaaggccaacccnctcncactctcgttcccgccctcctccatactcgtacngacgcgctgcaggcacatagnnnnnnnnnn

SEQ ID NO: 124492 - DNA, 491 bp, Homo sapiens
  misc_feature: GYAE6OF02JGFL8.18.9.A09.1.454.CMB.1.raw
  modified_base (480)..(491): a, c, t, g, unknown or other
  misc_feature (480)..(491): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccaggggacagcccccaaacttgtcatctatggtaacaataatcggccctcaggggtccctgcccgattctctggctccaagtctggcacctcagcctccctggccatcactgggctccaggctgatgatgagctgattattactgccagtcctatgacactaatctcagtggtctgggggtcttcgggcgagggaccaggctgaccgtcgtgggtcagcccaaggctcgcccctcggtcactctcgttcccaccctcctccactcctcgtacctgacgcggctggcaggcgcgatagnnnnnnnnnnnn

SEQ ID NO: 124493 - DNA, 720 bp, Homo sapiens
  misc_feature: GYAE6OF02IM0DM.18.9.A09.1.454.CMB.1.raw
  modified_base (712)..(712): a, c, t, g, unknown or other
  misc_feature (712)..(712): n is a, c, g, or t
  modified_base (714)..(715): a, c, t, g, unknown or other
  misc_feature (714)..(715): n is a, c, g, or t
  modified_base (717)..(719): a, c, t, g, unknown or other
  misc_feature (717)..(719): n is a, c, g, or t
tcagtacgagtatgcacgaccggtgctcgatttagcgagacgcgcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtacaactaaatacgccgtcctacgggtaccggttccgccgaccttacttctcggtcgtcctaacgtactggtcgacctacctacgccgtcccctcggtccgactcacctacgggtcggtccctacggacgtcgacgtgagtgtaggcgtcgtagttaatttacttacgtccacgtaccgttactagtacgatagtaggcgtcgtaggtagggttcggttacgttagttcgtttcgggtacgttccgtcgggggtaacccgaaacgggttaccacccggtttaccccttaaaggttaccacggacccccgaaaacgggtacccgaaaccccccttaccgttggtttacccaacccttaccgtttcggttttaccccctaccccccttaccctttccccctaaattaaccctttcccgggtaaccttttaccgggaggacccggggttaccgttcgggaccgaaaacgggtccggcccggttaactaagggtcctagctcncnncnnnc

SEQ ID NO: 124494 - DNA, 490 bp, Homo sapiens
  misc_feature: GYAE6OF02II830.18.9.A09.1.454.CMB.1.raw
  modified_base (329)..(329): a, c, t, g, unknown or other
  misc_feature (329)..(329): n is a, c, g, or t
  modified_base (421)..(421): a, c, t, g, unknown or other
  misc_feature (421)..(421): n is a, c, g, or t
  modified_base (438)..(438): a, c, t, g, unknown or other
  misc_feature (438)..(438): n is a, c, g, or t
  modified_base (481)..(490): a, c, t, g, unknown or other
  misc_feature (481)..(490): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactccctcatctttggtagcaacaatccggccctcaggggtcccctgaccgattctctggctccaagtctggcacctcagcctccctggccatcactgggctccaggctgaggatgaggctgactattacngccagtcctatgacatgaggctgagttgttcgtatgtctttcggatcgtgggaccaaggtcaccgtctaagtcacgcccaagcccaaccctntcgtcactctcgtcccncctcctcatacctcgtactgacgcggctggacaaggcgcatgnnnnnnnnnn

SEQ ID NO: 124495 - DNA, 492 bp, Homo sapiens
  misc_feature: GYAE6OF02G8F9T.18.9.A09.1.454.CMB.1.raw
  modified_base (483)..(492): a, c, t, g, unknown or other
  misc_feature (483)..(492): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgagatgaggctgactattactgccagtcctatgacatgaggctggagtggttcgtatgtcttggatcgtgggaccaaggtcaccgtctaagcagcccaaggcccaaccctctcgtcactctcgttcccacccttccctccactactccgtactgacgcgggctggccaaggcgcatagnnnnnnnnnn

SEQ ID NO: 124496 - DNA, 659 bp, Homo sapiens
  misc_feature: GYAE6OF02JDI25.18.9.A09.1.454.CMB.1.raw
  modified_base (646)..(646): a, c, t, g, unknown or other
  misc_feature (646)..(646): n is a, c, g, or t
  modified_base (649)..(659): a, c, t, g, unknown or other
  misc_feature (649)..(659): n is a, c, g, or t
tcagtacgagtatgcacgaccggtgctcgatttagcgagacgcgcagggtcctgggcccagtctgtgctgacgcagccgccctcagtgtctggggccccgaggcaggagggtccaccatcctccgtgcacgtacggaaccagcagtgtacggttgggttggttaataactatgtcctccgtcggtaaccaacagccaccgaggacaaaccgaccccaaactcatagtatttatgtagtgtactaagtaacgtccggccctacggtacggggtttactaacgtccgtcttctcgtcggtcctaccgtaagtcgtcggaccaaccgaccggtcccttcccgtacgacctactccgttcgtcgggtcctccggacggtcgtaggacgggacggaggtctagtaatttactacgtgacagtcctacaataactaacgaacgcacgacgacgacctaacctacgtaacgttaccgttaccgggaacggtacggggaaacctaacgggtaccctaacccgttaccggtaggtaccgaccgaccgaaccggaccccaaacccctcgtacgtcctaccttcgttacccgtccccgcccttcctacctacttaccgtcgtacgtaggaccggcggctcggacacggcactagcgnacnnnnnnnnnnn

SEQ ID NO: 124497 - DNA, 520 bp, Homo sapiens
  misc_feature: GYAE6OF02HUB7J.18.9.A09.1.454.CMB.1.raw
  modified_base (510)..(520): a, c, t, g, unknown or other
  misc_feature (510)..(520): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccctgaccgattctctggctccaagtctggcacctcagccctccctggcccatccactgggcctccagggctggaggatggaggctgactattactgccagtcctatgactatgaggtctggagttggtttcgtattggttcttcggatcgtagggaccaaggtccaccgtctaagtcacgcccaaggcccaaccctctcgtccacttcctccgttccccgcccttcctccacttacctcgtactggacgcgggctcggcaaggcgcatagnnnnnnnnnnn

SEQ ID NO: 124498 - DNA, 494 bp, Homo sapiens
  misc_feature: GYAE6OF02HSD1V.18.9.A09.1.454.CMB.1.raw
  modified_base (485)..(494): a, c, t, g, unknown or other
  misc_feature (485)..(494): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgagatgaggctgactattactgccagtcctatgacatgaggctgagtgttcgatgtctttcggatcgtgggaccaaggtcaccgtctaagtcagcccaaggcccaacccctctcgtcacctctccgttcccgccctcctccactacctcgtactcgagccgggctcggcgaggcgcatagnnnnnnnnnn

SEQ ID NO: 124499 - DNA, 484 bp, Homo sapiens
  misc_feature: GYAE6OF02FNDAK.18.9.A09.1.454.CMB.1.raw
  modified_base (475)..(484): a, c, t, g, unknown or other
  misc_feature (475)..(484): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtttctaatcgcttctctggctccaagtctggcaacacggcctcctgaccatctctgggctccaggctgaggacgaggctgattattactgcagctcatatacaagccaccagcactctctatgtcttcggaactgggaccaaggtcacgtcctaggtcagcccaaggcccaaccccatcgtcactcctctcccaccctcctccatacctcgtactcgacgcggctggcaggcgcatagnnnnnnnnnn

SEQ ID NO: 124500 - DNA, 483 bp, Homo sapiens
  misc_feature: GYAE6OF02GE5V1.18.9.A09.1.454.CMB.1.raw
  modified_base (474)..(483): a, c, t, g, unknown or other
  misc_feature (474)..(483): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcactcagcctccctggccatcactgggctccaggctgaggatgaggctgactattactgccagtcctatgacatgagctgagtgtcgtatgtcttcggatctgggaccaaggtcaccgtcctaagtcagcccaaggccaacccctctgtcactctcgttcccgccctcctccatactcgtactgagcgggctggcaaggcgcatagnnnnnnnnnn

SEQ ID NO: 124501 - DNA, 495 bp, Homo sapiens
  misc_feature: GYAE6OF02GWF5L.18.9.A09.1.454.CMB.1.raw
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (486)..(487): a, c, t, g, unknown or other
  misc_feature (486)..(487): n is a, c, g, or t
  modified_base (489)..(495): a, c, t, g, unknown or other
  misc_feature (489)..(495): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctcaggctgaggatggaggctgactntacngccagtcctatcgacatgaggctgagtggttctatgtcttcggatcgtggaccaggtcaccgtctaagtcacgcccaagcccaaccctctcgtccacttcctcgttcccgccctcctcccatacctccgtactgcgcgggctggcgaacggcgcatagctnncnnnnnnn

SEQ ID NO: 124502 - DNA, 511 bp, Homo sapiens
  misc_feature: GYAE6OF02JXIRY.18.9.A09.1.454.CMB.1.raw
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
  modified_base (500)..(500): a, c, t, g, unknown or other
  misc_feature (500)..(500): n is a, c, g, or t
  modified_base (503)..(511): a, c, t, g, unknown or other
  misc_feature (503)..(511): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactccctcatctttggtagcaaacaatccggccctcgacggggtccctgaccgattctctggctccaagtctggcacctcacgccctccctggcccatccactgggcctccgaggctggaggatggacggctgactattacgngccagtcctatgactntgaggctgagtggttcgtatgtcttcggatcgtggacagtcaccgtctagtcacgccaacgccaaccctcntcactctcgtcccgcctccctcctactccgtcgtactgacgtccgggctcggacgtacggcgaccgatagntgnnnnnnnnn

SEQ ID NO: 124503 - DNA, 500 bp, Homo sapiens
  misc_feature: GYAE6OF02IQIGT.18.9.A09.1.454.CMB.1.raw
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
  modified_base (489)..(489): a, c, t, g, unknown or other
  misc_feature (489)..(489): n is a, c, g, or t
  modified_base (492)..(500): a, c, t, g, unknown or other
  misc_feature (492)..(500): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctgctccaagtctggcacctcagcctccctggccatcactgggctccaggctgaggntgaggctgactattacngccagtcctatgacatgagctgagtgttcatgtcttggatcgtggaccaaggtcaccgtctaagtcagcccaacggccaaccctctcgtccacttctcgttcccacccttccctccacttacctacgtactcggacgccgggctcggacaaggcgacactagnagnnnnnnnnn

SEQ ID NO: 124504 - DNA, 488 bp, Homo sapiens
  misc_feature: GYAE6OF02FXLVB.18.9.A09.1.454.CMB.1.raw
  modified_base (478)..(488): a, c, t, g, unknown or other
  misc_feature (478)..(488): n is a, c, g, or t
tcagtacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactgtcatctatgtaacatatcggccctcagggtccctgcccgattctctggctccaagtctggcacctcagcctccctggccatcactggctcagctgaggatgagctgactattactgccagtcctatgacatgaggctgagtggttcgtatgtctcggatcgtgggaccaaggtcaccgtcctaagtcacgccccaaggcccaacccctctcgtccacctctcgttcccgccctcctccattacctcgttactgaggcgggctggcaaggcgcatagnnnnnnnnnnn

SEQ ID NO: 124505 - DNA, 546 bp, Homo sapiens
  misc_feature: GYAE6OF02IEMUP.18.9.A09.1.454.CMB.1.raw
  modified_base (248)..(248): a, c, t, g, unknown or other
  misc_feature (248)..(248): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (514)..(514): a, c, t, g, unknown or other
  misc_feature (514)..(514): n is a, c, g, or t
  modified_base (534)..(534): a, c, t, g, unknown or other
  misc_feature (534)..(534): n is a, c, g, or t
  modified_base (538)..(546): a, c, t, g, unknown or other
  misc_feature (538)..(546): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagtcttccagggacagcccccaaaactcctcatcttttggagcaaacaatcggccctcgagggggttccccnggacccgtatttctctggactccaagtcctggcacctcacgccctccctaggccctatccaccgttgggccttccagggtccaggacggatggaacggcttaggaccttattacngccagtcctatcgacagtcgaggctggagtcggtttnactgtcttcggatcgtggaccaaggtcacgtactaagtcacgtccaacgccaaaccctctcgtctactctccgtccgtcccctacctcctactactcgttaacgtcgacgcggngtcgcgaaggcgtcgatagnacgnnnnnnnnn

SEQ ID NO: 124506 - DNA, 495 bp, Homo sapiens
  misc_feature: GYAE6OF02G2ME6.18.9.A09.1.454.CMB.1.raw
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (471)..(471): a, c, t, g, unknown or other
  misc_feature (471)..(471): n is a, c, g, or t
  modified_base (485)..(495): a, c, t, g, unknown or other
  misc_feature (485)..(495): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcgacggggtccctgaccgattctctggctccaagtctggcacctcagcctccctgccatcactggctccaggctgagntgagctgactattacngccagtcctatcgacatgaggctggagtggttcgtatgtcttggatcgtgggaccaaggtcaccgtctaagtcacgcccaacggcccaaccctctcgtccactctcgttccccgccctccctccactacctcgtactgacgcgggcnggcaaggcgcatgnnnnnnnnnnn

SEQ ID NO: 124507 - DNA, 482 bp, Homo sapiens
  misc_feature: GYAE6OF02G2R0I.18.9.A09.1.454.CMB.1.raw
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (469)..(469): a, c, t, g, unknown or other
  misc_feature (469)..(469): n is a, c, g, or t
  modified_base (474)..(482): a, c, t, g, unknown or other
  misc_feature (474)..(482): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattacngccagtcctatgacatgagctgagtggttcatgtctcggntcgtgggaccaggtcaccgtctaagtcagcccaaggcccaaccctntcgtcactctcgttccccacctcctccatacctcgtactgacgcggctggcaggcgnatagnnnnnnnnn

SEQ ID NO: 124508 - DNA, 482 bp, Homo sapiens
  misc_feature: GYAE6OF02I3059.18.9.A09.1.454.CMB.1.raw
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (472)..(482): a, c, t, g, unknown or other
  misc_feature (472)..(482): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagctgagtggtctatgtcttggatcgtgggaccaaggtcaccgtctaagtcagcccaaggcccaaccctntcgtcactctcgttcccnccctctccatctcgtactgacgcggctggcaggcgcatcgnnnnnnnnnnn

SEQ ID NO: 124509 - DNA, 520 bp, Homo sapiens
  misc_feature: GYAE6OF02G82K1.18.9.A09.1.454.CMB.1.raw
  modified_base (510)..(520): a, c, t, g, unknown or other
  misc_feature (510)..(520): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatccggcccctcgacgggggtcccctgaccgattctctggctccaagtctggcacctcagcctccctggccatcactgggctccaggctgaggatgaggctgactattactgccagtcctatgacatgaggctggagttggttcgtatgtctttcggatcgtcgggaccaaggtccaccgtcctaagtcacgcccaacggcccaacccctctcgtccacttcctcgttccccacccttccctaccacttacctcgtactcgacgccgggtctcggcgaggccgcatagnnnnnnnnnnn

SEQ ID NO: 124510 - DNA, 488 bp, Homo sapiens
  misc_feature: GYAE6OF02GBSCL.18.9.A09.1.454.CMB.1.raw
  modified_base (432)..(432): a, c, t, g, unknown or other
  misc_feature (432)..(432): n is a, c, g, or t
  modified_base (471)..(471): a, c, t, g, unknown or other
  misc_feature (471)..(471): n is a, c, g, or t
  modified_base (477)..(488): a, c, t, g, unknown or other
  misc_feature (477)..(488): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcacggggtccctgaccgattctctggctccaagtctggcacctcagcctccctggccatcactgggctccaggctgaggacgaggctgatttattactgcagctcatatacaagcagcagcactcaagtcttcggaactggaccaaggtcaccgtctagtcacgcccaaggcccaacccatcgtccacttcctcgttcccnccctcctccactacctcgtactgacgcggctgcacggcncagtgnnnnnnnnnnnn

SEQ ID NO: 124511 - DNA, 506 bp, Homo sapiens
  misc_feature: GYAE6OF02HQRKY.18.9.A09.1.454.CMB.1.raw
  modified_base (497)..(506): a, c, t, g, unknown or other
  misc_feature (497)..(506): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggtttatgatgtacactggtaccagcagcttccagggacagcccccaaactcctcatctttggtagcaacaatcggccctcaggggtccctgaccgattctctggctccaagtctggcacctcacgcctcctggccatcactgggctccgaggctgagatgaggctgactattactgccagtcctatgacatgagctgagtgttcgtatgttcttcggatcgtggaccaaggtcaccgtcctaagtcacgacccgagacccaaccccttctcgtcctactctccgttcccgtccctcctccctactcctaccgtactcggacggcggccgtggacgacggcgcatgnnnnnnnnnn

SEQ ID NO: 124512 - DNA, 631 bp, Homo sapiens
  misc_feature: GYAE6OF02F4KX9.18.9.A09.1.454.CMB.1.raw
  modified_base (608)..(608): a, c, t, g, unknown or other
  misc_feature (608)..(608): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
tcagtacgagtatgcacgaccggtgctcgatttagcgagacgcgcagggtcctgggcccagtctgtgctgacgcagccgccctcagtgtctggggcccctagggcagagggtcaccatctcctgcacgtgggagcacctccaacattcgggggcggttatgtattgtacactggtaccagcagcttccagggacagcccccaaactcctcatcgttgggagctaacatcggccctcgacggggtccctgaccgattcctctggctccagtcctggcacctcacgcctcccgtggtcctatcacgtcgggcctccgaggctggatgagtggaggctgtatttatacgtgacctagtcctagtagacctactaatctacgtaggttcggtcgtcgggggttccttccgggacggacgggtaccgtacggtccgtaggtacccggttcggtacggtaccgaacggtacccgtaagggtcccgttccggttcccccgtacggttacctaccgttccgttacccgtttaccccctacccgttcccgtacctacgttacccgtaccgttaccgtcgacggtccggtcgtacggacgacggccgtacgactagtnacgtgagcgtagntntntantac

SEQ ID NO: 124513 - DNA, 488 bp, Homo sapiens
  misc_feature: GYAE6OF02G9H9Y.18.9.A09.1.454.CMB.1.raw
  modified_base (478)..(488): a, c, t, g, unknown or other
  misc_feature (478)..(488): n is a, c, g, or t
tcagtacgagtatgcacgaccggtgctcgatttagcgagacgcgcagggtccttggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtctaagtcagcccaaggcccaaccctctgtcactctcgttcccgccctcctccatcctcgtactgacgcggctggcaggcgcatagnnnnnnnnnnn

SEQ ID NO: 124514 - DNA, 521 bp, Homo sapiens
  misc_feature: GYAE6OF02HWW62.18.9.A09.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (326)..(326): a, c, t, g, unknown or other
  misc_feature (326)..(326): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (518)..(521): a, c, t, g, unknown or other
  misc_feature (518)..(521): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaatcctcatctttggtagcaacaatcggcctnaggggtcccngaccgattctctggctcaagtctggcacctnacgccctcctggccatcacgtgggctccgaggctgagatgaggctgacttatacngcctagtcctatgacatgagctgagtgtcgtatgtctggatcgtggacaggtcacgtctaaagctacgaccaacgacccaacccgtctagtcctactccgtcgttacccaccccgttctacccgtaacttacctcggttaacttcggacggacgggtctagggaccgtaaggtccgacagtagctgnncnannnn

SEQ ID NO: 124515 - DNA, 510 bp, Homo sapiens
  misc_feature: GYAE6OF02JCF1C.18.9.A09.1.454.CMB.1.raw
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (426)..(426): a, c, t, g, unknown or other
  misc_feature (426)..(426): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (504)..(510): a, c, t, g, unknown or other
  misc_feature (504)..(510): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacatcggccctcaggggtccctgaccgattctctggctccaagtctggcacctcagccctcctggccatcactgggctccaggctgacggatgaggctgactattacngccagtcctatgacntgagctgagtgttctatcgtcttcggatcgtaggaccgtaaggtccaccgtccgtaagtcgacgtacccaacggcccaacccctntcgtcaccttctcgttccccacccttcctcccattctccgtactggtacgcgggctggactacggcncatagnanncnnnnnnn

SEQ ID NO: 124516 - DNA, 492 bp, Homo sapiens
  misc_feature: GYAE6OF02F2GKO.18.9.A09.1.454.CMB.1.raw
  modified_base (484)..(492): a, c, t, g, unknown or other
  misc_feature (484)..(492): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctggagatgagctgactattactgccagtcctatgacatgagctgagtggttctatgttcttggatcgtgggaccaaggtcaccgtctaagtcacgcccaaggcccaaccctctcgtccacttccttccgttccccgccctcctccacttacctcgtactgacgcggctggcaggcgcatgnnnnnnnnn

SEQ ID NO: 124517 - DNA, 483 bp, Homo sapiens
  misc_feature: GYAE6OF02I6CXJ.18.9.A09.1.454.CMB.1.raw
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (472)..(483): a, c, t, g, unknown or other
  misc_feature (472)..(483): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtancaacaatcggccctcaggggtccctgaccgattctctggcctccaagtctggcacctcagcctccctggccatcactgggctccgaggctggaggacgaggctgattattactgccagctnatatacagcacagcactctctatgtctcggactggaccaagtcaccgtctagtcacgcccaagcccaacccntcncactctcgtcccncctcctccatactcgtactgacgtccggctcggacaggcacatagnnnnnnnnnnnn

SEQ ID NO: 124518 - DNA, 525 bp, Homo sapiens
  misc_feature: GYAE6OF02IWJ7Z.18.9.A09.1.454.CMB.1.raw
  modified_base (272)..(272): a, c, t, g, unknown or other
  misc_feature (272)..(272): n is a, c, g, or t
  modified_base (416)..(416): a, c, t, g, unknown or other
  misc_feature (416)..(416): n is a, c, g, or t
  modified_base (515)..(516): a, c, t, g, unknown or other
  misc_feature (515)..(516): n is a, c, g, or t
  modified_base (518)..(525): a, c, t, g, unknown or other
  misc_feature (518)..(525): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatcggccctcaggggtctctgaccgattctctggctccaagtctggcacctnagcctcctggccatcactggctccaggctggagatgaggctgactattactgccagtctatcgacatgagctagagtggttctatgttctgatcgtagggaccaaggtcaccgtctaagtcacgtacccaaggccctaaccctntcgtacactactccgttacccacccttccctacctacgttaccttccgttaactcggaacgtccgggtacgtcggacgtaacgggccgactactacggnngnnnnnnnn

SEQ ID NO: 124519 - DNA, 518 bp, Homo sapiens
  misc_feature: GYAE6OF02GAW4N.18.9.A09.1.454.CMB.1.raw
  modified_base (509)..(518): a, c, t, g, unknown or other
  misc_feature (509)..(518): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaaacaatccggccctcgacggggtccctgaccgattctctggctccaagtctggcacctcagccctccctggccatcactgggctccgaggctgaggatgaggctgactattactgccagttcctatcgactagtggaggtctggagttcggtttcgtattcgtctttcggattcgtgggaccaaggtcaccgtctaagtcacgcccaaggcccaaccctctcgtcctacctcctcgttccccgccctcctccattcctcgtactgacggcggctggacaacggcgcagtagnnnnnnnnnn

SEQ ID NO: 124520 - DNA, 480 bp, Homo sapiens
  misc_feature: GYAE6OF02G6JZA.18.9.A09.1.454.CMB.1.raw
  modified_base (470)..(480): a, c, t, g, unknown or other
  misc_feature (470)..(480): n is a, c, g, or t
tcagtacgagtatgcacgaccggtgctcgatttagcgagacgcgcagggtcctgggcccagtctgtgctgacgcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggttttcaatcgcttctctggctccaagtctggcaacacggcctccctgacccatctctgggctccaggctgaggcgaggctgattatactgcagctcatatacaagcagcagcactcaagtcttcggaactgggaccaaggtcaccgtctaggtcagcccaaggccaacccactgtcactctcgttcccaccctcctccactactcgtactgacgcgggctggcaaggcgcatgnnnnnnnnnnn

SEQ ID NO: 124521 - DNA, 531 bp, Homo sapiens
  misc_feature: GYAE6OF02GZBHF.18.9.A09.1.454.CMB.1.raw
  modified_base (325)..(325): a, c, t, g, unknown or other
  misc_feature (325)..(325): n is a, c, g, or t
  modified_base (520)..(520): a, c, t, g, unknown or other
  misc_feature (520)..(520): n is a, c, g, or t
  modified_base (524)..(527): a, c, t, g, unknown or other
  misc_feature (524)..(527): n is a, c, g, or t
  modified_base (530)..(531): a, c, t, g, unknown or other
  misc_feature (530)..(531): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatccggccctcaggggtccctgaccgattctctggctccaagtctggcacctcagcctccctgccatcactgggctccaggctgaggatgagctagctattacngccagtcctatcgacatgaggctggagtggttctagtcgtcttcggatcgtgggacctaaggtccaccgtactaagtcgacgtcccaaggccctaaacccctctcgtaccactctccgttccccgcccttccctccactaccgttccgtaactggacgtcgggctggaccaagggccgacgtactaaggctacgnacgnnnngcnn

SEQ ID NO: 124522 - DNA, 479 bp, Homo sapiens
  misc_feature: GYAE6OF02IHV90.18.9.A09.1.454.CMB.1.raw
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (428)..(428): a, c, t, g, unknown or other
  misc_feature (428)..(428): n is a, c, g, or t
  modified_base (462)..(462): a, c, t, g, unknown or other
  misc_feature (462)..(462): n is a, c, g, or t
  modified_base (468)..(479): a, c, t, g, unknown or other
  misc_feature (468)..(479): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaactcctcatctttggtagcaacaatcggccctcaggggtccctgaccgattctctggctccaagtctggcacctcagcctcctggccatcactgggctccaggctgatgatgagctgattatacngcagtcctatcgacactaatctnagtggtctgggggtcttcgggcggaggacaggctgaccgtcgtggtcacgccgaaggctcgcccctcggtcactctcgtcccncctcctcactctcgtactgacgcggctgcaggcncatagnnnnnnnnnnnn

SEQ ID NO: 124523 - DNA, 497 bp, Homo sapiens
  misc_feature: GYAE6OF02IUDP1.18.9.A09.1.454.CMB.1.raw
  modified_base (250)..(250): a, c, t, g, unknown or other
  misc_feature (250)..(250): n is a, c, g, or t
  modified_base (374)..(374): a, c, t, g, unknown or other
  misc_feature (374)..(374): n is a, c, g, or t
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
  modified_base (487)..(497): a, c, t, g, unknown or other
  misc_feature (487)..(497): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggagcaacaatcggccctcaggggtcccctgaccgattcnctggcctccaaagtctggcacctcagccctcctggccatcacgtgggctccaggctgaggatggagctgacttattactgccagtcctatgacagtgagctgagtggttcgtatggtcttcggntcgtgggacctaaggtcaccgtctaagtcacgacccaagcccaaccctctcgtcnctctccgttcccnccctcctccactactcgtactgacgcggctggacaggcgcatagnnnnnnnnnnn

SEQ ID NO: 124524 - DNA, 538 bp, Homo sapiens
  misc_feature: GYAE6OF02GE7E3.18.9.A09.1.454.CMB.1.raw
  modified_base (218)..(218): a, c, t, g, unknown or other
  misc_feature (218)..(218): n is a, c, g, or t
  modified_base (334)..(334): a, c, t, g, unknown or other
  misc_feature (334)..(334): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (529)..(530): a, c, t, g, unknown or other
  misc_feature (529)..(530): n is a, c, g, or t
  modified_base (534)..(535): a, c, t, g, unknown or other
  misc_feature (534)..(535): n is a, c, g, or t
  modified_base (537)..(538): a, c, t, g, unknown or other
  misc_feature (537)..(538): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttggtancaaacatcggccctcgaggggtccctgaccgattctctggctccaagtctggcacctcacgcctccctggccatcactgggcctccgaggctggaggatggaggctagattatacngcagctacatactacagccacagcactctctatcgtctacggaacgtcgggactaacggtcctaccggtcgtacggtcacgacccgaacggaccctaaccctcttacacttcctccgttccccgccctcctacctactacctccgtactcgacggcggtcgtacggaccagggccgactaagtacgnancgtganncganncnn

SEQ ID NO: 124525 - DNA, 608 bp, Homo sapiens
  misc_feature: GYAE6OF02H8Z61.18.9.A09.1.454.CMB.1.raw
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (606)..(607): a, c, t, g, unknown or other
  misc_feature (606)..(607): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggagcaacatcggccctcgaggggtccctgaccgattctctcggctccaagtctcggcacctcacgccctcccgtggccatccacgtcgggctccgaggcctggaggatcggaggctgaacttattacgcgccagtcctatgactagtgaggctaggagtttcggttacgttagtcggttcgtttacggacgttcggtcgggtaaccgtaacgggtccgtaacccggttaccttaacgtacgaccggacccgaaacggaccccgttaaacccctcgtacgtaccgtacctccttcccgttccccacccttcctacctacttaccgttccgtacgttcggacggtcgggtacgtcggacgaacggccgactagtacggcncgngtcngacatcgcnnc

SEQ ID NO: 124526 - DNA, 542 bp, Homo sapiens
  misc_feature: GYAE6OF02H818F.18.9.A09.1.454.CMB.1.raw
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (536)..(542): a, c, t, g, unknown or other
  misc_feature (536)..(542): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaaacaatccggccctcgacgggggtccctgaccgattctctggctccaagtctggcacctcagcctccctggccatcactcgggctccgaggctgaggntgagctgacttatacngccagtcctatgacatggagctgagttgttcgtatgtcttcggatcgtgggacctaaggtccaccgtccgtaagtccgaacgcccgaacggccctaaacccctctacgtcctacttccgtccgttcccgccccttccctcctacttaccgtccgttacctcggacggtccgggtcgtggaccgacggccgctaagtagnanncnnnnnnn

SEQ ID NO: 124527 - DNA, 520 bp, Homo sapiens
  misc_feature: GYAE6OF02J0LJZ.18.9.A09.1.454.CMB.1.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (508)..(508): a, c, t, g, unknown or other
  misc_feature (508)..(508): n is a, c, g, or t
  modified_base (514)..(519): a, c, t, g, unknown or other
  misc_feature (514)..(519): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcggttatgatgtacactggtaccagcagccttccagggacagcccccaaatcctcatctttggagcaaacaatcggccctgaacgggggtccctgaccgattcgtctaggctccaagtctggcacctcagcctcctggccatcactggctcaggctgagntgagctgctattacngcagtcctancgacatgacgctgacgtggtctatgtctcggatcgaggacctaagtcgacctcgtaagtcacacccgacgcctaaccctgtacgcctactccgtacttccccaccccttcgtaccctaactccttacgtcttacggacggtccggacgttcggacacgggccgatacgagtcngctgtnnnnnnc

SEQ ID NO: 124528 - DNA, 487 bp, Homo sapiens
  misc_feature: GYAE6OF02GQ2AC.18.9.A09.1.454.CMB.1.raw
  modified_base (326)..(326): a, c, t, g, unknown or other
  misc_feature (326)..(326): n is a, c, g, or t
  modified_base (416)..(416): a, c, t, g, unknown or other
  misc_feature (416)..(416): n is a, c, g, or t
  modified_base (479)..(487): a, c, t, g, unknown or other
  misc_feature (479)..(487): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattacngccagtcctatgacatgaggctgagtggttctatgtcttcggatcgtgggaccaaggtcaccgtctaagtcagcccaaggcccaaccctntcgcctactcctcgttcccgccctcctccatcctcgtactgacgtcggctggcaggcgcatgnnnnnnnnn

SEQ ID NO: 124529 - DNA, 487 bp, Homo sapiens
  misc_feature: GYAE6OF02FV8Z8.18.9.A09.1.454.CMB.1.raw
  modified_base (401)..(401): a, c, t, g, unknown or other
  misc_feature (401)..(401): n is a, c, g, or t
  modified_base (475)..(475): a, c, t, g, unknown or other
  misc_feature (475)..(475): n is a, c, g, or t
  modified_base (479)..(480): a, c, t, g, unknown or other
  misc_feature (479)..(480): n is a, c, g, or t
  modified_base (482)..(487): a, c, t, g, unknown or other
  misc_feature (482)..(487): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgagctgagtgtctatgtctgatctggaccagtcacgtctaagcagcccaagccaaccctntgtcactctcgttcccaccctcctcctacttacctcgtactcgagtccgggctggcctaagggcgcaatacggntagnncnnnnnn

SEQ ID NO: 124530 - DNA, 524 bp, Homo sapiens
  misc_feature: GYAE6OF02IYEXE.18.9.A09.1.454.CMB.1.raw
  modified_base (513)..(513): a, c, t, g, unknown or other
  misc_feature (513)..(513): n is a, c, g, or t
  modified_base (515)..(524): a, c, t, g, unknown or other
  misc_feature (515)..(524): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatccggccctcaggggtccctgaccgattctctggctccaagtctggcacctcagcctccctggccatcactgggcctccgaggctgaggatggaggctgactattactgccagttcctatgacatgagctgagtggttctagtgttcttggatcgtaggacaaggtccacgtctagtcacgcccaacgcccaaccctctcgtccactcctccgttccccacccttccctacctacttaccgttccgtactacggacggtccgggtcctggaccaagggccgactagtagntnnnnnnnnnn

SEQ ID NO: 124531 - DNA, 521 bp, Homo sapiens
  misc_feature: GYAE6OF02G3PR6.18.9.A09.1.454.CMB.1.raw
  modified_base (216)..(216): a, c, t, g, unknown or other
  misc_feature (216)..(216): n is a, c, g, or t
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (513)..(521): a, c, t, g, unknown or other
  misc_feature (513)..(521): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaatcctcatctttggtancaaacaatccggcccctcgagggggtccctgaccgtattcctctggcctccaagtctggcacctcacgccctcccctggcccatccactgggctccgaggctggaggatggaggctagacttattacngaccagtcctatcgacagtgagctggagttggttctatgttcttcggatcgtcgggacaggtctaccgtctaagtcacgcccaacggccaaccctntacgccactctcgttcccaccctccctaccactactcgtcgtgacgcggtctcggactaacggcncatagncnnnnnnnnn

SEQ ID NO: 124532 - DNA, 484 bp, Homo sapiens
  misc_feature: GYAE6OF02H17RV.18.9.A09.1.454.CMB.1.raw
  modified_base (325)..(325): a, c, t, g, unknown or other
  misc_feature (325)..(325): n is a, c, g, or t
  modified_base (474)..(484): a, c, t, g, unknown or other
  misc_feature (474)..(484): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctggagatgaggctgactatacngccagtcctatgacatgaggctgagtgttcgtatgtctgatcgtggacaggtcacgtctagcagccaagccaaccctctcgtcactctcgttcccgccctcctcctactacctccgtactcgacgccgggctggacgaggcgcagtagnnnnnnnnnnn

SEQ ID NO: 124533 - DNA, 485 bp, Homo sapiens
  misc_feature: GYAE6OF02FPCH4.18.9.A09.1.454.CMB.1.raw
  modified_base (461)..(461): a, c, t, g, unknown or other
  misc_feature (461)..(461): n is a, c, g, or t
  modified_base (475)..(485): a, c, t, g, unknown or other
  misc_feature (475)..(485): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctcaggctgaggatgaggctgactattactgccagtcctatgacatgaggctgagtgttcgtatgtctgatctggaccaaggtcaccgtctaagtcacgcccaagccaaccctctcgtcacttctcgttcccgccctcctccattacctcgtactgacgtcggcgnggcaggcgcatagnnnnnnnnnnn

SEQ ID NO: 124534 - DNA, 489 bp, Homo sapiens
  misc_feature: GYAE6OF02F2885.18.9.A09.1.454.CMB.1.raw
  modified_base (327)..(327): a, c, t, g, unknown or other
  misc_feature (327)..(327): n is a, c, g, or t
  modified_base (421)..(421): a, c, t, g, unknown or other
  misc_feature (421)..(421): n is a, c, g, or t
  modified_base (477)..(477): a, c, t, g, unknown or other
  misc_feature (477)..(477): n is a, c, g, or t
  modified_base (481)..(489): a, c, t, g, unknown or other
  misc_feature (481)..(489): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcgacggggtccctgaccgattctctggctccaagtctggcacctcagcctccctggccatcactgggctccaggctgagatgaggctgactattacngccagtcctatcgacatgaggctgagttggttcgtatgtcttcggatcgtcgggaccaaggtcaccgtctaagtcacgcccaagcccaaccctntcgtcactctcgttcccgccctcctcctactctcgtactgcgcggctgcgaggcgnatgnnnnnnnnn

SEQ ID NO: 124535 - DNA, 498 bp, Homo sapiens
  misc_feature: GYAE6OF02HU69N.18.9.A09.1.454.CMB.1.raw
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (488)..(488): a, c, t, g, unknown or other
  misc_feature (488)..(488): n is a, c, g, or t
  modified_base (490)..(498): a, c, t, g, unknown or other
  misc_feature (490)..(498): n is a, c, g, or t
tcagtacgagtatgcacgaccggtgctcgatttagcgagacgcgcagggtcctgggcccagtctgtgctgacgcagccgccctcagtgtctgggggccccagggcagagggtcaccatctcctgcactgggagcacctccaacatcgggggcgggttatgatgtacactggtaccagcagcttccagggacagcccccaaatcctcatcttttggagcaaacaatccggccctcaggggtcccctgaccgattctctggctccaagtctggcacctcagtcctccctggccatcactgggctccaggctgaggatggaggctagacttatcaagccagtccatgacatgaagctggagtgttcgtatcgtcttcggatcgtcggacaaggtcaccgtctaagtcagacccaaggccaacccctcncgtcactctcgttcccnccctccncatctcgtacngagcggctggacgaggcgactaagtagncnnnnnnnnn

SEQ ID NO: 124536 - DNA, 739 bp, Homo sapiens
  misc_feature: GYAE6OF02IJX38.18.9.A09.1.454.CMB.1.raw
  modified_base (732)..(732): a, c, t, g, unknown or other
  misc_feature (732)..(732): n is a, c, g, or t
  modified_base (736)..(737): a, c, t, g, unknown or other
  misc_feature (736)..(737): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacacgcccccaaaactccctcattctttggtacgacaacaactccggccctcgacggggtcccctgaccgattctcgtcggcctaccaagttccgtggcctaccctcacgtcccctcccgtggccatccacgtcgggcctccgaggtctggaggtatggaggtctagacttacttacgtcgcctagttcctagtcgaactagtcggaaggtctaggtacggtttggtttacgttagttcggttaccgtttacgggtaacgtttccgggtaccgggtaaacccgtaaacggggttccctaacccggtttaccgttaaaccggtacccgaacccggtaacccccgtaaaaccggtaccccccttaaaacccccgttccgttacccggttacccttaccctttcccgttaccccgtttacccccctaccccctttacccgttacccttaaccgttacccgttaccggttacccgtacgggaaccggtcccgggtaccttacggggaccgtaaccgggaccggtaactaacgtacggactctagctacgncgcnngc

SEQ ID NO: 124537 - DNA, 486 bp, Homo sapiens
  misc_feature: GYAE6OF02GXA6K.18.9.A09.1.454.CMB.1.raw
  modified_base (291)..(291): a, c, t, g, unknown or other
  misc_feature (291)..(291): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
  modified_base (473)..(474): a, c, t, g, unknown or other
  misc_feature (473)..(474): n is a, c, g, or t
  modified_base (477)..(486): a, c, t, g, unknown or other
  misc_feature (477)..(486): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccccaaatccctcatctttggtagcaacaatccggcccctcgaggggtccctgaccgattctctggctccaagtctggcaacacggcctccctgaccntcctcgtgggctccgaggctgaggacgnggctgattattactgcagctnatanacanccacngcactctntatgtctacggaactgggaccaggtcaccgtctagcagcccaagcccacccntcncnctctctcccncctcctccactactctacgngacgcgggctgcaggcacagtagcnnctnnnnnnnnnn

SEQ ID NO: 124538 - DNA, 591 bp, Homo sapiens
  misc_feature: GYAE6OF02F3O5J.18.9.A09.1.454.CMB.1.raw
  modified_base (339)..(339): a, c, t, g, unknown or other
  misc_feature (339)..(339): n is a, c, g, or t
  modified_base (578)..(578): a, c, t, g, unknown or other
  misc_feature (578)..(578): n is a, c, g, or t
  modified_base (583)..(583): a, c, t, g, unknown or other
  misc_feature (583)..(583): n is a, c, g, or t
  modified_base (585)..(587): a, c, t, g, unknown or other
  misc_feature (585)..(587): n is a, c, g, or t
  modified_base (589)..(591): a, c, t, g, unknown or other
  misc_feature (589)..(591): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggagcaaacaatccggccctcgacggggtccctgaccgattcctctggctccaagtctggccacctcacgccctccctggccatcacgtgggcctccgaggctggaggatggaggctgacttattacngccagtcctatcgacagtgaggtctggagttggttcgtatgttcttggatcggtacgggaacgtaaggtccaccgttctaacgtcgaaccgacccgaacggccctaaccccgtcttcgtacctacttcccttcccgttaccccctaccccttacccttaccgtaaccttaccgttccggttactacggaccggtccgggtcgtcgggaccgtaacgggccgtaccgtaagtacgctcgngtacncnnncnnn

SEQ ID NO: 124539 - DNA, 514 bp, Homo sapiens
  misc_feature: GYAE6OF02G37YB.18.9.A09.1.454.CMB.1.raw
  modified_base (328)..(328): a, c, t, g, unknown or other
  misc_feature (328)..(328): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (510)..(514): a, c, t, g, unknown or other
  misc_feature (510)..(514): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaaactcctcatctttggtagcaaacaatcggccctcgaggggtccctgaccgattctctggctccaagtctggcacctcacgcctcctggccatcactgggctccaggctgaggatggagctgactatacngccagtcctatgacatgagctgagtggttctatgtcttaggatcgtagggaccaaggtcaccgtctaagtcacgtacccaaggcccaaaccctctcgtaccacttctcgttcccgccctcctacctactacttccgtactgacggtcgggctcggacgacggcgactagtacgnancnagcnnnnn

SEQ ID NO: 124540 - DNA, 511 bp, Homo sapiens
  misc_feature: GYAE6OF02GACI3.18.9.A09.1.454.CMB.1.raw
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
  modified_base (501)..(501): a, c, t, g, unknown or other
  misc_feature (501)..(501): n is a, c, g, or t
  modified_base (503)..(505): a, c, t, g, unknown or other
  misc_feature (503)..(505): n is a, c, g, or t
  modified_base (507)..(511): a, c, t, g, unknown or other
  misc_feature (507)..(511): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggagcaacaatcggccctcaggggtccctgaccgattctctggctccaagtctggcacctcagcctccctggcccatcactgggctccaggctgaggatgagctgactatactgccagtcctangacatgagctgagtggttcgtatgtctcggntcgtgggaccaaggtcaccgtcgtaagtcacgcccaaaggtcccaaaccctctcgtaccactcctcgttaccccaccctaccctccacttactcgtacttcgacgcgggctcggcaacgggccgacaatacggcnannnannnnn

SEQ ID NO: 124541 - DNA, 638 bp, Homo sapiens
  misc_feature: GYAE6OF02IJXR3.18.9.A09.1.454.CMB.1.raw
  modified_base (352)..(352): a, c, t, g, unknown or other
  misc_feature (352)..(352): n is a, c, g, or t
  modified_base (633)..(633): a, c, t, g, unknown or other
  misc_feature (633)..(633): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggccacctcacgccctccctggccatccacgtcggggcctccgagggcctggaggatggaggctgacttattactcgccagtcctangacagtgaggtctgtaggttggtttcgtatcggttcgtttcggtacgtttcgtacgggaccgtaacgggttcctacccgttaccttaagtccgaacggtccccgtaaacgggacccctaaccccgttcgtacgttccctaccgttccgttccgttcccccgtcccttacccgttacccgtaacttaccgttaccgttaccgtaggtaccggtacccgggttccgtacgggtacccgaacgggtccgacggtaacgtacggtcacgtacgcgactgtacgcnctgtc

SEQ ID NO: 124542 - DNA, 493 bp, Homo sapiens
  misc_feature: GYAE6OF02GGCNE.18.9.A09.1.454.CMB.1.raw
  modified_base (483)..(493): a, c, t, g, unknown or other
  misc_feature (483)..(493): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccgaggctgaggatgaggctgactattactgccagtcctatgacatgagctgagtgttcgtatgtcttggatcgtgggaccaggtcaccgtctaagtcacgcccaaggcccaaccctctcgtccactctcgttccccaccctcctccattacctcgtactgacgcggctggacaggcgacagtagnnnnnnnnnnn

SEQ ID NO: 124543 - DNA, 656 bp, Homo sapiens
  misc_feature: GYAE6OF02JI3ZW.18.9.A09.1.454.CMB.1.raw
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (650)..(655): a, c, t, g, unknown or other
  misc_feature (650)..(655): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaatcctcatctttggtagcaaacaatcggccctcgacggggtccctgaccgattctctggcctccaagtcctggcacctcacgtcctccctggcccatcactgggctccaggctgaggntgagctgactattacncgcctagtcctaatcgaactagtcggacggtctaggtaacggttcggtttaccgtaagttcggttcgtttacgggaacgtttccggtacggggtaaccctaaacgggtccctaaccccggttaccttaaacggttccgaaccgtaccccgaaacgggtacccctaaaccccgttcgttaaccgtccctaaccgtttccgttcccggttcccccgtacccttacccctcccgtaaactttcccgtaccggtttaacccgacgggtacggtcccgggtcttacgggcgtaaacggtccgaaccgtaagtccggncgancgnnnnnnc

SEQ ID NO: 124544 - DNA, 498 bp, Homo sapiens
  misc_feature: GYAE6OF02G9CZ6.18.9.A09.1.454.CMB.1.raw
  modified_base (216)..(216): a, c, t, g, unknown or other
  misc_feature (216)..(216): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(493): a, c, t, g, unknown or other
  misc_feature (492)..(493): n is a, c, g, or t
  modified_base (495)..(498): a, c, t, g, unknown or other
  misc_feature (495)..(498): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtancaacaatcggccctcaggggtccctgaccgattctctggctccaagtctggcacctcagcctccctgaccatctctgggcctccgaggctgaggacgaggctgattatactgcagctcatatacaagcacagcactctctatgtcttcgaactgggaccaggtccaccgtctaggtcacgcccaaggcccaaccctctacgtccactctcgttccccaccctcctccactctcgtactcgacgccggctgggcacggcgacagtacgntgcngncnncnnnn

SEQ ID NO: 124545 - DNA, 475 bp, Homo sapiens
  misc_feature: GYAE6OF02GBV4X.18.9.A09.1.454.CMB.1.raw
  modified_base (322)..(322): a, c, t, g, unknown or other
  misc_feature (322)..(322): n is a, c, g, or t
  modified_base (410)..(410): a, c, t, g, unknown or other
  misc_feature (410)..(410): n is a, c, g, or t
  modified_base (465)..(475): a, c, t, g, unknown or other
  misc_feature (465)..(475): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcacggggtccctgaccgattctctggctccaagtctggcacctcacgcctccctggccatctctgggctccaggctgaggacgagctgattnttactgcagctcatatacaagcacagcaactctctatcgtcttcgactgggaccaaggtcaccgtctaggcagcccaagcccaacccntgtcactctctcccaccctctccatctcgtactgacgcggctgcagcgacatagnnnnnnnnnnn

SEQ ID NO: 124546 - DNA, 530 bp, Homo sapiens
  misc_feature: GYAE6OF02I5O2Q.18.9.A09.1.454.CMB.1.raw
  modified_base (273)..(273): a, c, t, g, unknown or other
  misc_feature (273)..(273): n is a, c, g, or t
  modified_base (441)..(441): a, c, t, g, unknown or other
  misc_feature (441)..(441): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
  modified_base (528)..(530): a, c, t, g, unknown or other
  misc_feature (528)..(530): n is a, c, g, or t
tcagtacgagtatgcacgaccggtgctcgatttagcgagacgcgcagggtcctgggcccaggtctgtgctgacgcagccgccctcagtgtctggggccccagggcagagggtcaccatctcctgcactgggagcacctccaacatcgggggcgggttatgatgtacactggtaccagcaacttccaggaacagcccccaaattgtcatctatggtaacaataatcggccctcaggggtccctgcccgattctctggctccaagtctgcacctnacgcctcctggccatcacgtggcctccgaggctgatgatcgaggctagacttatacgtgcctagtcctatcgaacactaatctacagttcggtcgtgggggtcttcgggcgggaggccagggctcggaccgtggtgggtcacgcccgaaggcctaccgccccgtgtcnctctctccccacctcctctactcctcgtactcgacgcggcgtacggcgtaacggcctacgtacgtacgntagctagcagtcntagcnnn

SEQ ID NO: 124547 - DNA, 507 bp, Homo sapiens
  misc_feature: GYAE6OF02H4BW7.18.9.A09.1.454.CMB.1.raw
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
  modified_base (496)..(507): a, c, t, g, unknown or other
  misc_feature (496)..(507): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatccggccctcgaggggtcccctgaccgattctctggctccaagtctggccacctcacgccctccctggcccatcactgggcctccgaggctggaggatggaggctgacttatactgccagtcctatgacagtgagctgagttgttcgtatgtcgttcggatcgtggaccaggtccaccgtactagtcacgcccgaacgcccaaccctntacgtcactctccgttccccnccctcctccattacctcgttactgcggcggtcnggacgacggcnannnnnnnnnnnn

SEQ ID NO: 124548 - DNA, 488 bp, Homo sapiens
  misc_feature: GYAE6OF02FMA4H.18.9.A09.1.454.CMB.1.raw
  modified_base (216)..(216): a, c, t, g, unknown or other
  misc_feature (216)..(216): n is a, c, g, or t
  modified_base (342)..(342): a, c, t, g, unknown or other
  misc_feature (342)..(342): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(488): a, c, t, g, unknown or other
  misc_feature (479)..(488): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtancaacaatcggccctcgacggggtccctgaccgattctctggctccaagtctggccacctcacgccctccctgggcccatccacgtcgggcctcccgaggctggaggatggaggctgactatttacngccagttcctatcgacagtggacggctgaggttgttcgtatgtcgttgatcgtggacaggcaccgtctagcngccagccaccntcncnctctcgttcccacctctccatcctctacgtgagcgcnggcagcgnangnnnnnnnnnn

SEQ ID NO: 124549 - DNA, 590 bp, Homo sapiens
  misc_feature: GYAE6OF02GDFQB.18.9.A09.1.454.CMB.1.raw
  modified_base (217)..(217): a, c, t, g, unknown or other
  misc_feature (217)..(217): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (582)..(582): a, c, t, g, unknown or other
  misc_feature (582)..(582): n is a, c, g, or t
  modified_base (589)..(589): a, c, t, g, unknown or other
  misc_feature (589)..(589): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtancaacaatcggccctcgacggggtccctgaccgattctctggctccaagtctggcacctcagcctccctgccatcactgggctccaggctgagntgaggctgactattacngccagtcctatgacatgaggctaggagttgttcgtagttgttcgttcggattcgtacgggaaccgtaacggtcctacccggttaccctaaagtccgaaccggaccccaaacgggacccctaaaccccgtcttacgtacctaccttccgttccgttccccgcccttaccctaccctaaccttcgtacctcggacggtccggtcgtacgggccgtaacgggccgtacgtaacgtacggctacgacgtctcgacgctntcgcgtng

SEQ ID NO: 124550 - DNA, 567 bp, Homo sapiens
  misc_feature: GYAE6OF02FN962.18.9.A09.1.454.CMB.1.raw
  modified_base (223)..(223): a, c, t, g, unknown or other
  misc_feature (223)..(223): n is a, c, g, or t
  modified_base (473)..(473): a, c, t, g, unknown or other
  misc_feature (473)..(473): n is a, c, g, or t
  modified_base (521)..(521): a, c, t, g, unknown or other
  misc_feature (521)..(521): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
tcagtacgagtatgcacgaccggtgctcgatttagcgagacgcgcagggtaccgtgggcccagtcctgtgctgacgcagccgtccctcagtgtctgggcccagggcagaggtcaccatctcctgcacgtgggtagcacctccaacagttcggggcgggtttatgattgtacactggtaccagcagcttccagggacagccccaaatcctcgatctttggtacncaacagtccggccctcgaggggtccctgaccgtattctctggctccaaggtctggcctacctcacgtcctcccgtggccatcacgtgggctccaggctgacggatggaggtctgacttagttacgtgcctagttcctagtgactacgtggaggtctaggtagtggtttacgtattcgttcgttcggattcggtagggaaccgtagggtcctacccgttactaagtcgacgcccaacggtccctaaccctntacgtcaccttcgttacttccccaccttcctaccaactacctcgtacnggacgcgggctaggaccaggcatacgtancntgctancangatgac

SEQ ID NO: 124551 - DNA, 644 bp, Homo sapiens
  misc_feature: GYAE6OF02IRSKA.18.9.A09.1.454.CMB.1.raw
  modified_base (638)..(638): a, c, t, g, unknown or other
  misc_feature (638)..(638): n is a, c, g, or t
  modified_base (640)..(644): a, c, t, g, unknown or other
  misc_feature (640)..(644): n is a, c, g, or t
tcagtacgagtatgcacgaccggtgctcgatttagcgagacgcgcagggtcctgggcccagtctgtgctgacgcagccgccctcagtgtcaggggccccagggcagagggtcaccatctcctgcactgggagcacctccaacatcgggggcgggttatgatgtacactggtaccagcagcttccagggacacgcccccaaaactcctcatctttggtagcaacatcggccctcgacggggtccctgaccgattcctctggcctccaagtcctggccaccctcagccctccctggccatcactgggcctccgaggctggagatcggagctgactattactgccagttcctagtcgactattggacggtctaggtacgttgggtttaccgtaatcggttaccgtttcgggattccggtaggggaaccctaagggttcccgtacccgttcctaaacggtaccaacggtacccccgaaacgggtccccctaaaccccgttcgttcggtaccctaccgttcccttaccggttcccccaacccttcccgttacccaactttaccgtaccgtaccgttacggaccggtccggggtaccttacggggaccaacggggtcccgaacttaacggtacgtcagctcgcncnnnnn

SEQ ID NO: 124552 - DNA, 693 bp, Homo sapiens
  misc_feature: GYAE6OF02I3VXI.18.9.A09.1.454.CMB.1.raw
  modified_base (213)..(213): a, c, t, g, unknown or other
  misc_feature (213)..(213): n is a, c, g, or t
  modified_base (352)..(352): a, c, t, g, unknown or other
  misc_feature (352)..(352): n is a, c, g, or t
  modified_base (686)..(686): a, c, t, g, unknown or other
  misc_feature (686)..(686): n is a, c, g, or t
  modified_base (689)..(692): a, c, t, g, unknown or other
  misc_feature (689)..(692): n is a, c, g, or t
tcagtacgagtatgcacgaccggtgctcgatttagcgagacgcgcagggtccgtgggcccagtctgtgctgacgcagccgccctcagtgtctcggggccccagggcagagggtcaccatctcctgcactgggagcacctccaacagtcggggcggttatgatgtacactggtaccagcagctcaggacacgccccaaactcctcatcttggancaacatccggcctacgacggggtcccctgaaccgtattcctctcggctaccaagtcctaggcccaccgtcacgtcccctcccgtgcccatcacgtgggcctccgaggctgaacggatcggagtctaggacttacttacncgtcctaacgttccctaagtagaacctagtacgaacgggtcttacgggtaaggtttggtttccgttaacgtttgtttcccgggtttacggaacgtttcccggtaaacggggtaaaccccgtaaacgggttcccgtaaacccggtttaacccgtaaacgtaccgtaaccggaacccccgaaaccggtacccctaaaccccgttcgttacgttacctaccgtttccgttacccgtacccctacccttcccgtaccctaaccttacgttaccgttaacctcgggtaacggtcgggtacccgtaggaccgaacggacgtacctaagtagcgctagctnagnnnnc

SEQ ID NO: 124553 - DNA, 879 bp, Homo sapiens
  misc_feature: GYAE6OF02IG073.18.9.A09.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (826)..(826): a, c, t, g, unknown or other
  misc_feature (826)..(826): n is a, c, g, or t
  modified_base (861)..(861): a, c, t, g, unknown or other
  misc_feature (861)..(861): n is a, c, g, or t
  modified_base (873)..(873): a, c, t, g, unknown or other
  misc_feature (873)..(873): n is a, c, g, or t
tcagtacgagtatgcacgaccggtgctcgatttagcgagacgcgcaggggttccgtcggcccacgtcgtgttcgctgacgtcagccgccctcagtgtctggggccccagggcagaggtcaccatctcctgcacgtgggagcacctccaactagttcggggtcggtttatgattagtacactggtaccagcagcttcgagggacacgacccccgaaatcctnattcgtttggtagcaanaacgtccggtccctcgacggggtccctgaccgtatttcgtcgtacggtccttaccgtaagttcctcggtacctaacccgttcgacgtcccccttccccggtcggaccctaactcccgtaccggtcgggggtaacccttcccggaaggggtccgttagggacggtaacgttacgggtaacggttaccgttaaacggtaacctttttaacgttaaacccggtccggtaaccccgtaacggggtttaccccttaaggttaccggaaaccggttagggtacggggtaaaccgggttccggtttaagggttaccggtttaaccgggttttacgtttaacggtttcggtttaaccgggtttacgggtaacctttacccgggaacggggaaaacccgttaacgggtacccgttaaccccgtttaacgttaaccggtacccgaacggtaacccccgtaaaccggtacccccttaaaccccggttttgaacgttaccccgttaaaccgttccggttaacccccggtttcccgtcccccgtttaacgttaccctaacgtttaccgttacggttacgtacgggacgggtccggttacgnggaacggacggtcgacgtaaggtcgagtcgtacgnacgctacggtcnctactg

SEQ ID NO: 124554 - DNA, 578 bp, Homo sapiens
  misc_feature: GYAE6OF02I48LS.18.9.A09.1.454.CMB.1.raw
  modified_base (347)..(347): a, c, t, g, unknown or other
  misc_feature (347)..(347): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (571)..(573): a, c, t, g, unknown or other
  misc_feature (571)..(573): n is a, c, g, or t
  modified_base (575)..(577): a, c, t, g, unknown or other
  misc_feature (575)..(577): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacatccggcctcgaggggtccctgaccgtattctctggcctccaagtctggcacctcagcctcctggccatcactgggctccgaggctgaggatggaggctgactattacgtgcctagtcctagcaacntggacgctggagttcgttcgtatgtcttggatcgtagggacctaaggtcctacccgtcgtaaagccgtaacgacccgaaggtcccctaaaccccttcgtcgttaccacccttccgttaccggttcccccgcccttcccttacccgacttacccgttcggtaccttggaccggtccgggcgttcgggtaccgaagggtcccgtaacgtaagttcggcncnacgcnnncnnnc

SEQ ID NO: 124555 - DNA, 537 bp, Homo sapiens
  misc_feature: GYAE6OF02GMYAK.18.9.A09.1.454.CMB.1.raw
  modified_base (457)..(457): a, c, t, g, unknown or other
  misc_feature (457)..(457): n is a, c, g, or t
  modified_base (492)..(492): a, c, t, g, unknown or other
  misc_feature (492)..(492): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaatcctcatctttggagcaacaatcggccctcgaggggtccctgaccgattcctctggcctccaagtcctggcacctcacgcctccctggccatcactgggctcgaggctggagatgagctgacttattacgtgccagtcctagtcgacagtgagtctggtagttggttctagtcgttcttacggatcgtagggaccaaggtctaccgtcctaagtcaacgccaacggccctaaccctctacgtccactcctccgttcccnccctacctccatcctccgttactcgacgtcggtcncggtacgacggtcgacgtacgtcgntcgangacncngtcngntcg

SEQ ID NO: 124556 - DNA, 516 bp, Homo sapiens
  misc_feature: GYAE6OF02FIOVN.18.9.A09.1.454.CMB.1.raw
  modified_base (325)..(325): a, c, t, g, unknown or other
  misc_feature (325)..(325): n is a, c, g, or t
  modified_base (411)..(411): a, c, t, g, unknown or other
  misc_feature (411)..(411): n is a, c, g, or t
  modified_base (510)..(510): a, c, t, g, unknown or other
  misc_feature (510)..(510): n is a, c, g, or t
  modified_base (513)..(515): a, c, t, g, unknown or other
  misc_feature (513)..(515): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatcggcccctcaggggtccctgaccgattctctggctccaagtctggcacctcagcctcctggccatcacgtgggctccaggctgaggatgagctgactattacngccagttcctatgacatgagctggagttggttctatcgttctggatcgtggaccagtcaccgtctaagtcacgccagcccaccctntcgtcactctcgttccccaccctcctaccattacctccgttacgtcgacggccggtcgtcggaccgaacgggccgtacaacgttaggactgtcagtcangcnnnc

SEQ ID NO: 124557 - DNA, 601 bp, Homo sapiens
  misc_feature: GYAE6OF02GZJ1Y.18.9.A09.1.454.CMB.1.raw
  modified_base (218)..(218): a, c, t, g, unknown or other
  misc_feature (218)..(218): n is a, c, g, or t
  modified_base (490)..(490): a, c, t, g, unknown or other
  misc_feature (490)..(490): n is a, c, g, or t
  modified_base (585)..(585): a, c, t, g, unknown or other
  misc_feature (585)..(585): n is a, c, g, or t
  modified_base (596)..(600): a, c, t, g, unknown or other
  misc_feature (596)..(600): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacacgcccccaaactcctcatctttggtancaacaatccggccctcgacggggtccctgacccgtattcctcgtaggcctccaagtctggccacctcacgccctcccgtcggcctatccacgtgggcctccgaggctgaggatgacggtctagacttattacgtgcctagtcctatcgactagtggagtctaggtaggttggtttcgtagtcggttcctttcggtattcgtacgggtaccgaaaggtcctaccgttccgtaagtcgaacgacccgaacgtacccaacccttcgtacgtaccnccttacttccgttccccgcccttaccctaccacttaccgtaccgttacgtcggacggtccgggtcgtcggacgtaacggccggtactagtacgtnacgtgactgcnnnnnc

SEQ ID NO: 124558 - DNA, 476 bp, Homo sapiens
  misc_feature: GYAE6OF02F3L5X.18.9.A09.1.454.CMB.1.raw
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
  modified_base (458)..(458): a, c, t, g, unknown or other
  misc_feature (458)..(458): n is a, c, g, or t
  modified_base (466)..(468): a, c, t, g, unknown or other
  misc_feature (466)..(468): n is a, c, g, or t
  modified_base (470)..(476): a, c, t, g, unknown or other
  misc_feature (470)..(476): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatcggccctcaggggtccctgaccgattctctggctccaagtctggcacctcagcctccctggccatcactgggctccaggctgaggatgaggctgactattactgccagtcctatgacatgagctgagtgttcgtatgtcttggatcgtggacagtcacgtctagtcngaccagccaccctctgtcactctcgtcccncctcctctatcctcgtactgacgtcggctggcaacggcncgatagcnnncnnnnnnn

SEQ ID NO: 124559 - DNA, 528 bp, Homo sapiens
  misc_feature: GYAE6OF02GJ7U8.18.9.A09.1.454.CMB.1.raw
  modified_base (286)..(286): a, c, t, g, unknown or other
  misc_feature (286)..(286): n is a, c, g, or t
  modified_base (445)..(445): a, c, t, g, unknown or other
  misc_feature (445)..(445): n is a, c, g, or t
  modified_base (501)..(501): a, c, t, g, unknown or other
  misc_feature (501)..(501): n is a, c, g, or t
  modified_base (517)..(520): a, c, t, g, unknown or other
  misc_feature (517)..(520): n is a, c, g, or t
  modified_base (522)..(524): a, c, t, g, unknown or other
  misc_feature (522)..(524): n is a, c, g, or t
  modified_base (526)..(528): a, c, t, g, unknown or other
  misc_feature (526)..(528): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcgacggggtccctgaccgtattctctggctccaagtctggcacctcagcctcccnggccatcactgggcctccgaggctgaggatggagctgacttattacgtcgccagttcctatgactagtggaggctgaggttggtttcgtattggtccttggatcgtacgggaccaaggtccaccgtctaagtccgacgacccaacggccctaacccctnttcgctactcctccgttccccaccctcctaccacttacctcgtactgcggcggtcncggacaggcgcatcgnnnncnnntnnn

SEQ ID NO: 124560 - DNA, 521 bp, Homo sapiens
  misc_feature: GYAE6OF02HLV1T.18.9.A09.1.454.CMB.1.raw
  modified_base (320)..(320): a, c, t, g, unknown or other
  misc_feature (320)..(320): n is a, c, g, or t
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (512)..(514): a, c, t, g, unknown or other
  misc_feature (512)..(514): n is a, c, g, or t
  modified_base (516)..(521): a, c, t, g, unknown or other
  misc_feature (516)..(521): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaaacaatcggccctcaggggtccctgaccgattctctggctccaagtctggccacctcacgccctccctggccatccacgtggggcctccgaggtctggaggntgaggctgacttattactgacctagtcctaatgaacagtgaggctggagtggttcgtatcgttctttcggattcgtgggaccaaggtccaccgtactagtccacgcccaagccctaaccctntcgtcactctcgttccccacccttcctccatacctcgtactggacgcggctcggacacggcncatcgntnnncnnnnnn

SEQ ID NO: 124561 - DNA, 731 bp, Homo sapiens
  misc_feature: GYAE6OF02GWNWC.18.9.A09.1.454.CMB.1.raw
  modified_base (716)..(716): a, c, t, g, unknown or other
  misc_feature (716)..(716): n is a, c, g, or t
  modified_base (724)..(724): a, c, t, g, unknown or other
  misc_feature (724)..(724): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttggtagcaacaatccggccctcgacggggtccctgaccgattctctggctccaagtctggcacctcacgcctcccgtggcctatccgacgtgggcctaccgaggctggaggatggaggtctagaacttattacgtcgacctagtcctagtcgactagtggaggtctaggtacgttgggtttacgtagttcggttccgtttacgggacgttaccggtacggggaacccgtaaacgggttaccctaacccggttacccgttaaacggtaccgtaaccggtacccccgtaaaaccgggtacccccttaaaccccccgttcgttaccgttacccgttaacccgtttccgtttacccggtttaccccctaccgtttacccccctttacccgtttaacccgtaaaccgtttacccgttacccggttaaccggttacggtaaccggggtcccggggtaccgttacggggtaacccgaacggggtcccgaaccgttaaggtacggactgacngtacgtcncgtcngn

SEQ ID NO: 124562 - DNA, 716 bp, Homo sapiens
  misc_feature: GYAE6OF02JXL4D.18.9.A09.1.454.CMB.1.raw
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (296)..(296): a, c, t, g, unknown or other
  misc_feature (296)..(296): n is a, c, g, or t
  modified_base (379)..(379): a, c, t, g, unknown or other
  misc_feature (379)..(379): n is a, c, g, or t
  modified_base (707)..(707): a, c, t, g, unknown or other
  misc_feature (707)..(707): n is a, c, g, or t
  modified_base (716)..(716): a, c, t, g, unknown or other
  misc_feature (716)..(716): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccagggacacgcccccaaactcctcattctttggtagcaaacaatccggccctcgacggggtccctgaccgtntttcnctggctccaagtctggcctacctcacgcccttccgngcccatccacgtcgggcctccgaggctggtaggatggacggctcgaacttactttacgcggacctacgttacctagtcgaacncgttagacgggtctagggtagtttcgggtttacgttacttcggttccgtttaggacgtacgtacggggtaaccgtacgggttaccgtacccggttacgttaacggtaccgtacgaccccgtaaaccgtacccgtaacccgttaccgttcgttacccgtccttacccgtttcccgtttaccccggtacccccttcccgttacccctaacctttacccggttacccgtttaaccgtaccgggtaaccggggttcccgggtaccggttacggtaccggtaaccgggtaccgcccggtaagtttaacggcgcgtaacggtcacgttacggcncgtcgtatn

SEQ ID NO: 124563 - DNA, 518 bp, Homo sapiens
  misc_feature: GYAE6OF02FT46P.18.9.A09.1.454.CMB.1.raw
  modified_base (251)..(251): a, c, t, g, unknown or other
  misc_feature (251)..(251): n is a, c, g, or t
  modified_base (508)..(518): a, c, t, g, unknown or other
  misc_feature (508)..(518): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattcnctggctccaagtctggcacctcagcctccctggccatcactgggctccaggctgaggatgaggctgactattactgccagttccatgacatggaggctgagttggttctatcgtctttcggatcgtcgggacctaaggtcaccgtccgtaagtcacgcccgaagcccaacccctctcgtccaccttcctcgttccccaccccttcctcccacttaccgttccgtacctgacggccggctgggcaacggcgctatagnnnnnnnnnnn

SEQ ID NO: 124564 - DNA, 538 bp, Homo sapiens
  misc_feature: GYAE6OF02JDMPY.18.9.A09.1.454.CMB.1.raw
  modified_base (525)..(528): a, c, t, g, unknown or other
  misc_feature (525)..(528): n is a, c, g, or t
  modified_base (531)..(538): a, c, t, g, unknown or other
  misc_feature (531)..(538): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacaccggggcgggttatgatgtacactggtaccagcagcttccagggacagcccccaaactcctcatctttggtagcaacaatcggccctcacggggtccctgaccgattctctggctccaagtctggcacctcacgcctcctggccatcacgtgggctccgaggctgaggatgaggctgacttatactgctacgtcctatgacatggaggtctggtaggttggtttcgtagttggtcgtttcggagttcgtagggaccgtacggtcctaccggtcctaagtcacgacccgaacggccctaaccctctacgtctactctccgtcccgccctcctcctactaccgtcgttacgcgacggccggtctcggacacggcgacgtagtannnncgnnnnnnnn

SEQ ID NO: 124565 - DNA, 640 bp, Homo sapiens
  misc_feature: GYAE6OF02JQ31M.18.9.A09.1.454.CMB.1.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (345)..(345): a, c, t, g, unknown or other
  misc_feature (345)..(345): n is a, c, g, or t
  modified_base (627)..(627): a, c, t, g, unknown or other
  misc_feature (627)..(627): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (638)..(640): a, c, t, g, unknown or other
  misc_feature (638)..(640): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttgggancaacactccggcctcacggggtccctgaccgnttctctcggcttccaagtctggccacctcacgcctacccgtggccattcgacgtcgggacctccaaggctaggaggtatcggaggtcctggaactnttacgtgcctaagtccgtaatcggactagtacggtacggaccgttggaagggttttcggtttacggtattcgggtttacgttacggtaagttcggtacgggtaaacccgttaacgggtacccgtacccgttacctaaacggtctaccggacccgtaacggaccctaccccttacgtcgttaccacttccgttccgttacccacccttccgtaccctacgtacttaaccgtctacgtacggccgggtcttacgggaccgtacgccggtacagttagacgcgtnctacncgcncnnn

SEQ ID NO: 124566 - DNA, 575 bp, Homo sapiens
  misc_feature: GYAE6OF02GCDBV.18.9.A09.1.454.CMB.1.raw
  modified_base (347)..(347): a, c, t, g, unknown or other
  misc_feature (347)..(347): n is a, c, g, or t
  modified_base (465)..(465): a, c, t, g, unknown or other
  misc_feature (465)..(465): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (570)..(571): a, c, t, g, unknown or other
  misc_feature (570)..(571): n is a, c, g, or t
  modified_base (573)..(575): a, c, t, g, unknown or other
  misc_feature (573)..(575): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaatcctcatctttggagcaacaatcggccctcgacggggtcccctggaccgtattcctcgtggcctaccaagtctggccacctcagccctcccgtggcccattccactgggcctccgaggctaggaggatggaggctagacttattacngaccagttacctatgaactagtcggaagctggagttggttacgtatcggttcttacgggatcgtagggacctaaggtccaacccgttctaaagtcacgacccgaacgccctaaccctntacgctacgtctccgttcccacctccctaccgtaattcccgtacgtactgtacggccgggtacgcggactaacgggccgtacaagttacggcagngtacngtacnncnnn

SEQ ID NO: 124567 - DNA, 614 bp, Homo sapiens
  misc_feature: GYAE6OF02F7XGS.18.9.A09.1.454.CMB.1.raw
  modified_base (397)..(397): a, c, t, g, unknown or other
  misc_feature (397)..(397): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
  modified_base (607)..(613): a, c, t, g, unknown or other
  misc_feature (607)..(613): n is a, c, g, or t
tcagtacgagtatgcacgaccggtgctcgatttagcgagacgcgcagggtcctgggcccagtctgtgctgacgcagccgccctcagtgtctggggccccagggcaggagggtcaccatctcctgcactgggagcacctccaacatcgggggcgggttatggatgtacactggtaccagcagcttccagggacacgaccccccaaatcctcattcttttggtacgcaaacaagtccggccccttcgacgggggttcccctggacccgtattccgtcgtcggcctaccgaaggtcctcgggccacccgtcacggtcccctccccgtggccctatccacgttcggggcctccgaggtcgtggaggatgaggctgactattacgcgaccagtcctatgacngtaggagctaggtagttggtttactagttgttcgtttcgattcgtacgggaacctacggtcctaccggtacctaagtcgaccgacccgaacgccctaacccctcgttcgtcctacctccgttccgttacccccgtccttcccgtaccacgttacctccgtttacgtggacggtcggcgtcggtacgaacgggcgacctatacggntnncnnnnnnnc

SEQ ID NO: 124568 - DNA, 758 bp, Homo sapiens
  misc_feature: GYAE6OF02JL0EP.18.9.A09.1.454.CMB.1.raw
  modified_base (742)..(742): a, c, t, g, unknown or other
  misc_feature (742)..(742): n is a, c, g, or t
  modified_base (752)..(753): a, c, t, g, unknown or other
  misc_feature (752)..(753): n is a, c, g, or t
  modified_base (755)..(755): a, c, t, g, unknown or other
  misc_feature (755)..(755): n is a, c, g, or t
  modified_base (757)..(757): a, c, t, g, unknown or other
  misc_feature (757)..(757): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccgagggacacgccccaaactcctcacttctttaggtacgacaaacaacgtcggcccctcggacggggtccctgacccgtattctcgtggcctacgaacgtctcggccacctcacgcccctcctccggcctactcctacgttcgggcctaccgacggtcctagggaaggtagtcggacggtcttacggtaacttaacgtttaacctaccgtaacgttaccttaactacgaaccgtagtacggacggtcgttacggtaggtttacggtttacgtaagtttcgggttccgtttacgggtaacgttccggggttaaaccgggtaacccgttaaacgggtttccccgttaaaccccgggtttaccggttaaaccggtcccggtaaaccggtacccccgtaaaccggaacccccttaacccgttcttaccgggtaccctacccgttaccggttacccctttacccccgtaccccttacctacccgttaaccttacccgttacggttaacccgtcggtaccgggtaccggtaccgtagggcccgacgggtccgactaacggtgcgngctgcaggtnncngnc

SEQ ID NO: 124569 - DNA, 608 bp, Homo sapiens
  misc_feature: GYAE6OF02HWVZN.18.9.A09.1.454.CMB.1.raw
  modified_base (526)..(526): a, c, t, g, unknown or other
  misc_feature (526)..(526): n is a, c, g, or t
  modified_base (597)..(597): a, c, t, g, unknown or other
  misc_feature (597)..(597): n is a, c, g, or t
  modified_base (600)..(601): a, c, t, g, unknown or other
  misc_feature (600)..(601): n is a, c, g, or t
  modified_base (605)..(608): a, c, t, g, unknown or other
  misc_feature (605)..(608): n is a, c, g, or t
tcagtacgagtatgcacgaccggtgctcgatttagcgagacgcgcagggtcctgggcccagtctgtgctgacgcagccgccctcagtgtctggggccccagggcagaggtcaccatctcctgcactgggagcacctccaacatcgggggcgggttatgatgtacactggtaccagcagcttccagggacagcccccaaactcctcattctttggtacgcaacaagtccggaccctcgacgggggtccctagaccgtattctctggcctaccaagtcgtcggcacctcacgccctcccgtcggccatccacgtcggggcctccgagggtcgtacggaaggtacgtggaacggtcgttagtaacttagttaccgtgtacccagtttccctaagtcgaactatggaggtctaggtaggttggttacgtagttcgttacgttcgtagtcggtacggacgtaacggtccaacccgtacgtaacgtaccgacgacccgacgaacccaccctcgtcgactctctaccgttccnccgtcccctcccgtaccacttacctcgttacgacggacgtccgggactcggcgaacggtcgacagtgactncgnnacgnnnn

SEQ ID NO: 124570 - DNA, 522 bp, Homo sapiens
  misc_feature: GYAE6OF02H5TDD.18.9.A09.1.454.CMB.1.raw
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
  modified_base (494)..(494): a, c, t, g, unknown or other
  misc_feature (494)..(494): n is a, c, g, or t
  modified_base (512)..(522): a, c, t, g, unknown or other
  misc_feature (512)..(522): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacagcccccaaaactcctcatctttggtagcaaacaatccggccctcgacgggggtccctcgaccgattctcgtggctccaagtctggccacctcacgccctccctggccatccacgtgggcctccaggctggaggatggaggctgtacttattactgccacgttcctatgacngtgagtctgagttggttcgtatgtctttcggatcgtgggactaaggtcaccgtctaagtcacgccaacgcccaaccctncgtctactctccgttcccaccctcctaccacttactcgtactgacgtccgggntacgcgaacggcgcatgnnnnnnnnnnn

SEQ ID NO: 124571 - DNA, 661 bp, Homo sapiens
  misc_feature: GYAE6OF02IC3HX.18.9.A09.1.454.CMB.1.raw
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (651)..(651): a, c, t, g, unknown or other
  misc_feature (651)..(651): n is a, c, g, or t
  modified_base (653)..(661): a, c, t, g, unknown or other
  misc_feature (653)..(661): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccgagggacacgccccccaaacttcctacatcgtttggtacgacaaacaattccggccctacgacggggtcccctgaccgtattcctctcggcctccgaagtcctggccacctcacgtccctccctggcccatccacgtcgggcctccgaggctaggaggatggacggctagaacttacttacgngacctaggtaccctagtnaaccagttcggaaggtctaggtacggtttggttacttagttgttaccgttttacgggagttcggtacgggtaaccgtaacgggttaccaacccggttacgttaaacggtccgtaaccggacccgtaaacggtaacccctaaaccccttcgtacgttacctacgttaccttacccggtttacccctaccccttacccgttacctacttacccgtccggttaacctcggacggaccgggtcgtcgggacgaacgggtccgcgactacggncnnnnnnnnn

SEQ ID NO: 124572 - DNA, 543 bp, Homo sapiens
  misc_feature: GYAE6OF02HWZAL.18.9.A09.1.454.CMB.1.raw
  modified_base (288)..(288): a, c, t, g, unknown or other
  misc_feature (288)..(288): n is a, c, g, or t
  modified_base (530)..(530): a, c, t, g, unknown or other
  misc_feature (530)..(530): n is a, c, g, or t
  modified_base (532)..(534): a, c, t, g, unknown or other
  misc_feature (532)..(534): n is a, c, g, or t
  modified_base (536)..(536): a, c, t, g, unknown or other
  misc_feature (536)..(536): n is a, c, g, or t
  modified_base (538)..(543): a, c, t, g, unknown or other
  misc_feature (538)..(543): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagccccccaaaactcctcatctttggtagcaacaatccggccctcgacgggggtccctgaccgattctctggctccaagtctggcacctcagcctcccnggccatcacgtcgggctccgaggctgacggatggaggctagacttattactgcctagtcctatgacatggaggctgagttggttcgtattgtcgtttcggagtcgtacggaccgtaacggtccaccgtacctaagtccgacgaccccgaacggaccctaacccctctcgtcctactctccgttccctaccctcctaccacttcctacgttactcggacggccggtctcggacaggcgctagngnnnangnnnnnn

SEQ ID NO: 124573 - DNA, 649 bp, Homo sapiens
  misc_feature: GYAE6OF02GCGGM.18.9.A09.1.454.CMB.1.raw
  modified_base (241)..(241): a, c, t, g, unknown or other
  misc_feature (241)..(241): n is a, c, g, or t
  modified_base (625)..(625): a, c, t, g, unknown or other
  misc_feature (625)..(625): n is a, c, g, or t
  modified_base (633)..(633): a, c, t, g, unknown or other
  misc_feature (633)..(633): n is a, c, g, or t
  modified_base (645)..(645): a, c, t, g, unknown or other
  misc_feature (645)..(645): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccgagggacacgcccccaaatcctcatctttggataacaatccggcctcgacggggtcccngaccgtattctctggcctccaagtctcggcaccgtcacgcccttccctggcctatccacgtgggcctccggagtctgaggatggacggtctagaacttacttacgtcgcctagttccctatagactatggaacggtctaggtagttcggtttacgtagttcggttcgttacgggaacttccggtacgggaaaccgtaacgggtcccttaacccggtaccgttaacgtccgaccggaaccccgtaacggacccctaaccccgttctacgtccgtaccttcgttacccttacccctacccttacctacctaccgtaccgttccgtaaccgtgaccggtccgggtcgtacggtaccgtaccggcgtaaccgtacgtacggtcgtacncgtgtacncgaccgatcggnatcg

SEQ ID NO: 124574 - DNA, 520 bp, Homo sapiens
  misc_feature: GYAE6OF02FHWKE.18.9.A09.1.454.CMB.1.raw
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (473)..(473): a, c, t, g, unknown or other
  misc_feature (473)..(473): n is a, c, g, or t
  modified_base (508)..(508): a, c, t, g, unknown or other
  misc_feature (508)..(508): n is a, c, g, or t
  modified_base (510)..(511): a, c, t, g, unknown or other
  misc_feature (510)..(511): n is a, c, g, or t
  modified_base (513)..(520): a, c, t, g, unknown or other
  misc_feature (513)..(520): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggcccctcgacggggtccctgaccgtattctctggctccaagctggccactcacgcctcctgccatcacgtgggctcgagctgagntgaggctgactattacngcctagtcctatgacagtgagctggagttggttctattcgtcttggactcgtggaccagtccaccgtcgtagtcgacgacccaacggcccaacccgactcgtactactctccgttccccaccctcctccacttacctcgttaccngtacggccgggtctcgggactacggcgacacgtgngnngnnnnnnnn

SEQ ID NO: 124575 - DNA, 689 bp, Homo sapiens
  misc_feature: GYAE6OF02GVKI3.18.9.A09.1.454.CMB.1.raw
  modified_base (321)..(321): a, c, t, g, unknown or other
  misc_feature (321)..(321): n is a, c, g, or t
  modified_base (680)..(680): a, c, t, g, unknown or other
  misc_feature (680)..(680): n is a, c, g, or t
  modified_base (683)..(689): a, c, t, g, unknown or other
  misc_feature (683)..(689): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggagcaacaatccggccctcgacggggtccctgaccgattctctggcctccaagtctggccacctcacgccctccctcggccatccacgtgggcctccgaggctgaggntgaggctagacttattactcgcctagtcctagtcgaacagtggacggcgttggtaaggttcgggtttacgtagttcggttccgtttacgggtacttccggtacggggtaacccgtaaacgggttcccgtaacccggttacccgttaaacggtccgtaaccggacccccgaaaccgggtaccccctaaacccccgttcgttaccggttaccctaaccgtttcccgtttccccggtttcccccccggtccccctttaccccgttacccttaaaccgttaacccgttacccggttaacccgttcgggaaccgggtcccggggtccgtacgggaccgtaacgggtccggaactacgtaagctncannnnnnn

SEQ ID NO: 124576 - DNA, 724 bp, Homo sapiens
  misc_feature: GYAE6OF02J06X3.18.9.A09.1.454.CMB.1.raw
  modified_base (704)..(704): a, c, t, g, unknown or other
  misc_feature (704)..(704): n is a, c, g, or t
  modified_base (712)..(712): a, c, t, g, unknown or other
  misc_feature (712)..(712): n is a, c, g, or t
  modified_base (718)..(718): a, c, t, g, unknown or other
  misc_feature (718)..(718): n is a, c, g, or t
  modified_base (723)..(723): a, c, t, g, unknown or other
  misc_feature (723)..(723): n is a, c, g, or t
tcagtacgagtatgcacgaccggtgctcgatttagcgagacgcgcagggtcctgggcccagtctgtgctgacgcagccgccctcagtgtctggggccccagggcaggagggtcaccatctcctgcacgtgggagcacctccaacatcggggcggttatgatgtacactggtaccagcagcttccagggacacgaccccaaactcctcattacgtttggagccaacaatccggtccctcgacggggtccctgaccgtattacgtcgtggcctcctaaggtctcggaccacgtaccacgccctacccgtggaccctaagtcacgtcgggcctccgacggtctgacggtatcgggacgtcctgtaaccttagttaccgtcgcccgtaagttccgtagtacggtactaggtcggacggtacgtaggtacggtttacggtttcgttaagtccggtacgtttcggtacgtaccggttacgggaacccgtaacggttacccgaacccggttacctaaacggtacgaacccggtaaccccggaaacccggtcccttaaccccgttcgttaccgtcctaaccgttccgttacccgtttacccccgtcccttacccgtacctaccgttacccgtaccgttacgtacggttaccgggtcggtaccgtcgggaaccgtacgggtaccgtacgtacggtacgcgtaacgtcggtacncggtaccnggtacncgtang

SEQ ID NO: 124577 - DNA, 548 bp, Homo sapiens
  misc_feature: GYAE6OF02FGVW7.18.9.A09.1.454.CMB.1.raw
  modified_base (318)..(318): a, c, t, g, unknown or other
  misc_feature (318)..(318): n is a, c, g, or t
  modified_base (539)..(541): a, c, t, g, unknown or other
  misc_feature (539)..(541): n is a, c, g, or t
  modified_base (543)..(548): a, c, t, g, unknown or other
  misc_feature (543)..(548): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacatcggccctcgacggggtccctgaccgattcctcgtggcttccaagtctggcacctcagccctccctggccatcacgtgggcctccgaggctgacggntggaggctgaacttattacctgccctagtcctatcgaacagtggaggctggaggttggtttctattcgttccttcggattcgtcgggaacctaggtcctaccgtacctaacgtcgacgcccgaacggccctaaaccctcgtcgtaccacttctccgttcccacccctcctcctacttacctcgtactcgcggtcggtctggtacaggcgacgataggctannncnnnnnn

SEQ ID NO: 124578 - DNA, 539 bp, Homo sapiens
  misc_feature: GYAE6OF02GHQPH.18.9.A09.1.454.CMB.1.raw
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (529)..(529): a, c, t, g, unknown or other
  misc_feature (529)..(529): n is a, c, g, or t
  modified_base (531)..(539): a, c, t, g, unknown or other
  misc_feature (531)..(539): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaatcctcatctttggtagcaacaatccggccctcgacggggtccctgaccgtattcctctggcctccaagtctggcacctcacgcctccctggcctatcacgtgggcctccgaggcctggaggatggaggtctagacttattactgcctagtcctangacngtgaggtctggtagttggtttactagttcgtctttaggacttcggtagggacctaaggtcccaccgttacgtaagtcacgtcccaacgccctaccctntcgtccnctctcgtcccctccctctcctatacctcgtactgacggcggtctcggacgacggcagtactagcngnnnnnnnnn

SEQ ID NO: 124579 - DNA, 585 bp, Homo sapiens
  misc_feature: GYAE6OF02F83L4.18.9.A09.1.454.CMB.1.raw
  modified_base (347)..(347): a, c, t, g, unknown or other
  misc_feature (347)..(347): n is a, c, g, or t
  modified_base (500)..(500): a, c, t, g, unknown or other
  misc_feature (500)..(500): n is a, c, g, or t
  modified_base (533)..(533): a, c, t, g, unknown or other
  misc_feature (533)..(533): n is a, c, g, or t
  modified_base (575)..(575): a, c, t, g, unknown or other
  misc_feature (575)..(575): n is a, c, g, or t
  modified_base (579)..(585): a, c, t, g, unknown or other
  misc_feature (579)..(585): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttaggtagcaacaatccggccctcgacggggtccctggacctattcctctcggctccaagttcctggccacctcacgcccctccctggccatcacgtgggcctccgaggctggaggatgaggctagacttattacngacctagtcctatgaacagttgaggtctggtaggttggtttacgtattggttctttcggattcggtcgggaacctaaggtcctacccgttacctaagtcacgacccgaacggcccctaacccgtctcgtaccctacttccttccgttaccccncccttaccctacctacttaccgtccgttaccgngacggcgggtcttccgggacacggtccgactaagacggctgntcgnnnnnnn

SEQ ID NO: 124580 - DNA, 532 bp, Homo sapiens
  misc_feature: GYAE6OF02GOCHK.18.9.A09.1.454.CMB.1.raw
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
  modified_base (499)..(499): a, c, t, g, unknown or other
  misc_feature (499)..(499): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (525)..(527): a, c, t, g, unknown or other
  misc_feature (525)..(527): n is a, c, g, or t
  modified_base (529)..(531): a, c, t, g, unknown or other
  misc_feature (529)..(531): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacagcccccaaatccctcattctttggtagcaaacaatccggccctcgaggggtccctgaccgattctctggctccaagtctggcncctcagcctccctgccatcactgggctccaggctggagntgagctgactatactgccagtcctatgactatggacgctggagttggttcgtagtggttcttcggactcgtacgggacctaaggtcctaccgtaccgtaagtcacgcccgaacggcccctaacccttctcgtccactccttccgtcccgtccctccctcctacttcctcgtatcggacggcggtcnggacgtacggcgctatcgngntgntnnncnnnc

SEQ ID NO: 124581 - DNA, 614 bp, Homo sapiens
  misc_feature: GYAE6OF02HPELD.18.9.A09.1.454.CMB.1.raw
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (607)..(614): a, c, t, g, unknown or other
  misc_feature (607)..(614): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtancaacaatcggccctcaggggtccctgaccgattctctggctccaagtctggcacctcagccctccctggccatcactgggctccaggctgagatggaggctgactattacngccagtcctatcgactagtgaggtctggtagttggtttacgtattgttccgttcgggtattcggtacgggaacccgtaaggtcctaacccggttcctaaacgttccgacggacccccgtaacgggacccctaaaccccttccgtcgttaccctaccttacccgtttcccgttaccccctaccccgttacccctccctaacgttacccttaccgttacccgtgggaccggtcggggtaccgttcggggacgaaccgggtcgactaacgttacggatcgacnnnnnnnn

SEQ ID NO: 124582 - DNA, 728 bp, Homo sapiens
  misc_feature: GYAE6OF02G4OPB.18.9.A09.1.454.CMB.1.raw
  modified_base (708)..(708): a, c, t, g, unknown or other
  misc_feature (708)..(708): n is a, c, g, or t
  modified_base (719)..(719): a, c, t, g, unknown or other
  misc_feature (719)..(719): n is a, c, g, or t
  modified_base (723)..(723): a, c, t, g, unknown or other
  misc_feature (723)..(723): n is a, c, g, or t
  modified_base (725)..(727): a, c, t, g, unknown or other
  misc_feature (725)..(727): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccgagggacacgacccccaaactcctcattctttggtagcaacaatccggccctcgacggggtccctgaccgattctctggctccaagtctggcacctcacgccctccctcggccatccaccgtgggcctccgaggctggaggagtggaggctagtacttacttactcgacctagtacctagtcgactagtagacggcgtaggtacggttcggtttacgttacgttcggttaccggtttacgggtacgttccgggtacggggtaaacccgtaacgggttacccgtaacccggttaccgttaaacggtacccgtaaccggaaccccgtaaacccggtacccccgttaaaccccgttccgttaccgtaccgttaacccgtttccgtttaccccggtttccccccgttacccctttaccctttacccgtaacccgtttaccgtttacccggtttaaccgtccgggtacgggtacccggggttacggtaccgggtaccggaaccgggtaccggtaacgtaaagttcggtanacgtagcgtcncgtncnnnc

SEQ ID NO: 124583 - DNA, 633 bp, Homo sapiens
  misc_feature: GYAE6OF02FL4N1.18.9.A09.1.454.CMB.1.raw
  modified_base (216)..(216): a, c, t, g, unknown or other
  misc_feature (216)..(216): n is a, c, g, or t
  modified_base (341)..(341): a, c, t, g, unknown or other
  misc_feature (341)..(341): n is a, c, g, or t
  modified_base (623)..(624): a, c, t, g, unknown or other
  misc_feature (623)..(624): n is a, c, g, or t
  modified_base (628)..(632): a, c, t, g, unknown or other
  misc_feature (628)..(632): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtancaacaatccggccctcgacggggtccctgaccgattctctggcctccaagtcctggccacctcacgccctccctggccatccacgtgggcctccgaggctggaggatggagctagacttattacngcctagtcctagtcgactgtaggacggctggaagttgggtttacttagttcggtttccgtttacgggacgttcggtacgggtaaccgtaacgggttccgtacccggttaccgtaaacgtccgtaaccgaccccgtaaccggtacccctaaccccgtaccgttaccgttacctaccgttccttccgttccccgtccccgttcccttcccgggtacctaccgtccgttaccgtcggtaccggcgggtcgtcggtacgacggaccggtacgacgttacgcgactnncgannnnnc

SEQ ID NO: 124584 - DNA, 623 bp, Homo sapiens
  misc_feature: GYAE6OF02F8JP0.18.9.A09.1.454.CMB.1.raw
  modified_base (612)..(623): a, c, t, g, unknown or other
  misc_feature (612)..(623): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttggtagcaacaatccggccctcgacggggtccctgaccgattctctggctccaagtctggccacctcacgtccctccctggccactcacgtcgggcctccgaggctaggaggtatggacggctgtaccttatttacctcgacctagtcctaatcgaactacttaactctacgtagttcggttcgtcgggggttccgttcggggcgggacgggaccgaggcgtcggaccggttcgggtcgggtccgaccggtacccgaacgggtcccgtcccggtcccccgttccggttcccgtacccgtttcccgttcccggtttcccccgtcccccttcccttaccctaccttaccgtccgtaaccgtcggacggtccgggcgtcggaccgacggtcgactagtcgatnnnnnnnnnnnn

SEQ ID NO: 124585 - DNA, 495 bp, Homo sapiens
  misc_feature: GYAE6OF02F4FP5.18.9.A09.1.454.CMB.1.raw
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
  modified_base (446)..(446): a, c, t, g, unknown or other
  misc_feature (446)..(446): n is a, c, g, or t
  modified_base (485)..(495): a, c, t, g, unknown or other
  misc_feature (485)..(495): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaatcctcatctttggtagcaacaatcggccctcaggggtccctgaccgattctctggctccaagtctggcacctcagcctccctggccatcacgtgggcctccgaggctggaggatggagctgactattacngccagtcctatgacagtgaggctggagttggttcgtatgtcttgntcgtggactaagtcaccgtctaagtcacgcccaagcccaaccctctcgtcacttctcgttccccgccctccnccactactcgtactgacgcgcgtggcaaggcgacatagnnnnnnnnnnn

SEQ ID NO: 124586 - DNA, 592 bp, Homo sapiens
  misc_feature: GYAE6OF02IQPJ9.18.9.A09.1.454.CMB.1.raw
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (402)..(402): a, c, t, g, unknown or other
  misc_feature (402)..(402): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (587)..(591): a, c, t, g, unknown or other
  misc_feature (587)..(591): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatccggccctcaggggtccctgaccgattcnctggctcaagtctggccacctcacgccctccctggcccatccacgtcgggcctccgaggcgtggaggtntaggacggtctgacttattacgtgtcccagttcctagtgacngtggacgctggtagttcggtttgtattgttcgtttcggnttcgtcgggaaccgtaacggtcgtaccgttcctaagtcgaccgtcccgaaccggcccctaacccctcgttcgtacctaccttccttccgttccccctacccttcccttacctactaccgttaccgttaccgacggtacggccgggtccgtcgggtacgacgggtccgactagtacgntncancannnnnc

SEQ ID NO: 124587 - DNA, 519 bp, Homo sapiens
  misc_feature: GYAE6OF02GYACC.18.9.A09.1.454.CMB.1.raw
  modified_base (218)..(218): a, c, t, g, unknown or other
  misc_feature (218)..(218): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
  modified_base (504)..(504): a, c, t, g, unknown or other
  misc_feature (504)..(504): n is a, c, g, or t
  modified_base (510)..(519): a, c, t, g, unknown or other
  misc_feature (510)..(519): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacacgcccccaaactcctcatctttggtancaaacatccggccctcgacggggtccctgaccgacttctctggctccaagtctggcacctcacgccctcccctggccatccacgtgggctccgaggtctggaggatggaggctgacttattacngccagttccatgacngtggaggtctggtagttggtttctagtcgttctttggatcgtagggaccaaggtcaccgtctaagtcagcccaacggcccaaccctntcgtcactcttccgttcccnccctcctcctactactcgtactgacgcggctcggcaggcncaatcnnnnnnnnnn

SEQ ID NO: 124588 - DNA, 596 bp, Homo sapiens
  misc_feature: GYAE6OF02IWKM4.18.9.A09.1.454.CMB.1.raw
  modified_base (578)..(578): a, c, t, g, unknown or other
  misc_feature (578)..(578): n is a, c, g, or t
  modified_base (585)..(586): a, c, t, g, unknown or other
  misc_feature (585)..(586): n is a, c, g, or t
  modified_base (589)..(596): a, c, t, g, unknown or other
  misc_feature (589)..(596): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatccggccctcgacggggtccctgaccgtattctctggctccaagtctggcacctcacgccctcccgtggccatcacgtcgggcctccgaggctggaggagtcggacggctggtaacttattactcgaccctagttcctagtcgacagttcggaggtctggtaggttcgggtttcgtattcggttccgtttcgggtattccggtcggggaaccctaagggttacccgtacccggttactaaaggtccgaaccgtccccgaaacggcccctaaccccttcgttcgtcctaccttcctaccgttccccaccctccctacctacttcctcgtactgacgcgggtctcggacacggccgntagacgnngcnnnnnnnn

SEQ ID NO: 124589 - DNA, 861 bp, Homo sapiens
  misc_feature: GYAE6OF02GUA2C.18.9.A09.1.454.CMB.1.raw
  modified_base (833)..(833): a, c, t, g, unknown or other
  misc_feature (833)..(833): n is a, c, g, or t
tcagtacgagtatgcacgaccggtgctcgatttagcgagacgcgcagggtcctgggcccagtctgtgctgacgcagccgccctcagtgtctggggccccagggccagagggtcaccatctcctgcactgggagcacctccaacatcggggcgggttatgatgtacactggtaccagcagcttccgagggacacgcccccaaactcctcatctttggtagcaacaatccggccctcgacggggtccctgaccgtattctctcggctccaagtctggcctaacctcacgtccctcccgtcggccctactaccgtaccgtcggggaccctcccggaacggtccgttagggaacgggtacgttacgggaacggggtcctttacgggtaaaccgtttaaccgttttaaccggttaccggtaccccggtaacggttttacccccgttaagttaaccggtaaacgttaacgttacggggtaaacgggttccgtttaacgggtaacggggttttacggggttttcccggtttaaaggtttccgggttttaccgtttaacgggtacgtttccgggtaacggggtaaacccgtaaacggggttaccccgtaacccggttaccgtttaaacgggttaccgaacccggtaaccccgtaaccgggtacccccttaaaacccccgtttcgttaccggttacccttaaccgtttccggtttacccgttcccccgttacccccgttccttacccgtaaccgtttacccgttaccgttaacgggttcgggaccggttaccggggtaccgttacgggaccggtaacgggtcccgacgttaagttacccggntaccgtctacgtcgtacgctactgactg

SEQ ID NO: 124590 - DNA, 785 bp, Homo sapiens
  misc_feature: GYAE6OF02ICYX9.18.9.A09.1.454.CMB.1.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (770)..(770): a, c, t, g, unknown or other
  misc_feature (770)..(770): n is a, c, g, or t
  modified_base (773)..(773): a, c, t, g, unknown or other
  misc_feature (773)..(773): n is a, c, g, or t
  modified_base (775)..(775): a, c, t, g, unknown or other
  misc_feature (775)..(775): n is a, c, g, or t
  modified_base (777)..(777): a, c, t, g, unknown or other
  misc_feature (777)..(777): n is a, c, g, or t
  modified_base (779)..(779): a, c, t, g, unknown or other
  misc_feature (779)..(779): n is a, c, g, or t
  modified_base (781)..(781): a, c, t, g, unknown or other
  misc_feature (781)..(781): n is a, c, g, or t
  modified_base (783)..(784): a, c, t, g, unknown or other
  misc_feature (783)..(784): n is a, c, g, or t
tcagtacgagtatgcacgaccggtgctcgatttagcgagacgcgcagggtcctgggcccagtctgtgctgacgcagccgccctcagtgtctcggggccccagggcagagggtcaccatctcctgcactgggagcacctccaacagtcggggtcgggttatgatgtacactggtaccagcagcttccgagggacacgccccaaactccnctacttctttggtagcaacaagtccggcctcgacggggtccctggaccgtattcttcgcggcctaccgaagttcgcggacacccgttnaccgtcccctcccgtcggacctaatccaccggtcgggtcccttccgacggtcctaggacggtatggaacggtcctagacgtttactttaccgcggtacccgaaagtttccctagttacggacctattacgggaacggttacctggggtaagtttccgggttttaccggttattcggttttcgtttacccgggaacttttccgggaccggggtaaaccgtaaaccggggtttccccgtaacccgggtttacccgttaaacgggttacccgaaaccccggtacccggtaaacccgggttaaccccttaaacccccgttcccggttactaccccggttacctttccccggtcccttttaaccccccgacccctttacccttaacccggtacctttaacccggttacccgttacggttaaccggccggtaccgggtccggtaaccgggacgtacggggccctacgtaacgttcgcacngcncncncncncnnc

SEQ ID NO: 124591 - DNA, 648 bp, Homo sapiens
  misc_feature: GYAE6OF02I6EQS.18.9.A09.1.454.CMB.1.raw
  modified_base (132)..(132): a, c, t, g, unknown or other
  misc_feature (132)..(132): n is a, c, g, or t
  modified_base (143)..(143): a, c, t, g, unknown or other
  misc_feature (143)..(143): n is a, c, g, or t
  modified_base (313)..(313): a, c, t, g, unknown or other
  misc_feature (313)..(313): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
  modified_base (642)..(645): a, c, t, g, unknown or other
  misc_feature (642)..(645): n is a, c, g, or t
  modified_base (647)..(648): a, c, t, g, unknown or other
  misc_feature (647)..(648): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggancacctccaacntcggggcgggttatgatgtacactggtaccagcagtccttccgagggacacgaccccccaaactcctcatctttggacgcaacaatccggccctcgaggggtccctagaccgtacttctccgtggctaccgaagtcgtggcctaacctcacgcccctcccgttcggaccnttccaccgtgggtccctccgagggtctaggacggagtcggacgggctacgtacctattacgtcgaccgagtaccttagacaccggtatggaacgggtctagggtacggttttggttacgttaacgttcggttaacccgtttcggtagtccgggttacggtaacccgggtagtacccgtaccgtacgtaacgtcaccggacccgaacggaccctacccgtctacgtcctacctccgttcctcccgtcccttacccttaccgtacgttcccgtaccgtacgtcgacggtccgggacttcgggactacgggcgtaactacgtagcncnnctnnnncnn

SEQ ID NO: 124592 - DNA, 602 bp, Homo sapiens
  misc_feature: GYAE6OF02FTQD4.18.9.A09.1.454.CMB.1.raw
  modified_base (259)..(259): a, c, t, g, unknown or other
  misc_feature (259)..(259): n is a, c, g, or t
  modified_base (372)..(372): a, c, t, g, unknown or other
  misc_feature (372)..(372): n is a, c, g, or t
  modified_base (592)..(592): a, c, t, g, unknown or other
  misc_feature (592)..(592): n is a, c, g, or t
  modified_base (594)..(602): a, c, t, g, unknown or other
  misc_feature (594)..(602): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcattctttggtagcaaacaatccggccctcgacggggtccctgaccgtattccncgtggcctccaagtctggccacctcacgcccttcccgtggccatcacgtgggcctccgaggtctggaagagtggacgtcgtagtacttattacgtcgacctagtcctatcganagtgagtctggtaggttgttacgtatgttcgttcggagttcgtagggaaccctacggtcctaaccgttcctaacgtccgaaccggaccccaaaccgggtcccctaaccccgtcgttacgtacctacgttcctcccgttcccctaccccttccctacctacgttacccttccgtactggaccgggccggtcggtacgacggtaacggcggaactagtacgncnnnnnnnnn

SEQ ID NO: 124593 - DNA, 645 bp, Homo sapiens
  misc_feature: GYAE6OF02IEQ9E.18.9.A09.1.454.CMB.1.raw
  modified_base (220)..(220): a, c, t, g, unknown or other
  misc_feature (220)..(220): n is a, c, g, or t
  modified_base (339)..(339): a, c, t, g, unknown or other
  misc_feature (339)..(339): n is a, c, g, or t
  modified_base (375)..(375): a, c, t, g, unknown or other
  misc_feature (375)..(375): n is a, c, g, or t
  modified_base (628)..(628): a, c, t, g, unknown or other
  misc_feature (628)..(628): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
  modified_base (643)..(645): a, c, t, g, unknown or other
  misc_feature (643)..(645): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagtcttccgagggacacgcccccaaactcctcattctttggtanacaacaactccggccctcgacggggtcccctagaccgtacttctctcggtccttccgaagttcgtcggtccacctcacgtccctcccgtcggccatcacgtcggctccgaggctgacgntggaggtctagacttaatacgcgacctagttcctangactagttgaggtctaggtagttaggttcgttagttcgttacggttcggtagttcgtacgggaacccgtaacggttccgtaacccgttaccgttaacggtccgaccgaacccggtaacccgtaccccgtaaacccctttccgtaccgttacccacgtttaccgttcccgttcccccgtaccccttccctccctaacgttacccttccggttaccgtcggacggccggtcgcggacgacggcggacttacggancgtagngnctcgncnnn

SEQ ID NO: 124594 - DNA, 636 bp, Homo sapiens
  misc_feature: GYAE6OF02FPR6I.18.9.A09.1.454.CMB.1.raw
  modified_base (219)..(219): a, c, t, g, unknown or other
  misc_feature (219)..(219): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (617)..(617): a, c, t, g, unknown or other
  misc_feature (617)..(617): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccgagggacacgcccccaaactcctcattctttggancaacatcggccctcgacggggtccctgaccgtattcctctcggcctccgaagtcctggccacctcacgccctccctggccatcacgtgggcctcgaggctgaggntggagctgacttatacngccagtcctatcgactagtggacggtctaggtacgttggttacgtattcggttcctttacgggattcggtacggggaaccctaagggttccctacccggttaccttaaacggtccgaaccggtaccccgaaaccggtcccctaaaccccgttcgttacggttccctaaccgttccttacccgttccccctaccccttccctaccctaacgttacccgttccgttaaccgtcgggacggtccgggtcgtcgggacgtaacgggtccgactaagtagncgagcncnctgacgntncg

SEQ ID NO: 124595 - DNA, 752 bp, Homo sapiens
  misc_feature: GYAE6OF02HQ7US.18.9.A09.1.454.CMB.1.raw
  modified_base (176)..(176): a, c, t, g, unknown or other
  misc_feature (176)..(176): n is a, c, g, or t
  modified_base (740)..(740): a, c, t, g, unknown or other
  misc_feature (740)..(740): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (748)..(752): a, c, t, g, unknown or other
  misc_feature (748)..(752): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactggggagcacctccaacagtcggggcgggttatgatgtacactggtaccngacaacttccaggaacacgcccccaaaattgtccatctatcggtaacaataatccggccctcgaggggtccctgcccgtatttcctcgtcggccttaccgaagttccgtggtaccacccgttccacggtcccccttccccgttcgggcccctaacttccgtaaccggttccggggcccgtttacccgtaggggtccttaggaacttcggtaaggtcgggtaggtaccttaggttaacttttaacttaaccgtcggtacccgtacgttacccgttagtaccgaaaccttaccgttaaattccttacgagggtttcggttcggtcgggggtttcctcggggacggggacgggtaccggacgggtccgtcgggtaaccggttcgggtcgggtacgacgggacccgaacggtcccggtaccgtacccccggttcggttcccttaccggtttcccgttcccggttccccgtcccttccccttaccgtacccgttaacccgtcgttaaccgtcggtaccgggaccgggtcggtaccgggacgaccgggtcgaccgtacgtagcgtagagngncncncnnnnn

SEQ ID NO: 124596 - DNA, 531 bp, Homo sapiens
  misc_feature: GYAE6OF02HT8K6.18.9.A09.1.454.CMB.1.raw
  modified_base (328)..(329): a, c, t, g, unknown or other
  misc_feature (328)..(329): n is a, c, g, or t
  modified_base (520)..(520): a, c, t, g, unknown or other
  misc_feature (520)..(520): n is a, c, g, or t
  modified_base (523)..(531): a, c, t, g, unknown or other
  misc_feature (523)..(531): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaatcctcatctttggtagcaaacaatccggccctcacggggtccctgaccgattctctggctccaagtctggcacctcagcctccctggccatcacgtggctccaggctgagatgaggctgactattacnnccagttcctatcgacatgagctggagtgttacgtatgttacttcggatcgtacggaaccgtaaggtccaccgttctaagtccacgacccgaacgcccaaccctctacgtccactccttccgttccccgcccttaccctcctaactactacgtactcggacgcggtctcggcgaacggtccgcgtaactagnacnnnnnnnnn

SEQ ID NO: 124597 - DNA, 561 bp, Homo sapiens
  misc_feature: GYAE6OF02GM65E.18.9.A09.1.454.CMB.1.raw
  modified_base (224)..(224): a, c, t, g, unknown or other
  misc_feature (224)..(224): n is a, c, g, or t
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
  modified_base (457)..(457): a, c, t, g, unknown or other
  misc_feature (457)..(457): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcggttatgatgtacactggtaccagcagcttccaggggacacgcccccaaaactcctcattctttggtagcaanaatccggccctcgacgggggtccctgaccgattcctcgtcggcctcaagttcctggcacctcacncctcccctggcacgtcacgtcggctccgaggctggagatggagctgactattcncgctagtctancacntgaggtctgtacgttggttcgtagtcgttcgttacggntcgtaggacctaggtccacgtactagcgtacgaccgaacgccctaacccgtctcgttaccncttctccgtcccctacctccgtactacttactccgttacgtcggcgtaccggcgtcggaccgagggtccgtaactaacggtatccgagtnacgncnncncgntn

SEQ ID NO: 124598 - DNA, 831 bp, Homo sapiens
  misc_feature: GYAE6OF02JKYGS.18.9.A09.1.454.CMB.1.raw
  modified_base (271)..(271): a, c, t, g, unknown or other
  misc_feature (271)..(271): n is a, c, g, or t
  modified_base (816)..(816): a, c, t, g, unknown or other
  misc_feature (816)..(816): n is a, c, g, or t
  modified_base (822)..(822): a, c, t, g, unknown or other
  misc_feature (822)..(822): n is a, c, g, or t
  modified_base (824)..(825): a, c, t, g, unknown or other
  misc_feature (824)..(825): n is a, c, g, or t
  modified_base (827)..(827): a, c, t, g, unknown or other
  misc_feature (827)..(827): n is a, c, g, or t
  modified_base (830)..(831): a, c, t, g, unknown or other
  misc_feature (830)..(831): n is a, c, g, or t
tcagtacgagtatgcacgaccggtgctcgatttagcgagacgcgcagggtcctgggcccagtctgtgctgacgcagccgccctcagtgtctcggggccccagggcagagggtcaccatcctcctgcacgtgggagcacctccaacagtcggggcgggttatgatgtacacgtggtaccagcagtccttccgagggacacgcccccaaaactcctactacttcgtttggtagacaaactaacgtccggccctcgacggggtccctgaccgtnttctcgtcgctacaagtctcggctaccctcaccgccccttccgtccggaccactactaccgttcgggccctccgacggtgtacggaaggtcgcgggtaagtccgtagtaccttacgttaccgtcggaaccttaccgttaccgtaaggttccgtaaccgtaggttacggaacgggttccgttaaggggttccggttttacgggttttaccggtttaagtttggtttaacccgggtttacggttaaccggtttccgggttaaccggggtaaacccggtttaaccgggttaaccccggttaaccccggttaacgttaaaccgtaacccggtaacccgggtaacccccgtaaacccggtcccccgttaaaaccccgtttcccgggttacctacccgggttaaccctttaccccgtttaccccggttacccccttaaaccccttcccccgttaaacccttaccgttaacccgttacccgttacgtaccggggtacgtacccggggttacgtacgggaccgttacggggcctacggtaaccgtgtcgacgngtacgncnncnctnn

SEQ ID NO: 124599 - DNA, 581 bp, Homo sapiens
  misc_feature: GYAE6OF02G4YR6.18.9.A09.1.454.CMB.1.raw
  modified_base (287)..(287): a, c, t, g, unknown or other
  misc_feature (287)..(287): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
  modified_base (577)..(581): a, c, t, g, unknown or other
  misc_feature (577)..(581): n is a, c, g, or t
tcagtacgagtatgcacgaccggtgctcgatttagcgagacgcgcagggtcctgggcccagtctgtgctgacgcagccgcctcagtgtctggggccccagggcagagggtcaccatctcctgcactgggagcacctccaacagtcggggcggttatgatgtacactggtaccagcagcttccagggacacgccccccaaactcctcattcgtttcggtagcaaacaatccggccctcgacggggtccctggaccgattcctctggcctccgaagtctggacaccttnacgcctccccgtggccattccacgtgggcctccgaggctggaaggtactggacggctgactattacngacctatcctangacgatggggactggaagttgttcgtatcggtcttcgggactcgtcggaccaggtcctaccgtccgtaagtaccacgacccgaaggccccaacccgttctacggtaccacgtccgtcgttccccacccttcctaccctacgtaccttccgtacgtcggaccggtccggacgtcggacgacggccgtcgaagtacggancgtacgctncgcnnnnn

SEQ ID NO: 124600 - DNA, 596 bp, Homo sapiens
  misc_feature: GYAE6OF02IIRTX.18.9.A09.1.454.CMB.1.raw
  modified_base (242)..(242): a, c, t, g, unknown or other
  misc_feature (242)..(242): n is a, c, g, or t
  modified_base (345)..(345): a, c, t, g, unknown or other
  misc_feature (345)..(345): n is a, c, g, or t
  modified_base (465)..(465): a, c, t, g, unknown or other
  misc_feature (465)..(465): n is a, c, g, or t
  modified_base (593)..(593): a, c, t, g, unknown or other
  misc_feature (593)..(593): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatccggcctcgaggggtcccngaccgattctctggctccaagtctggcacctcacgcctcctaggccatccacgtgggcctccgaggtcctggaaggtctggacggtctagtacttacgttacncgcctagtcctagtgactatggacgtctggagttcggttactagtcgtcgttcgactcgtcggaacgtacggtacctaccgtactaacgtcacggtacccgaacggaccctaaccccgtntcgtacctcttccgtaccgttaccccacccttcctacctaccgttaccgtaccgttaacgcggtacggtccgggactacgggcgtaaacgggccgtactacgtacgtgactcgctacgctacgctcgnacg

SEQ ID NO: 124601 - DNA, 757 bp, Homo sapiens
  misc_feature: GYAE6OF02IA8JT.18.9.A09.1.454.CMB.1.raw
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
tcagtacgagtatgcacgaccggtgctcgatttagcgagacgcgcagggtcctgggcccagtctgtgctgacgcagccgccctcagtgtctcgggggccccaggggcaggagggtcaccatctcctgcacgtgggagcacctccaacagtcgggggcgggttatgatgtacactggtaccagcagcttccgagggacacgccccaaactcctcatctttggtagacaacaacgtccggcctcgacgggtcctcgaccgtattctctggcctccaagttcgtcggccacctcacgtcctcccgtcggcctagtccacgtcggccttaccgacggtcgtggaggtatggacggtctacgtactttacttacgtcgaccgtacgtccctagtcgaactagtacggacggtcgtagggtacgggtttcggttacgttagttcggtttacggtttacgggtacgttccggtaacgggtaacccggttaaacgggttacccgtaacccggtttaacgttaaaccgggtaccgaacccgggtaacccggtaaaccgggtaccccccttaaacccgttttcgtaccggttaccctttaacccgttccggtttaccccggtttcccctaccccgttttcccgttaacccttaacccgtttaacccggttccggttaaccgttagggaccgggtaccgggtccgttagggaacccggtaacgggtccgtaacgtaacggttggactggtcaacgtcagtcacngngc

SEQ ID NO: 124602 - DNA, 751 bp, Homo sapiens
  misc_feature: GYAE6OF02FPBCS.18.9.A09.1.454.CMB.1.raw
  modified_base (745)..(745): a, c, t, g, unknown or other
  misc_feature (745)..(745): n is a, c, g, or t
  modified_base (750)..(750): a, c, t, g, unknown or other
  misc_feature (750)..(750): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcaccctccaacatcgggggcgggttatgatgtacactggtaccagcagcttccagggacacgcccccaaactcctcattctttaggtagacaaacaactccggccctacgacgggggtcccctaggaccctattccgtctcggcctccaaggtctcggcctacctcacgtcccctccctggccctagtccaccggttacgggccctaccggaaggtccgtagaacgggtagtgggtacgggtcttaggtaacctttaagttaccggtcgtacccgtaggttcccttaagtacgactaggttacggaggtaccttgggtagggtttcggttacgttagttcggttaccggttaggtacgttccggtaacgggaaccgttaacgggtccctaacccggttacgttaacggtaccctaacggaaccccgaaccggccccttaaaccccgtcgttaccggtaccctaccggttcccgtttcccggttaccccctccccttaccgttaccctaccgttaccgttaccggttccgacgggtaccgggccgtacgttacgggaccgaaccgggtcccgtaacgtaacgacggtactcttaggaccttcggacttacggtntcgtnc

SEQ ID NO: 124603 - DNA, 637 bp, Homo sapiens
  misc_feature: GYAE6OF02G4VW4.18.9.A09.1.454.CMB.1.raw
  modified_base (619)..(619): a, c, t, g, unknown or other
  misc_feature (619)..(619): n is a, c, g, or t
  modified_base (637)..(637): a, c, t, g, unknown or other
  misc_feature (637)..(637): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactggtaccagcagcttccagggacagcccccaaatcctcatctttggagcaacatccggccctcgaggggtccctgaccgtattctctggctccaagtctggccacctcacgccctcccctggccatcacgtcgggctccgaggtcctggacggatggacggtctagtacttattacgtcgacctacggttccctagtcgactagtaggaggtctggacgttggtttacgtagttcggttcgtttacggattcggtacgggtaacctaaggtcctacccggttacctaacgtccgaacggtacccctaaaccgggtacccctaaccccttgttaccgtacctaccgttccttcccgtttcccccaaccccttccctaccctaaccttaccttccggttaccgtcgggacggtccgggtccgtagggaccgtaacgggtccgaaccggtatacggncgtgctacgcagctgctn

SEQ ID NO: 124604 - DNA, 817 bp, Homo sapiens
  misc_feature: GYAE6OF02GOBZC.18.9.A09.1.454.CMB.1.raw
  modified_base (130)..(130): a, c, t, g, unknown or other
  misc_feature (130)..(130): n is a, c, g, or t
tcagtacgagtatgcacgaccggtgctcgatttagcgagacgcgcagggtcctgggcccagtctgtgctgacgcagccgcctcagtgtctggggcccagggcagagggtcaccatctcctgcactgggancacctccaacatcggggcggttatgatgtacactggtaccagcagcttccagggacacgcccccaaaactcctacattcgtttaggagacaaacacgtccggcccttacgacggggttccctgaccgactttctccgtggcctaccgtaagttccgtcggccaccttacgacggtccccttcccgtggcctattaccgacgttcggggcccttccgaggtccgtaggaacggattaggacgggtccttaggtacttaacgtttacgcgacccgttagttaccctagtacgacacgttagggacgtctaggtaggtttggttccgttagttcggttacgtttacggacgtttccggtaacggggtaaccctaacgggttacccgtaacccgtttaaccgttaaacggttaacccgaaccgggaccccgtaaaccggtacccccgtttaaaacccccgttcgtttaccggtaacccttaccgtttaccccgtttcccggtttacccccctaacccccggtttaccctttaaccccggttaacctttaaaccccggtttcccggtttaaaccgttaccggggccgggttaacccgggggtaccgttccgggttacccggaacggggttacccaacggttaacccgtaagggtccgtaacgtacgtacgtacgacgtcgcgacgacgtacg

SEQ ID NO: 124605 - DNA, 560 bp, Homo sapiens
  misc_feature: GYAE6OF02FJXF3.18.9.A09.1.454.CMB.1.raw
  modified_base (132)..(132): a, c, t, g, unknown or other
  misc_feature (132)..(132): n is a, c, g, or t
  modified_base (250)..(250): a, c, t, g, unknown or other
  misc_feature (250)..(250): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (558)..(560): a, c, t, g, unknown or other
  misc_feature (558)..(560): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggancacctccaacatcgggggcggttatgatgtacactggtaccagcagcttccagggacagcccccaaatcctcatctttggagcaacaatcggccctcgaggggtccctgaccgattcncgtggctccaagtctggccacctcacgccctcctggccctatccactgggcctccgaggctgagntgacggctgactattacngcctagtcctatcgacagtgagtctgagtggttctatgtctgatcgtgggaacctaggtctaccgtctaagtccgacgacccaaggcccctaaccctcgtactacctacgttccttcggttcccccgtccctttcctacctacttacccgttcgtaaccgttcggacgtccgggtcctagggtaccgaacgggtcctacgtaagtcgcacgacgtncacgtancnnn

SEQ ID NO: 124606 - DNA, 743 bp, Homo sapiens
  misc_feature: GYAE6OF02GB7OU.18.9.A09.1.454.CMB.1.raw
  modified_base (300)..(300): a, c, t, g, unknown or other
  misc_feature (300)..(300): n is a, c, g, or t
  modified_base (335)..(335): a, c, t, g, unknown or other
  misc_feature (335)..(335): n is a, c, g, or t
  modified_base (732)..(732): a, c, t, g, unknown or other
  misc_feature (732)..(732): n is a, c, g, or t
  modified_base (741)..(741): a, c, t, g, unknown or other
  misc_feature (741)..(741): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacagtcggggcgggttatgatgtacactggtaccagcagcttccagggacacgcccccaactcctacattctttggtagacaacaacgtccggccctcgacggggtccctggaccgtattcctcgtcggcctccaagtctggcacctcacgccctcccnggccatccacgtcgggcctccgaggccgtggaggnttaggacggtctaggtaactttacgttaccgtacgtaccctacggttccctaagtacgacgtagttcgggaacggtcgttcgggtagggtttcggtttacggttaggtttacggtttccgtttacggggtacgtttaccgggtaccggggtaacccgtaacgggttacccgtacccggttaccgttaaacgtccgacccgtacccgtaaccggtaccccttaaacccccgttcttacccgtaccctaacccgttccgtttaccccggttccccgttaccccgtaccccgttacccgtaaccgttacccgttaccgttaccgtccggtacccgggtacgggtcgtcccgggtacgaaccgggtccggaacgttacgtaacgtcgacgtcgtcgaccgngtgcgtcgncg

SEQ ID NO: 124607 - DNA, 1014 bp, Homo sapiens
  misc_feature: GYAE6OF02HW5OK.18.9.A09.1.454.CMB.1.raw
  modified_base (169)..(169): a, c, t, g, unknown or other
  misc_feature (169)..(169): n is a, c, g, or t
  modified_base (998)..(998): a, c, t, g, unknown or other
  misc_feature (998)..(998): n is a, c, g, or t
tcagtacgagtatgcacgaccggtgctcgatttagcgagacgcgcagggtcctgggcccagtctgtgctgacgcagcccgccctcagtgtctcggggccccagggcaggagggtccaccatctccctgcacgtgggagccaccctccaacagtccgggggcgggtttanggtactcgtactacgtacggtacccagccacgtccttacccgaggggacccaaccgaccccccctaaaccgttccctacacgtttccgtttacgggtaacgaccctaaaccgtaacgttccccgggaccccttaccgggtaccggggggttccccttaccgggtaacccgttacgtttaccgttcccgtacgggtacccctacccgttaacgggttccgttacccggggaccctaacccccgttccgaacccgggttcccccccgtttcccccgttaccgggacccctaaacgttacccggtaccccgggtaccgggggtcccttaacccggaccggggttccttaaggggaacggtacgtacgggtacggtaccgttacgttaacccgttaaacgtttacccggtaccgtaccccgtaacggtttcccttaacggttaccggaacttacggggtacggtaccgggtacgttacggggttacgggttttaccgggtttaccgttacgggtttacgttttcccgggtttaacggttaccggtttaccggggtaacccggggttacccgttaaaccggggttaaccccctaacccgggttaacccggtttaaccgaccggtaacccggaccccggttaacccgaacccccgttaaccctccggtttaccgttaacccgtccgttacccgtttcccggttacccccttaccccttacccgttacccgtaccgttacccgttaaccgttaccgttacgggaccggttccgggtacggtacggtacccgggtaacggaccgtaacggtaacggccgtaacgtacgcgtacgtcngaactcggacataccg

SEQ ID NO: 124608 - DNA, 719 bp, Homo sapiens
  misc_feature: GYAE6OF02FYQPD.18.9.A09.1.454.CMB.1.raw
  modified_base (220)..(220): a, c, t, g, unknown or other
  misc_feature (220)..(220): n is a, c, g, or t
  modified_base (700)..(700): a, c, t, g, unknown or other
  misc_feature (700)..(700): n is a, c, g, or t
  modified_base (705)..(705): a, c, t, g, unknown or other
  misc_feature (705)..(705): n is a, c, g, or t
  modified_base (711)..(711): a, c, t, g, unknown or other
  misc_feature (711)..(711): n is a, c, g, or t
  modified_base (714)..(715): a, c, t, g, unknown or other
  misc_feature (714)..(715): n is a, c, g, or t
  modified_base (717)..(719): a, c, t, g, unknown or other
  misc_feature (717)..(719): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgacccccaaactcctcattctttggtacncaaacaatccggccctcgacggggtccctgaccgtattctctcggcctccgaagtccgtggacctacctcacgtcccctccccgtggccctatcctaccgttcggggccctccgacgggtccgtggaacgggtacgtggacggtcgttacggtaactttagtttaaccgtcgaccctaacggttacctaatcgaactacgtagggacgtcgttaggtacgggtttgggtttacgttagttcggtttccgtttacggtacgtttcggtaacggggtaacccgtaaccggttacccgtacccggttacctaacggtaccgaaccgaaccccgaaaccgtaaccccctaaccccgttctcgttaccgtaccttcccgttcccgttacccccgttccccttacccgtacccttaacgttacccgttaccgtttaccgacggtacggtaccgggtcgtacgggacgacggcgtaaccgagtacgngtacngtacgntcnncnnn

SEQ ID NO: 124609 - DNA, 680 bp, Homo sapiens
  misc_feature: GYAE6OF02IZPFP.18.9.A09.1.454.CMB.1.raw
  modified_base (666)..(666): a, c, t, g, unknown or other
  misc_feature (666)..(666): n is a, c, g, or t
  modified_base (670)..(670): a, c, t, g, unknown or other
  misc_feature (670)..(670): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacagtcggggcggttatgatgtacactggtaccagcagcttccgagggacacgacccccaaactcctcattcgtttggtacgcaacacgtccggccctcgacggggtccctgaccgtattctcgtcggcctaccaagtctgcctacctcacgtcctcccgtcggcctatccacgtcgggactccgaggtcctggagagtggacgtcgtacgtacttattaccgtcgcctacggtacctagtacgtactacgtagggtacggtcgtacggtacgggtttcgttacgttagttcggttccgttagggtacgtcggtaccgggtaacgtaacggttccgtaacccgttacgtaacgtaccgaaccggacccggaaccgaccccgttaaacccttcgtaccgtacctaaccgttccgttacccgttacccccaacccgttccctaccgtaacgttacccgttaccgtacgtccggacgggtccgggtacgaccggacgtaacgggcctaacgtaacggtgactcgacgntacncacncgcngc

SEQ ID NO: 124610 - DNA, 741 bp, Homo sapiens
  misc_feature: GYAE6OF02HSF9K.18.9.A09.1.454.CMB.1.raw
  modified_base (720)..(720): a, c, t, g, unknown or other
  misc_feature (720)..(720): n is a, c, g, or t
  modified_base (727)..(727): a, c, t, g, unknown or other
  misc_feature (727)..(727): n is a, c, g, or t
  modified_base (731)..(731): a, c, t, g, unknown or other
  misc_feature (731)..(731): n is a, c, g, or t
  modified_base (733)..(733): a, c, t, g, unknown or other
  misc_feature (733)..(733): n is a, c, g, or t
  modified_base (736)..(741): a, c, t, g, unknown or other
  misc_feature (736)..(741): n is a, c, g, or t
tcagtacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacagtcggggcgggttatgatgtacactggtaccagcagcttccgagggacacgacccccaaactcctcattcgtttggtacgacaaactaacgtccggccctacgtacggggtccctaggaccgtattctcgtggacctaccgtaaggttcctcgggcctacccgtcgaccgtcccccgttccccgtacgggtaccctacgtcccgtaccgggttccggggtacccttacccggaacggggtccggttaacgggaacgggtacggttacgggacggtaccgttacggtaaccgttttacgtttaaccggtccggacccgttaacgttacccgtacggttacggaacgtaggtacgggtaacggggttctaggggttacggtttcgggtttacgtttaacggtttcggtttaccgggtttacggtacggtttcgggtaccgggtaaccgttaacggtccgtaaccgttacgtaacgtcgaccgaccggtaccgacccctacctcgtacgtacctcgtccgtccgtccccctctccctactactacgtcgtacgtcggcggcgtcgtagacggcgtacgntagtagnacgntncgnnnnnn

SEQ ID NO: 124611 - DNA, 726 bp, Homo sapiens
  misc_feature: GYAE6OF02JBGDR.18.9.A09.1.454.CMB.1.raw
  modified_base (218)..(218): a, c, t, g, unknown or other
  misc_feature (218)..(218): n is a, c, g, or t
  modified_base (710)..(710): a, c, t, g, unknown or other
  misc_feature (710)..(710): n is a, c, g, or t
  modified_base (718)..(720): a, c, t, g, unknown or other
  misc_feature (718)..(720): n is a, c, g, or t
  modified_base (722)..(722): a, c, t, g, unknown or other
  misc_feature (722)..(722): n is a, c, g, or t
  modified_base (724)..(725): a, c, t, g, unknown or other
  misc_feature (724)..(725): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcgggttatgatgtacactggtaccagcagcttccagggacacgcccccaaactcctcatctttggtancaacaatccggccctcgacggggtcccctgacccggacttctcttggcctaccaagtcctggcctacctaccacgccctccccgtggtcccatccaccgtcgggtcctccgacggctcggaggtagtggacggtctcggaacctttacttacgtccgtacctaacggtcccttaagtcgaacctgtagggtaacggtcgttaggtacgggtttggttttaccgtacgttcgggtttacccttagggtacgttacggtaccgggtaaaccgtaacgggttccccgtaacccgtacggttaaaccgtaccgaccgaccccggtaaccggtacccctaacccgttacttccgtacctaacccgtttcccgttccccgggttaccccctccccgttaccccttacccttaaaccgttcccgttacccggttacgtaccgggtaccgggaccggggttccgaccgggtacggtaaccggggctaaccggtaatcggntcgatcgnnncncnnc

SEQ ID NO: 124612 - DNA, 842 bp, Homo sapiens
  misc_feature: GYAE6OF02HWM09.18.9.A09.1.454.CMB.1.raw
  modified_base (176)..(176): a, c, t, g, unknown or other
  misc_feature (176)..(176): n is a, c, g, or t
  modified_base (218)..(218): a, c, t, g, unknown or other
  misc_feature (218)..(218): n is a, c, g, or t
  modified_base (812)..(812): a, c, t, g, unknown or other
  misc_feature (812)..(812): n is a, c, g, or t
  modified_base (821)..(821): a, c, t, g, unknown or other
  misc_feature (821)..(821): n is a, c, g, or t
  modified_base (838)..(838): a, c, t, g, unknown or other
  misc_feature (838)..(838): n is a, c, g, or t
tcagtacgagtatgcacgaccggtgctcgatttagcgagacgcgcagggtcctgggcccagtctgtgctgacgcagccgccctcagtgtctggggccccagggcaggagggtcaccatctcctgcactgggagcacctccaacagtcggggcgggttatgatgtacactggtaccngcagcttccaggacacgcccccaaactcctcatctttggtanacaactaacgtccgccctcgacggggtccctaggaccgtattcgtcgtcggtacctccgtaagttccgtcgggtaccctaaccgttccaacggtccccccgttccccgttcgggaccctaacgttcccgtaaccggttcgggccccgttacccgaacgggtccttaggaacgggtaagttcggaacgggtccgttaggaactttaaccttacgttcggacccttacgggttaccttacgttaggaccgtaagttacggacggggttcctagggttacggggttttcggtttaacgggttacttcgggttttacggtttacccgggtttagttacgggttacggggaaacccggtttaaacgggttccccttaaccggttaacccggttaagtaacccggtacgggtaccccgtaaaccggaccccgtaaaccccgttcttaccggttacccttacgtttcccgtaccccgggttttccccgacccccgtttaaccccgttacccttaccgttaaccgttaccgttttaccggaccggtaaccgggtcccggtaacggtccgggtaaccggacggttaccggccgttaaaccggngtacacgtntacgcgtagcgcgacgntacg

SEQ ID NO: 124613 - DNA, 720 bp, Homo sapiens
  misc_feature: GYAE6OF02FYP4N.18.9.A09.1.454.CMB.1.raw
  modified_base (144)..(144): a, c, t, g, unknown or other
  misc_feature (144)..(144): n is a, c, g, or t
  modified_base (656)..(656): a, c, t, g, unknown or other
  misc_feature (656)..(656): n is a, c, g, or t
  modified_base (704)..(704): a, c, t, g, unknown or other
  misc_feature (704)..(704): n is a, c, g, or t
  modified_base (710)..(710): a, c, t, g, unknown or other
  misc_feature (710)..(710): n is a, c, g, or t
  modified_base (713)..(715): a, c, t, g, unknown or other
  misc_feature (713)..(715): n is a, c, g, or t
  modified_base (718)..(718): a, c, t, g, unknown or other
  misc_feature (718)..(718): n is a, c, g, or t
tcagtacgagtatgcacgaccggtgctcgatttagcgagacgcgcagggtccgtgggcccagtctgtgctgacgcagccgccctcagtgtctggggccccagggcagagggtcaccatctcctgcactgggagcacctccaacngtcggggcggttatgatggtacactggtaccagcagcttccgagggaccacgtcccccaaactcctacattccgttttggaacgcaaccaagtccggcccctcgacggggtcccctggaccgtattctctggcctacctaagtcttggaccacctcacgccctcccgtgccatccgacgtcgggcctacgacggtctacggaaggtacgtagacggtctacggtaacttacgttacgttcggacctaacgtccgttagtacgtactagtcggtacggacttgggaagtttcggggttaacttcggttacggttccttacgggactttcgggaacgggtaccgtaacgggttcccgtaccccggttacgtaaaccggtacccgaccggtaaccccgtaaacccgggtacccctaaaccccggtttgttacccggttaccgtacccgtttacccgtaccctttaccccctaacccgttcccgtaacgttaccttacccgtaccttaccggttanccgggttaccgggacgttacggacgaaccggtccgaacgtacgtacgngcagcncgnnncgncg

SEQ ID NO: 124614 - DNA, 880 bp, Homo sapiens
  misc_feature: GYAE6OF02GGR2C.18.9.A09.1.454.CMB.1.raw
  modified_base (861)..(861): a, c, t, g, unknown or other
  misc_feature (861)..(861): n is a, c, g, or t
  modified_base (868)..(868): a, c, t, g, unknown or other
  misc_feature (868)..(868): n is a, c, g, or t
  modified_base (874)..(874): a, c, t, g, unknown or other
  misc_feature (874)..(874): n is a, c, g, or t
  modified_base (877)..(878): a, c, t, g, unknown or other
  misc_feature (877)..(878): n is a, c, g, or t
tcagtacgagtatgcacgaccggtgctcgatttagcgagacgcgcagggtcctgagcccagtctgtgctgacgcagccgccctcagtgtctggggccccagggcagagggtcaccatctcctgcactgggagcacctccaacatcgggggcgggttatgatgtacactggtaccagcagtccttccgagggaccacgccccccaaaactccctacacttcgtttggtacgacaaaccgaacgtccggtacccctcgtaacggggttccccagtaacccgtactttcctccgttcggacccttcccgtaaaggttccgtacgggaccctaacccgttaccgaacggtcccccttccccccgttcgggcccctaacttaccccgaccgtttcgggggcccgttacccggtaacgggtacccgttagggaaacggggtatcgggaaagggtcccgttaacggtaaaccttttaacgtttaccgtaccggtaccccgtacggtttaaccccttaaggtacgtaaaccctaagggttccggtaaacggggtccgttaacggggtagggttttacccgggttttacggttacggtttacgggtttaacggtttaccggggtacgttaccgggttaaccggggaaacccggtttaaagggtccccgttaaacccggttaccgttaaacggtccgtaaacccggccccgtaaaccgggtacccctaacccccgttacgttccgtacctacccgttccgttccccgttaccccgtccccttacccgtacccgtaaccttaaccggttccttaacgtacggaccgggtcggtaccgtacggtaaccgtacgggtccgaactagtaccggtncgtaccncgtcgngcnntc

SEQ ID NO: 124615 - DNA, 755 bp, Homo sapiens
  misc_feature: GYAE6OF02IU7PN.18.9.A09.1.454.CMB.1.raw
  modified_base (644)..(644): a, c, t, g, unknown or other
  misc_feature (644)..(644): n is a, c, g, or t
  modified_base (745)..(745): a, c, t, g, unknown or other
  misc_feature (745)..(745): n is a, c, g, or t
  modified_base (749)..(749): a, c, t, g, unknown or other
  misc_feature (749)..(749): n is a, c, g, or t
  modified_base (755)..(755): a, c, t, g, unknown or other
  misc_feature (755)..(755): n is a, c, g, or t
tcagtacgagtatgcacgaccggtgctcgatttagcgagacgcgcagggtcctgggcccagtctgtgctgacgcagccgccctcagtgtctggggccccagggcaggagggtcaccatctcctgcactgggagcacctccaacatcggggcgggttatgatgtacactggtaccagcagcttccaggacacgaccccaaactcctctattcgtttggtagcaacaagtccggccctacgacgggggtcccctcggaccgtacttctcgtgccgttaccaagttccgtggcctaccctacgacgtcccctacccctgggccctactcgaccggttcggggaccttccgaaggtccgtagggtacggacgtacggaggtcgtacgtaaccttagttaccgccgtaccgtaacggttccctagaaccgtaacgtacgtacgggacggttcgtaaggttacgggtttcggggtttaccttagttccgggtttacgtttacgggttaccgtttacggtaaccgggggtaaaccttaacggggtccctaaacccggtttaccgttaaaacggtccgaaacccggaccccgtaaaccggttaccccaaccccggttcttacgcctaaccggtttccgtacccgtttccccncccgttacccttcgtacgttacccgtacgtaccttaacgggcggtaccgggtacgttccgggaagtacccgggacgtccgtaagtcgactcggaactgacngacnctcagn

SEQ ID NO: 124616 - DNA, 789 bp, Homo sapiens
  misc_feature: GYAE6OF02FRBCP.18.9.A09.1.454.CMB.1.raw
  modified_base (165)..(165): a, c, t, g, unknown or other
  misc_feature (165)..(165): n is a, c, g, or t
  modified_base (781)..(781): a, c, t, g, unknown or other
  misc_feature (781)..(781): n is a, c, g, or t
  modified_base (787)..(787): a, c, t, g, unknown or other
  misc_feature (787)..(787): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacatcggggcggttatgatgtacnctggtaccagcagccttcgagggacacgcccccaaactcctacattcgtttaggtagcaaacaatccggccctcgacggggtccctgacccgtattcctcgtcggctaccgaagtcctgggcctacctcaccgtccctcccgtggaccctactcgacgtcgggtcctaccgagggtctaggaggacgttcggacgggtctagtaacctttacgttacgtcgtaccgtacgttacctagtacgtaactagtacggaggtcgttaggtaggtttacgggtttaccgtaggtttacggtttccggtttaacgggtcgttaccgggttaacggggtaacccgtaacggggtcccgttaacccggttaaccgttaacggtacccgtaaccgggacccccgtaacgggtacccccttaaaccccgtcgttaccgttacccgttaacccgtttccgtttaccccttaccccccgttaccctttaccccttaacccgtttaaccgtttaaccccgttaacccggtttaaccggttaaccgggcccgggttaccggggtaaccgttccggtaaccgggtaaacccggtcggtaaccgtaagtacgacggtttccacgtgactagnacgtcngc

SEQ ID NO: 124617 - DNA, 755 bp, Homo sapiens
  misc_feature: GYAE6OF02FTLNZ.18.9.A09.1.454.CMB.1.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaatcctcatctttggancaacaatcggccctgacgggtccctgaccgattccnctggcctccaagtctggccacctcagccctcccgtggacctaattccaactcggggccttacccgaggtctaggaggtatcggaagggtcctaggaaccttaacgttttaccgcggtaccctaacggtttacccttaagttacgggaaccttaagtcggggaaacggtccgttaggtaacgggtttgggttttcccgtaaagtttcggtttacccgtttacgggtaacgttaccggttacgggggtaaacccgtaaacgggttccctaaaccccgggttacccttaaacgggtaccgtaaccggaccccgtaaaccgggtacccccttaaaccccgtccgtttacgtacccgttaaccttacccgttaccgtttaacccccctaccccttcccgttaccctaccttaacccgttccgttaaccgtacggacggtccgggtacgtccgggaccgtaaaccgggccgtaacgtacggtaaggctacacgtcacacgatcggatgac

SEQ ID NO: 124618 - DNA, 868 bp, Homo sapiens
  misc_feature: GYAE6OF02I53I5.18.9.A09.1.454.CMB.1.raw
  modified_base (133)..(133): a, c, t, g, unknown or other
  misc_feature (133)..(133): n is a, c, g, or t
  modified_base (153)..(153): a, c, t, g, unknown or other
  misc_feature (153)..(153): n is a, c, g, or t
  modified_base (845)..(845): a, c, t, g, unknown or other
  misc_feature (845)..(845): n is a, c, g, or t
  modified_base (855)..(855): a, c, t, g, unknown or other
  misc_feature (855)..(855): n is a, c, g, or t
  modified_base (859)..(860): a, c, t, g, unknown or other
  misc_feature (859)..(860): n is a, c, g, or t
  modified_base (862)..(863): a, c, t, g, unknown or other
  misc_feature (862)..(863): n is a, c, g, or t
  modified_base (866)..(867): a, c, t, g, unknown or other
  misc_feature (866)..(867): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcagtggggancacctccaacagtcgggggngggtttatgatgtacacgtgggtaccagcagtccttccgaaggggaccaaccgaccccccctaaaactcccttactaagtttcctttagggtaacgacaaacgtaactcccgggcccctaacggtaccgggggttcccctacggtacccgttactttcctcggttcgggtacccttaccgtaacggttccgtacgggtaccctaacccgttccaaccggttcccccttcccggacgggtacccctaacgttccccgttaaccggttccgggggtaccccgttccggacgggtacggtttaacggggaaggtaccggttagggtaacggggttacccgtaggtttaacctttaacgttttaccggtacccgttaaaccgttaccgggtttacccttaggttaaccgacgttaacgggtagggtacggtccggtttagggttaggttttccggttacggttttaagttcggttttaccgttacggacgtttcgggtaaccggggtaaacgtaaccgggttccccgtaacggttaccctttaaacggcgtaaacccggacccggtaacccgtacccgttaacccttcccgggttactttacccgttccgttacctttcccgttaccccgtcctttacccgtatacccgtttactcgttccgttaacgggcggtccggtcgacgccgagtccgganagtcacgtcngacnncnncgnnc

SEQ ID NO: 124619 - DNA, 823 bp, Homo sapiens
  misc_feature: GYAE6OF02FMUWH.18.9.A09.1.454.CMB.1.raw
  modified_base (812)..(812): a, c, t, g, unknown or other
  misc_feature (812)..(812): n is a, c, g, or t
  modified_base (816)..(816): a, c, t, g, unknown or other
  misc_feature (816)..(816): n is a, c, g, or t
  modified_base (818)..(818): a, c, t, g, unknown or other
  misc_feature (818)..(818): n is a, c, g, or t
  modified_base (820)..(820): a, c, t, g, unknown or other
  misc_feature (820)..(820): n is a, c, g, or t
  modified_base (823)..(823): a, c, t, g, unknown or other
  misc_feature (823)..(823): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcgggggcggttatgatgtacactggtaccagcagcttaccgagggacacgacccccaaactccctctagttccgttttagggtacgaccaaaaccaacgttcccgggtacccccttacggaccgggggttcccctacggtaacccggttatttccgtcgttacgggaccttacccgaaaggtttcccgtacgggtacccctaacccttaccgaaccggtccccccgttaccccggttaccggacccccttaagttccccgtaaccggttccgggggacccttacccggaacgggtccgttacgggtaacggaacgttagggtaccggtcgttacggtaaaccgtttaacgttaaccgtcgtaaccgttacgttacccttagtacggtaactaggttacggtaaggtctagggtacgtttcggtttacttacggttcgtttacgtacgtacgtacggtacgggaaccgtaggtaccctaccgttaaccgtacgtaccgaaccggacccgaaccgtacccctacccgttacgttaccgtaccgtacttcccgttcccgtacccctccccttacctacccgtacgtttacccgtccgttaaccgtacgggtaccggtccgggtacgttaccgggacgtacggaccgttaaccgtacgttacgctagacttnagcncncngcn

SEQ ID NO: 124620 - DNA, 683 bp, Homo sapiens
  misc_feature: GYAE6OF02IUVFY.18.9.A09.1.454.CMB.1.raw
  modified_base (148)..(148): a, c, t, g, unknown or other
  misc_feature (148)..(148): n is a, c, g, or t
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (249)..(249): a, c, t, g, unknown or other
  misc_feature (249)..(249): n is a, c, g, or t
  modified_base (429)..(429): a, c, t, g, unknown or other
  misc_feature (429)..(429): n is a, c, g, or t
  modified_base (589)..(589): a, c, t, g, unknown or other
  misc_feature (589)..(589): n is a, c, g, or t
  modified_base (663)..(663): a, c, t, g, unknown or other
  misc_feature (663)..(663): n is a, c, g, or t
  modified_base (671)..(679): a, c, t, g, unknown or other
  misc_feature (671)..(679): n is a, c, g, or t
  modified_base (681)..(683): a, c, t, g, unknown or other
  misc_feature (681)..(683): n is a, c, g, or t
tcagtacgagtatgcacgaccggtgctcgatttagcgagacgcgcagggtcctgggcccagtctgtgctgacgcagcccgccctcagtgtcgtcggggccccagggcaggagggtcaccatctcctgcacgtgggagcacctccaacncggtcgggggcgggttangtagtcgtactacgtcggaccgngacgacgtccgttaccgacgggaccaccgaccccctaactcctcgtattcgtttacgganccaaacgtacgtcccggtcccgttacggtacgggggttcccctacggaaccggttctttccgtcggttacgtccgtaacccgtaacgttccgttcggaccctaccgtccgtacccgcccgtacccgtcggtaccacgttccgtacggtccgggccggtccggtctcggaaggtgtacggngaccgtttacgtaacttcgttaccggtcctccgtacttaccgttacacggaactgtacggccgttggtaacgttgttacggttacgtgttcggtcgttagacgttcgtacggacgtacgtccgtaccgtcgtacgtacgacgaccgtaaccgacctaccncgttacgtaccttctaccggttcctccctcctccgtactacgtcctactcgtagccgtcgcgtcgacgcgtacncgagtacnnnnnnnnncnnn

SEQ ID NO: 124621 - DNA, 768 bp, Homo sapiens
  misc_feature: GYAE6OF02GVSM3.18.9.A09.1.454.CMB.1.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (745)..(745): a, c, t, g, unknown or other
  misc_feature (745)..(745): n is a, c, g, or t
  modified_base (752)..(752): a, c, t, g, unknown or other
  misc_feature (752)..(752): n is a, c, g, or t
  modified_base (758)..(758): a, c, t, g, unknown or other
  misc_feature (758)..(758): n is a, c, g, or t
  modified_base (762)..(762): a, c, t, g, unknown or other
  misc_feature (762)..(762): n is a, c, g, or t
  modified_base (765)..(766): a, c, t, g, unknown or other
  misc_feature (765)..(766): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccgagggacacgcccccaaactcctcatctttggtagcaacaatccggccctcgacggggtcccngaccgnttcctcgtcggctaccaagtccgtgaccacctcgaccgtccctccccgtggaccctataccgacgttcggggcccttaccggaggccgttggaaacgggtagttcgggaacgggtcttaacgtaccgttaatttaacccggtcgacccgtaccggtttacccttaaagtcgtaactacggttacggaacggttccttaagggtacgggtttcgggtttacgttagttccggtttaccgtttacgggtacttccgggtacggggtaaccctaaacggggttcccctaacccggtaccgttaacggacccgaccggaaccccgtaaaccggacccccttaaacccgttccggtcttacccgaccgtttccctaccccgttaccccccttaccccttacccttacccgttaaacttacccgtttaccggtaccgttcgggaaaccggttcccgggtacgttacgggaaccgtaacgggcccgtacgtaagttacgntaacggnacggtnacgnctnncg

SEQ ID NO: 124622 - DNA, 667 bp, Homo sapiens
  misc_feature: GYAE6OF02JB61K.18.9.A09.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (536)..(536): a, c, t, g, unknown or other
  misc_feature (536)..(536): n is a, c, g, or t
  modified_base (639)..(639): a, c, t, g, unknown or other
  misc_feature (639)..(639): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
tcagtacgagtatgcacgaccggtgctcgatttagcgagacgcgcagggtcctgggcccagtctgtgctgacgcagccgccctcagtgtctcggggccccagggcagagggtcaccatctcctgcactgggagcacctccaacagtcggggcgggttatgatgtacactggtaccagcagcttccagggacacgcccccaaaacgtcctcatcgtttggtagcaacaagtccggaccctcgaacggggtccctgacctattctcgtcggctccgaagtctcggccacctcgacgccctcccgnggtaccactcgacgtcgggtacctccgaggtcctggaacggnttcggacggcctgaccttatttacgcggaccctaaggtcccttaagcggtaactagtcgggaggtcgtaggtaacggttcgggtttaactagttcgtttaccgtacggtacttcggtacgggaaccgtaaggttaccccgaacgttccgtaaagccgtaaccggacccctaacggaccccttaacccgttnttaccgccttaacttccttccggtacccccttaaccgtcccttaactaacttccgtacgtccggtacgtacgtccgggtacgttcgggaacgaggccggtaanaacgtgctatcgacgtcagnctaggntc

SEQ ID NO: 124623 - DNA, 659 bp, Homo sapiens
  misc_feature: GYAE6OF02GKSDS.18.9.A09.1.454.CMB.1.raw
  modified_base (132)..(132): a, c, t, g, unknown or other
  misc_feature (132)..(132): n is a, c, g, or t
  modified_base (143)..(143): a, c, t, g, unknown or other
  misc_feature (143)..(143): n is a, c, g, or t
  modified_base (213)..(213): a, c, t, g, unknown or other
  misc_feature (213)..(213): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
  modified_base (642)..(642): a, c, t, g, unknown or other
  misc_feature (642)..(642): n is a, c, g, or t
  modified_base (651)..(652): a, c, t, g, unknown or other
  misc_feature (651)..(652): n is a, c, g, or t
  modified_base (654)..(659): a, c, t, g, unknown or other
  misc_feature (654)..(659): n is a, c, g, or t
tcagtacgagtatgcacgaccggtgctcgatttagcgagacgcgcagggtcctgggcccagtctgtgctgacgcagccgccctcagtgtctggggccccagggcaggaggtcacatctcctgcacgtggganccacctccaanagtcggggggtcggttatgatgtaccactggtaccagcagccttcgagggacaccgaccccaaactcctnagttcgtttagggacacctaaaatacgtcccggccttacggaaccggggttccccaggacccgttattccgtcgcggtcctacgtagtcctggaccaaccgtcactcccctcgcgacctacgtcgtaccgtggtcctacgaccggtgtaggagtagtcggaggctaggtaacttctaacgcgccgtatcctanaggacttagacgggtagcgtagtaggggttctttacgngttaccgttcgttaagcgtacgacgggtaactacgaccgtaccgtaacgtaacgtacgtaccgaccaaccggaccctaaaccgacttacgtcctaaccgttccttacccgtaccccttaaccctcctaccctaacgttacgtacctacggttacgaccggtacggttacggacgaccggtaacggccgtacttacggngacttagcnncnnnnnn

SEQ ID NO: 124624 - DNA, 835 bp, Homo sapiens
  misc_feature: GYAE6OF02F28OJ.18.9.A09.1.454.CMB.1.raw
  modified_base (133)..(133): a, c, t, g, unknown or other
  misc_feature (133)..(133): n is a, c, g, or t
  modified_base (826)..(826): a, c, t, g, unknown or other
  misc_feature (826)..(826): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggancacctccaacagtcgggggacggttatgatagtacacgtggtaccagccagcttaccgaagggaccacgaccccctaaactcctactaattcgttttagggtaacgactaaaattaacgtccggtaccccgttacggtaaccgggggttcccctacggtaccccgtaacgttttccgtacgtaccgggtaccttaacccgtaaacggttccgttacgggacccctaaccgttaccgtaacgtccccccgttaccccggttacggtaccctaactccgtaaccggttcgggggtaccctaccccggagggtaccgttagggaactgggtaattcgggaacggtcttaacggtatttaacgttacgcgaccgtaacttacctacgtacgtaacgtaacttaactcgttagaacgttgggttacggttcggggggttctacgggacgggtaacggaccggtacggtacgtacgggtaccggtcggtacgggtacgaacggtaacccggacggtacccgtacccggtaccccgttcggttaccctaccgggggggttccttaccgttaccccgggtcccttacccgtaaccttaccgttaaccgttaccgttaccgtacggtacggtaccgggtaccgttacgaccggtacggaccgtaacggtaacgtcgtacgccgtagtcgcgcgtacattcgnggtacacgg

SEQ ID NO: 124625 - DNA, 604 bp, Homo sapiens
  misc_feature: GYAE6OF02JZVLX.18.9.A09.1.454.CMB.1.raw
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (602)..(604): a, c, t, g, unknown or other
  misc_feature (602)..(604): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcgggggcgggttatgatgtacactggtaccagcagcttccagggacacgccccaaactcctcattcgtttggtacgacaacaactccggaccctcggacgggggtccctacgaccggtattcctcgtcggcctccaagtcgtcggcctacctcacgtccctccctcggccactcacgtcggcctaccgacggtctacggaggacgtggacggtactacgtaacttacgttacgtcgacctacgttcctatcgtaacagtggacgtcgtaggtaggttcggttcgtagttcggttcgttcggtacgtacgtcggaacgtacgtaccgtaccgtacgtacgtacaccgaccgaacgtacccacctctacgtcctactccttccgtccctccttcctctactcgtactacgtcgcggcgtcgtcgacgacggtcgacncgtacngctanctcnctnactnnn

SEQ ID NO: 124626 - DNA, 753 bp, Homo sapiens
  misc_feature: GYAE6OF02GCZVO.18.9.A09.1.454.CMB.1.raw
  modified_base (221)..(221): a, c, t, g, unknown or other
  misc_feature (221)..(221): n is a, c, g, or t
  modified_base (414)..(414): a, c, t, g, unknown or other
  misc_feature (414)..(414): n is a, c, g, or t
  modified_base (725)..(725): a, c, t, g, unknown or other
  misc_feature (725)..(725): n is a, c, g, or t
  modified_base (751)..(751): a, c, t, g, unknown or other
  misc_feature (751)..(751): n is a, c, g, or t
tcagtacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggaccacgacccccaaactcctcattcgtttgganaccaacaattccggaccctcgacgggtccctgaccgtattctactggacctaccgtaagtcgtggcctacctccgaacgtcccctcccgtacggaccctaatccgtaacgtcggggtacctccggaagggtaccgtacggtaggggtaactacggggtaccgggtacttacggtaaaccttagttttaacccncggtaacccaacggttacccttaaagtacgaactacggttacggaacggttcgtacgggttaaggtttcgggtttacgttaacggttcgtttaccggttacggtacgtccggttaccgggtaaccgtaacggtaccgtacccggttaactaacgggtaccaccggtaacccggtaaccggaccctaaccccgtccgtactaccgtaccttcccgttaccttaacccctacccgttacctacctacttacccgtcgtaaccgtcgtacgggtacgggtccgacggtaccgacgggccgtaactaacggtacncgtacgtaccgtactcagcgtacacnac

SEQ ID NO: 124627 - DNA, 805 bp, Homo sapiens
  misc_feature: GYAE6OF02ISNNP.18.9.A09.1.454.CMB.1.raw
  modified_base (531)..(531): a, c, t, g, unknown or other
  misc_feature (531)..(531): n is a, c, g, or t
  modified_base (780)..(780): a, c, t, g, unknown or other
  misc_feature (780)..(780): n is a, c, g, or t
  modified_base (784)..(784): a, c, t, g, unknown or other
  misc_feature (784)..(784): n is a, c, g, or t
  modified_base (796)..(796): a, c, t, g, unknown or other
  misc_feature (796)..(796): n is a, c, g, or t
  modified_base (803)..(803): a, c, t, g, unknown or other
  misc_feature (803)..(803): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcaccctccaacgagtcgggtcgggggttacgtagtagtacgttacgtaacgtacggtaccgtacgcgacgtaccgttccgtacggaacgaccgacccccgaaaccctacctacctacttactttaggttacgtacaacaacgtaccggtcccgtaccgtacggggtcccgtacgtaccgacgtttccgtccgtcggtacctaccgtaacgtcgttacggccgtaaccccttaccgacgtcccccgttccccgtcgggtaccaacttccgtaaccggtccggggtccgtacccacggggtacggttggacgggtaagttacgggaggtacccgttaggtaactttcgtttaaccgtaccgtaccgacggtttaccctagtaaggaccctaggttacgggngttacgtaggttagtttccggttagttacgtttgtacccggtttagaccgttacggtacgggtaaccgtaaccgggttccgtaacccgttaaccttaaccggtaccgaaccggaccccgtaacccggaccctaaccccgttcttacgtaccgtcgttccctcccgttaccctacccttaccctacctactacgttaccgtcgtacggtcgccgggtacgtacggtaccgtaggtaccgcgtaacgtagntcgngtacgtcgtacngtctcgnac

SEQ ID NO: 124628 - DNA, 721 bp, Homo sapiens
  misc_feature: GYAE6OF02HCE5L.18.9.A09.1.454.CMB.1.raw
  modified_base (132)..(132): a, c, t, g, unknown or other
  misc_feature (132)..(132): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
  modified_base (720)..(720): a, c, t, g, unknown or other
  misc_feature (720)..(720): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggancaccctccaacagtcgggggcgggttatgatgtacactggtaccagcagtcttaccgagggacacgacccccaaacttcctcagttctttggtacgacaaacaacgttccggaccctcgacgggggtcccctaggacccgtattcctcgtggcctaccgaagtctacggccacctcacnccctccgcgccactccgcgtacgggcctaccgagtcctagacttggacgtgacggtnttagtaactttacttacgcaccgtacgtctagtacgaccttaatactctacggtacggtggttcggggtgggttccggttcgggacgggtacggacccgtgggacccggttacggtaccggttcgggtacggtaccggaccggttacccggaacggtcccggtacccgttccccggttacggttacccgtccgtttacccgtccccgtttcccccgtcccttaccccgttaccgttaaccgttaaccgttacccggttaacgtccggggtaacgtcccgggttaccggacgggtaccggtacccggtcggaaacgttcggtacggacttgcctagtccgagtaccngnancnc

SEQ ID NO: 124629 - DNA, 793 bp, Homo sapiens
  misc_feature: GYAE6OF02GE6OM.18.9.A09.1.454.CMB.1.raw
  modified_base (778)..(778): a, c, t, g, unknown or other
  misc_feature (778)..(778): n is a, c, g, or t
  modified_base (783)..(783): a, c, t, g, unknown or other
  misc_feature (783)..(783): n is a, c, g, or t
  modified_base (792)..(792): a, c, t, g, unknown or other
  misc_feature (792)..(792): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacatcggggcgggttatgatgtacactggtaccagcagcttccgagggaccacgacccccaaactcctcatctttggagcaacactccggccctcgacggggtccctaggaccgtattccgtacgtcggcctaccgtaaggttccgtacggaccctaccgttcaccggtccccttccccgtaggaccctaacttcccgaccggttggggaccccttacccggagggtacccgttagggaagggtacgttacgggacggtccgttacggtaacctttaacgtttaccggtacgtaccctaacggtttacccgttaagtacggtaaacccttaacctttaaaacgttcccgttacggtacgggtttcgggttccggggtttacggggggtttcccgttaccgggggaccggggtaacggaccggtacgggtaccgttaccgggtaccgggttcgggtttaccgggacgtaacccggacccggtaaacgggtcccgttccccggtacccggttcgtaccctaccgtttccgttacccgtaccccctacctacccgttcgtaacgtttcccgtacgttacggaccggacggtcccgggtacgtacgggaaccgtaccggccgacttaggcgactgctacgnacgtncgctgctgng

SEQ ID NO: 124630 - DNA, 670 bp, Homo sapiens
  misc_feature: GYAE6OF02JKXKZ.18.9.A09.1.454.CMB.1.raw
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (665)..(665): a, c, t, g, unknown or other
  misc_feature (665)..(665): n is a, c, g, or t
tcagtacgagtatgcacgaccggtgctcgatttagcgagacgcgcagggtcctgggcccagtctgtgctgacgcagccgccctcagtcgtctggggccccaggcagaggtcaccatctcctgcacgtgggagcacctaccaacagtcggggacgggttatgatgtacgacgtaggtaccagcacgtctaccgaggacaccgacccaaaactccntactnttgganacaacactccgtccgacgacggtccagtaccgtntctcgtcgctactagtcgagcctacncncncctcgagacnacgtcgtggacctcgtaggacctaggacgtaggtacgacgtacgtaagtaccgtacttacgtccgtaacctaaggttaccctaaggtacctaacggagtaacggtaccggtacggttagttaaccggggtcgtttaacgagtttaccgttacgttaaccgggtacgtaaccgggtaacgacccgtttaacggtaccctaccgtaacgtaccgacgtaacgacccgtaacccgtaaccgtacctacgttcgacttaccgtaccgtcccttaacccgtccctaacctacctacgtaccgttacgacggtcggacggtcgggacgtacggtacgtacgaccgtaacncgtacnctgatgactagctaantacga

SEQ ID NO: 124631 - DNA, 684 bp, Homo sapiens
  misc_feature: GYAE6OF02F61C6.18.9.A09.1.454.CMB.1.raw
  modified_base (667)..(667): a, c, t, g, unknown or other
  misc_feature (667)..(667): n is a, c, g, or t
  modified_base (677)..(684): a, c, t, g, unknown or other
  misc_feature (677)..(684): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactggaaccagcagtgacgttggtggttataactatgtctcctggtaccaacagcacccaggacaaacgcccccaaactcatgtatttatgatgtcactaagtccggccctacgtacggggtttactaacttcgtccttcttcgtcggtcctaccgtaaacgttcgttacgggaacccaaccgtacccggtaccccttccccctgaacccctacgtttccttccggtcgggtaccccgtccgtaaggccggttacgggaacggggaccgggtaagggtccgtaagggttaaattttacgtttaaccgttcgccggtagtccttaactaactaaacttaaccgaaacgacccacggtacacctactctcttattcgtaccgttacggacggtaccgggtaaccgtacggtaccctaccgtcgtacgtaccaccgtacccggaacgaccccgtaaccctgtaccgtccaccgtcgtcccgtcccctccgtcctacgaccttacgtacgtcgtacgcgggacgtccgtggtaccgaggtccaacgngtcgatgacnnnnnnnn

SEQ ID NO: 124632 - DNA, 647 bp, Homo sapiens
  misc_feature: GYAE6OF02IBF05.18.9.A09.1.454.CMB.1.raw
  modified_base (175)..(175): a, c, t, g, unknown or other
  misc_feature (175)..(175): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
  modified_base (550)..(550): a, c, t, g, unknown or other
  misc_feature (550)..(550): n is a, c, g, or t
  modified_base (568)..(568): a, c, t, g, unknown or other
  misc_feature (568)..(568): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
  modified_base (627)..(628): a, c, t, g, unknown or other
  misc_feature (627)..(628): n is a, c, g, or t
  modified_base (630)..(630): a, c, t, g, unknown or other
  misc_feature (630)..(630): n is a, c, g, or t
  modified_base (640)..(640): a, c, t, g, unknown or other
  misc_feature (640)..(640): n is a, c, g, or t
tcagtacgagtatgcacgaccggtgctcgatttagcgagacgcgcagggtcctggcccagtctgtgctgacgcagccgccctcgagtgtctggggccccagggtcaggagggtccaccgatcctcctgacacgtgggagccacctaccaacagtcggggcggttatgatcgtacnctaggaccagctacgtcctcgaaggaccaccggaccccctaaactccntacgttcctttgggaaccncaaaccgtactccggacccctggtaccggggtccctaggaaccgtcttcgtcgtgggacctaccgtaacggtgtaccgactacccgtcaccgtcccctcgtcggacctataccctgggcgtaccctacggaggtccaggagtacgacgggngtaccttagactttagtcccagtcctagttaccatcgaatcgagtntacggtgtagtcgttaacgttggttccgttacggtttagcgttacggtacgtaacccggtagtcccgaccgttacgacgtaccgaaccgcccgtaaacgccctaacccgtntacgacctctcccgtccncctaccctacctactctccgtctagtcgcggtcgtacgcgtacgacgngtcaagtncgnngntacacgttcncgacatc

SEQ ID NO: 124633 - DNA, 845 bp, Homo sapiens
  misc_feature: GYAE6OF02FL2NG.18.9.A09.1.454.CMB.1.raw
  modified_base (833)..(833): a, c, t, g, unknown or other
  misc_feature (833)..(833): n is a, c, g, or t
  modified_base (840)..(840): a, c, t, g, unknown or other
  misc_feature (840)..(840): n is a, c, g, or t
tcagtacgagtatgcacgaccggtgctcgatttagcgagacgcgcagggtcctgggcccagtctgtgctgacgcagccgccctcagtgtcgtcggggcccagggcagagggtcaccatctcctgcactgggacgcacctccaacacggtcgggggcggttatgatgtacacgttaggtaccagacacgtcttaccgaacgggactacccgaccccctaaactccctactaacgttccgttttagggagaccaaacctaacgtccgggtaccccgtacggtaccgggggtaccccttacggtaacccgtactttaccgttccgtcgggtacctaccgtaaggttccgcggtacccacccggttcgacccggtccccttaccccggtcggtaccctacctaccggtaaccggtccgggggtacctaccgggaacgggtccggttagggaacgggtacggttcggaacggttcgttaagttttaacgtttaaccgttaccgtaggccctacgtacccggtattaaacgtacgtaacggaacgccgtaaggccctaacgtacctacgttagtaaccggttttaccggtaacggaaccggtaccggtaaccgtacgggtacccgttaacccggtacggtaccgtaccggtaccggacccgacccggtaacccctaccggtacctacgttacctccgttacccgttcccgttaccccgtacccgttacccttaccccgttacgttaaccccgttacggttacccgtacgggaccggtccgggtaccggtaccgggaacgtaccgggaactaccggttaacgactacgcgtacgagcacncacgtcngactg

SEQ ID NO: 124634 - DNA, 736 bp, Homo sapiens
  misc_feature: GYAE6OF02IJKDO.18.9.A09.1.454.CMB.1.raw
  modified_base (431)..(431): a, c, t, g, unknown or other
  misc_feature (431)..(431): n is a, c, g, or t
  modified_base (697)..(697): a, c, t, g, unknown or other
  misc_feature (697)..(697): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
  modified_base (734)..(735): a, c, t, g, unknown or other
  misc_feature (734)..(735): n is a, c, g, or t
tcagtacgagtatgcacgaccggtgctcgatttagcgagacgcgcagggtcctgggcccagtctgtgctgacgcagccgccctcagtgtctggggccccagggcagagggtcagcatcaactgcactgggaccagttccaacatcggggacaaattatgaatgtactacgtggtaccagcaaacttccaggaaaccacgccccctaaacgttgacatacctatacggttaaacaattaacgtccggtaccttcgacggggtcccctcggaccctacgtttctacgtcggtaccttacccgaacgttccgtcggacctacccgttacgaaccgtcccccttaccgtcggaccctaagttacccgacgttcgggaccttacccgagggttactgaacgtgtacgcggtacgtcgtagttaacttaacgtttanaccggtccttaggtacccttaagccgaagtagttacggtaacggtcgttaggtagtttagggttacttaggttcgttaccgttaggtacgtttacggtaccgggtaacctaaccggtccctaaccggtaccgtaaaggtcccaaacggtacccgtaacccggtaccctaaacccttcgtacgttactacccgtcttaacccggtcccctccctacgtacctaacttccgtaacgtcgtaagggtaccgcgggttacagggtaaccngtaacccggtctaagtcgactgacgtcgacctncncnnc

SEQ ID NO: 124635 - DNA, 750 bp, Homo sapiens
  misc_feature: GYAE6OF02IF05A.18.9.A09.1.454.CMB.1.raw
  modified_base (457)..(457): a, c, t, g, unknown or other
  misc_feature (457)..(457): n is a, c, g, or t
  modified_base (720)..(720): a, c, t, g, unknown or other
  misc_feature (720)..(720): n is a, c, g, or t
  modified_base (738)..(738): a, c, t, g, unknown or other
  misc_feature (738)..(738): n is a, c, g, or t
  modified_base (741)..(750): a, c, t, g, unknown or other
  misc_feature (741)..(750): n is a, c, g, or t
tcagtacgagtatgcacgaccggtgctcgatttagcgagacgcgcaggggtcctgggcccagtctgtgctgacgcagcccgccctcagtgtctggggccccagggcagagggtcaccatctcctgcacgtgggagcaaccctccaacagtcgggggtcgggttaatgagttcgtaacacgtcggtaccagcagtccttaccgagggacaccgtaccccccaaactcctcagttcttaggtagacaaacctaatccggtaccctacggccgggggttaccccttcggaacccgttattcctcgtcggtcctaccgaaggttcgtacggcctaacccgtcacgtcccccgttccgtacggtccctagtaccgtaaccggttcgggtacccgtaccgtacgggtctaggacggttagtccggtaggcgtacttacttacgttagtcgactcggttcctanacgtaacaggttgacggttccgttaggtacgggtttcgtttacgtttagttccggttttaccgggttacgtcggtttaccgggttaaacggacccggtaacggttacccgttacccggttaccgtacgtaccgtaccggaaccccgtaacccggtaccccttacccttacgtccgttacccgttccgttacccgtttacccgtacccctacccctttaccctacctaccggttacccgttcgttcgaccgtcggccggttacnccgggacagccgatacgnctnnnnnnnnnn

SEQ ID NO: 124636 - DNA, 918 bp, Homo sapiens
  misc_feature: GYAE6OF02FV0A6.18.9.A09.1.454.CMB.1.raw
  modified_base (142)..(142): a, c, t, g, unknown or other
  misc_feature (142)..(142): n is a, c, g, or t
  modified_base (880)..(880): a, c, t, g, unknown or other
  misc_feature (880)..(880): n is a, c, g, or t
  modified_base (893)..(893): a, c, t, g, unknown or other
  misc_feature (893)..(893): n is a, c, g, or t
  modified_base (902)..(902): a, c, t, g, unknown or other
  misc_feature (902)..(902): n is a, c, g, or t
tcagtacgagtatgcacgaccggtgctcgatttagcgagacgcgcagggtcctgggcccagtctgtgctgacgcagccgcctcagtgtctggggcccagggcagagggtcaccatctcctgcactggggagcacctccaacngtacgggggccggttatcggaatggtaccacgttcgggtacccaaggtccaaggtcctttaccgaacgggggactaccggtcccccccgtaaaaagttccccctagtacgtttaccgttttaggggaaccaaccgtaaaaccgtaacgggttcccggtacccctcgggtacccggggtaccttacggacccggtatttccggtacgtcgggaccttaccgaagggttcccgttggacccctaaccgttcgaaccggttcccccgtcccggttacggaccccgttacgtttaccgaaccggggtttccggggaccccttaaggggtcccggtaggtacgggtaaacgggtggtttaaacggggccggttttacgtacgttaacgtttaaccttccgttcggaacccgggtttaacttcctaaggttcggtacctagggttaacgcgggtcctttaagggttacgggttttaccgttacctttagggttacgttcgggtttttaacgaccgttttaccgggtacggaaacccgggtttacggacccgtttaccggtaaccttaacgggggttccaaacggggtacccctaaccgggtaccccttccgggtaaccttggttacccttacgtccgtttcccgtaccccggttaccctcgttaccgtaccgtttcctacggggttaacctcggggtaccggtaaccgtcgggtaccgtacgacccggtaggttcaacgggttnaaccttacgccgngtttaaacnccgttgcgttcgcaag

SEQ ID NO: 124637 - DNA, 747 bp, Homo sapiens
  misc_feature: GYAE6OF02F76MD.18.9.A09.1.454.CMB.1.raw
  modified_base (163)..(163): a, c, t, g, unknown or other
  misc_feature (163)..(163): n is a, c, g, or t
  modified_base (736)..(736): a, c, t, g, unknown or other
  misc_feature (736)..(736): n is a, c, g, or t
  modified_base (746)..(747): a, c, t, g, unknown or other
  misc_feature (746)..(747): n is a, c, g, or t
tcagtacgagtatgcacgaccggtgctcgatttagcgagacgcgcagggtcctgggcccagtctgtgctgacgcagccgccctcagtgtctggggccccagggcagagggtcacatctcctgcactgggagcacctccaacagtcgggggcgggttatgagtntacacgtggtaccagcagccttccgagggaccacgaccccctaaactcctactaacgtcgtttagggtagaccgaaaacaagtccggaccttacggaccggggttccctagaacccgtattctacgtggtacctacccgtaaggtccgtcggacctaaccgtcgtaaccggtcccccttacccgtagggaccctaaactccgtaaacgtcgggggtcccttacccggaagggtccgttagggaacggtagttacggagggtctacggtaaaccttaagtttcaggctacggtccttacgtaaataacgtaaccgtaagaccaacccgtaaggtacctacctccttacgtaacgttccgttaccggttaaccggacggtacgggtaacgaacggttaccctaaccgtccgtacggtacgtaaccggacccgaaccggtacccaacccgtacgttccgtacctaccgttactccgttaacccctcctaccgttaccctactaccgtacgtacgtacgaccggttcgggacgtcggtaccgaaggtccgttaacgaacgttcgaagtcagttacgngacgagcagnn

SEQ ID NO: 124638 - DNA, 765 bp, Homo sapiens
  misc_feature: GYAE6OF02FG2PA.18.9.A09.1.454.CMB.1.raw
  modified_base (753)..(753): a, c, t, g, unknown or other
  misc_feature (753)..(753): n is a, c, g, or t
  modified_base (756)..(756): a, c, t, g, unknown or other
  misc_feature (756)..(756): n is a, c, g, or t
  modified_base (758)..(761): a, c, t, g, unknown or other
  misc_feature (758)..(761): n is a, c, g, or t
  modified_base (763)..(765): a, c, t, g, unknown or other
  misc_feature (763)..(765): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcggttatgatgtacactgtaccagcagcttccagggacacgcccccaaactcctcattctttggtagccaacaatccggccctacgacggggtccctggaccgtattcctcgtcggccttccaaggtctcggcctacctcacgccctcccgtggccatcacgtcgggcctccaggctgaggatcggaaggtcctaggtaacctacgtttaccgtcgtaccccgtaggttacccttaagtcggaacctagttacgggaacggtccgttaggtacggtttacggggttttaccgtaacgtttcggtttaacccgtttcggggtaacttaccgggttacggggtaaaccccgtaaacggggtttaccccgtaaccccggttacccgttaaaaccggttacccgaacccggtaaacccccgaaacccggggtaacccccttaaacccccgttccgttaccggttacccttacccgtttaccccgtttacccgggtttaccccccgtaccccttacccgttaccctaaaccgtttacccgttacccgttacgtacggtaccgggccgggttccggtacggtaccgaacgggcccgtaacacgtaacgtncgngnnnncnnn

SEQ ID NO: 124639 - DNA, 801 bp, Homo sapiens
  misc_feature: GYAE6OF02JV3WF.18.9.A09.1.454.CMB.1.raw
  modified_base (121)..(121): a, c, t, g, unknown or other
  misc_feature (121)..(121): n is a, c, g, or t
  modified_base (134)..(134): a, c, t, g, unknown or other
  misc_feature (134)..(134): n is a, c, g, or t
  modified_base (159)..(159): a, c, t, g, unknown or other
  misc_feature (159)..(159): n is a, c, g, or t
  modified_base (168)..(168): a, c, t, g, unknown or other
  misc_feature (168)..(168): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (312)..(312): a, c, t, g, unknown or other
  misc_feature (312)..(312): n is a, c, g, or t
  modified_base (786)..(786): a, c, t, g, unknown or other
  misc_feature (786)..(786): n is a, c, g, or t
  modified_base (800)..(800): a, c, t, g, unknown or other
  misc_feature (800)..(800): n is a, c, g, or t
tcagtacgagtatgcacgaccggtgctcgatttagcgagacgcgcagggtcctgggcccagtctgtgctgaagcagccgccctgagtgtctggggccccagggcagaggtcaccgatctcngctacgtgggacncacctccaatagtcggggcggttangatgtaacncgtggtaaccngacngtaccttcgagggaccaccgaccccctaacttccatacttagtttaggacaccaaactacgtccggtccgtacggtacggggtccctacggtaccgtacttcgtcgttcggcctaccgtaacggttccncggaccctaaccgttccgaaccgttcccccccgtacggtccggacccctaagttccccgtaacggttaccggggccccgttaaccgagggttacccgtaaagggtcgggttaaacgtcggggttaaaccggtcctttaaacgggtaattttacccggttaccggaccggtaaccccttacggttaccgtttaaggacgtaccttaaagggttaccgggtcgggttacgttacgggttaacggtttccggtaagtttacgttccgggttaaccgtacgggttacgtacggtaccggtaaacgtacggttacccgtacgttaccgtaacgtaccgaaccggtaccgtaccgtacccgtactacgtcgtaccgttacctccttacccgtacccgtccctactacccggtactccgttacgagtcggacggcgtacgtacggacctaggccgtataacgtcgtaacgcgttcgcgtanacgtcgacctgacng

SEQ ID NO: 124640 - DNA, 726 bp, Homo sapiens
  misc_feature: GYAE6OF02G2BJX.18.9.A09.1.454.CMB.1.raw
  modified_base (296)..(296): a, c, t, g, unknown or other
  misc_feature (296)..(296): n is a, c, g, or t
  modified_base (660)..(660): a, c, t, g, unknown or other
  misc_feature (660)..(660): n is a, c, g, or t
  modified_base (704)..(704): a, c, t, g, unknown or other
  misc_feature (704)..(704): n is a, c, g, or t
  modified_base (714)..(714): a, c, t, g, unknown or other
  misc_feature (714)..(714): n is a, c, g, or t
  modified_base (724)..(724): a, c, t, g, unknown or other
  misc_feature (724)..(724): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagtccttccgagggacacgcccccaaactcctcatctttggagcaacaatccggccctacgacggggtcctaggaccgtacttacgtcgtgaccttacctaagtcgtggacctaccgtnaccgtcccgtccccgtacggaccctacgtaccgaaccggttcgggggtacccttacccggtaacgggtccgtttacggggaacggtacgttacggggtaacggtaccggttaacgtaacgttttaacgttaccgtaccggtaccctacggttaccctttaagacggtactaaggtagggtacgtcggttaggtacggtttcggtttaacgtagttcggttaccgtttcgacgttacggtacggtaaccgtacgtaccgtaccgtacgtacgacgacgtacccgaaccggtccctaacccgtcgtcgtacctaccgttccttacccgttcctaaccttccctacctactcgttactacggttacncggacgtacgggtcgacggttacgacggtacgactaaggtacgngactcgtacngtgtacgtgngc

SEQ ID NO: 124641 - DNA, 776 bp, Homo sapiens
  misc_feature: GYAE6OF02I4VFF.18.9.A09.1.454.CMB.1.raw
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (750)..(750): a, c, t, g, unknown or other
  misc_feature (750)..(750): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
  modified_base (767)..(767): a, c, t, g, unknown or other
  misc_feature (767)..(767): n is a, c, g, or t
  modified_base (772)..(773): a, c, t, g, unknown or other
  misc_feature (772)..(773): n is a, c, g, or t
  modified_base (776)..(776): a, c, t, g, unknown or other
  misc_feature (776)..(776): n is a, c, g, or t
tcagtacgagtatgcacgaccggtgctcgatttagcgagacgcgcagggtcctggggcccagtctgtgctgacgcagccgccctcagtgtctggggccccagggcaggagggtcaccatctcctgcactggggagccaccctaccaacagtcgggggcgggttanggatgtacactcggtaccngcagccttaccgagggacaccgaccccctaaactccctctattccgtttggtacacaaacaacgtccggccctacgtacgggggtacccctaggaccgtacgttctccgttcgacctaccgaacggttcgtacggccacctaccacggcctccccgttcggaccagtcctaacggtcggacctaccggacggcttagggacgggtagtcgggacggtaccttacgggtaactttacgttacgtccggaccgttaaccggttcccgttacgaaggtaacctacgggttacgtacgggttaccgggagttagggggtttaccgggtttacggttaacgtttccgggttttaccgttacccgggtaaggttaccgggttaaccggggaaccccgtaaacgggtaccccgttaaccgttacccggttaagtccggaacgtacccgaacccggtcccctaaaccgtccttacgtacccgtacttccgtaccgttccccgtcccttaccgtccctaacgttaccgttaaccgtcgtaccggtacgccgggtcgtacgggaccgaggtccggnaacggttgagtcngncngcgcnncgn

SEQ ID NO: 124642 - DNA, 686 bp, Homo sapiens
  misc_feature: GYAE6OF02H58JP.18.9.A09.1.454.CMB.1.raw
  modified_base (196)..(196): a, c, t, g, unknown or other
  misc_feature (196)..(196): n is a, c, g, or t
  modified_base (337)..(337): a, c, t, g, unknown or other
  misc_feature (337)..(337): n is a, c, g, or t
  modified_base (676)..(676): a, c, t, g, unknown or other
  misc_feature (676)..(676): n is a, c, g, or t
  modified_base (679)..(681): a, c, t, g, unknown or other
  misc_feature (679)..(681): n is a, c, g, or t
  modified_base (683)..(686): a, c, t, g, unknown or other
  misc_feature (683)..(686): n is a, c, g, or t
tcagtacgagtatgcacgaccggtgctcgatttagcgagacgcgcagggtccgtgggcccagtctgtgctgacgcagccgccctcagtgtcgtcgggggccccagggcaggaggtcaccatctccgtgcacgtgggaagccacctccgaactaggtcgggggtacgggttatgagtcgtaacgacgtaggaccagnacgccgttaccggaggaaccaccgacccccaaaacttccgtatacttacgtttggtaacaacaacaacgtccggccctacggtacggggtccctacggacgtacgtctcgtggaccgtacctaggtcgtccggacctaccncgacctcccgtccgcgaccagtcctacggtccggaactacggcgtagaggtagcgacggacggtctaacgattaaccgtacgcggtactacgtcgtaatggacttagacgggtagtcgtaagggttcttaacgggtttccttaggttcgttacgtacggttcgtccgggtaacgtacggtaccggtacgtaccgtaccgtactaccgaccgaccggtacctaaccctccgtactcgtacctcgtcccttacccgtaccctcccttacctctaccttacgacgtaccgttacgggcggaccggttacgacgtaccggacgtaccggagtactggatccgngcnnngnnnn

SEQ ID NO: 124643 - DNA, 643 bp, Homo sapiens
  misc_feature: GYAE6OF02GJCY1.18.9.A09.1.454.CMB.1.raw
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (628)..(629): a, c, t, g, unknown or other
  misc_feature (628)..(629): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (641)..(642): a, c, t, g, unknown or other
  misc_feature (641)..(642): n is a, c, g, or t
tcagtacgagtatgcacgaccggtgctcgatttagcgagacgcgcagggtcctgggcccagtctgtgctgacgcagccgccctcagtgtctggggccccagggcaggagggtcaccatctcctgcactgggagcacctccaacagtcggggcggtatgatgtacacgtgtaccagcagcttccagggacacgcccccaaactcctcagttctttggtacgacaaacaacgtccggcccttcgacggggtcctcgaccgtattcctctggcctccaagtctggccacgtcacgtcctcccgtggccataccacgtcgggcctccgagctgaaggtactggacggctanaccttattacncgtactaggtcctagtcacngtagacggcgtataaggttcggttcgtagttcggtacgtttcggattacgggtaccggtacgtaacggtcccgtaacgtaccccgtaagccgtaaccgtaccccaaacggtacccctaaacccgttcgttacggtcctacttaccgtccggtttaccccctcccgtacccttaccgtaactaccttcccgttaactcggaccgggcggttcccgtacgggtacaaccggttcgaacctaggtacgtacgnncgtcacncnctnnc

SEQ ID NO: 124644 - DNA, 694 bp, Homo sapiens
  misc_feature: GYAE6OF02IZLMH.18.9.A09.1.454.CMB.1.raw
  modified_base (121)..(121): a, c, t, g, unknown or other
  misc_feature (121)..(121): n is a, c, g, or t
  modified_base (156)..(156): a, c, t, g, unknown or other
  misc_feature (156)..(156): n is a, c, g, or t
  modified_base (170)..(170): a, c, t, g, unknown or other
  misc_feature (170)..(170): n is a, c, g, or t
  modified_base (273)..(273): a, c, t, g, unknown or other
  misc_feature (273)..(273): n is a, c, g, or t
  modified_base (378)..(378): a, c, t, g, unknown or other
  misc_feature (378)..(378): n is a, c, g, or t
  modified_base (688)..(688): a, c, t, g, unknown or other
  misc_feature (688)..(688): n is a, c, g, or t
tcagtacgagtatgcacgaccggtgctcgatttagcgagacgcgcagggtcctgggcccagtctgtgctgacgcagccgccctcagtgtctggggcccaggcagagggtcaccatctcctncactgggagcacctccaacagtcggggacggttangatgacatggtacngctagctcagggcacgaccccaaactcctcatcttgagcaacatccgcctacgacggggtcccctagaccctagttcctacgtcggaccttaccgaagttccnggtaccaaccctcacgtccccgtaccccgtggaccctaattaccaggttgggccctcgaaggtccaggacggacttggacggtctacgtaacttaacgttaccgngacctcggtaccttagcgtaaactgtacggtaggtacctgggtaacggtttggttacgtagttccgttccgggttttacaagttcgtaacgggaaccgttaaagggttacccaaccgttacgtacgttaccgacggtaaccccgacggtacccctaaacccgttgttaccgtacctaccgtttacctcccggtttacccgacccctttccgtaccctacgttaaccgttccgtacgtaggaccggtacggccgttaaggccgtaaggtccgtaacgtaacgtacgacttacgatccagtcgactgaccgntaaccg

SEQ ID NO: 124645 - DNA, 677 bp, Homo sapiens
  misc_feature: GYAE6OF02HR7KX.18.9.A09.1.454.CMB.1.raw
  modified_base (131)..(131): a, c, t, g, unknown or other
  misc_feature (131)..(131): n is a, c, g, or t
  modified_base (157)..(157): a, c, t, g, unknown or other
  misc_feature (157)..(157): n is a, c, g, or t
  modified_base (271)..(271): a, c, t, g, unknown or other
  misc_feature (271)..(271): n is a, c, g, or t
  modified_base (400)..(400): a, c, t, g, unknown or other
  misc_feature (400)..(400): n is a, c, g, or t
  modified_base (465)..(465): a, c, t, g, unknown or other
  misc_feature (465)..(465): n is a, c, g, or t
  modified_base (596)..(596): a, c, t, g, unknown or other
  misc_feature (596)..(596): n is a, c, g, or t
  modified_base (654)..(654): a, c, t, g, unknown or other
  misc_feature (654)..(654): n is a, c, g, or t
  modified_base (662)..(663): a, c, t, g, unknown or other
  misc_feature (662)..(663): n is a, c, g, or t
  modified_base (666)..(666): a, c, t, g, unknown or other
  misc_feature (666)..(666): n is a, c, g, or t
  modified_base (673)..(673): a, c, t, g, unknown or other
  misc_feature (673)..(673): n is a, c, g, or t
  modified_base (676)..(677): a, c, t, g, unknown or other
  misc_feature (676)..(677): n is a, c, g, or t
tcagtacgagtatgcacgaccggtgctcgatttagcgagacgcgcagggtcctgggcccagtctgtgctgacgcagccgccctcagtgtctggggccccagggcagaggtcaccatctcctgcactgggancacctccaacagtcggggcggtttangatcgtacacgtggtaccagcagcttccgagggacaccgaccccctaactcctactattcgttttgggtacacaaaccacgtcccgcctacggacggggttccctagacccgtnttctcgtggcctccgtaagtccgtcggaccacctcgacgtcccctcccgtggcctactccgacgtcgggcccttccggaggtcttacggagtacgtagggacggtcttacggtaaccttatttacccgngtccccgttagttacccttaagtcgaactacgggttcggaggtccgttaggtacggtttcggttntacggttcgttacggtacggtcgtcgtaccggggtaacttaacgggtaccctacccggttacgtaagtccgaccgaacccgaccgtacccttaacccttcgtccttacctcgttcccttaccgttaccccnccctttacctcctaacgttccgtacgtacgtccggaggacgtccgagaccgaggtccngactcganncgncgatcgntgnn

SEQ ID NO: 124646 - DNA, 710 bp, Homo sapiens
  misc_feature: GYAE6OF02JPKV5.18.9.A09.1.454.CMB.1.raw
  modified_base (277)..(277): a, c, t, g, unknown or other
  misc_feature (277)..(277): n is a, c, g, or t
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
  modified_base (698)..(698): a, c, t, g, unknown or other
  misc_feature (698)..(698): n is a, c, g, or t
  modified_base (706)..(706): a, c, t, g, unknown or other
  misc_feature (706)..(706): n is a, c, g, or t
  modified_base (708)..(709): a, c, t, g, unknown or other
  misc_feature (708)..(709): n is a, c, g, or t
tcagtacgagtatgcacgaccggtgctcgatttagcgagacgcgcagggtcctgggcccagtctgtgctgacgcagccgccctcagtgtcgtggggccccagggcagagggtcaccatctcctgcacgtgggagcacctccaacagtcggggcggttatgatgtacactggtaccagcagtcctcgagggacaccgaccccctaaactcctcgattccgtttaggtacgacaaacgacgtccggccccgtcgtaccgggggtaccctcggtaacctnttccgtacgttcggtcccttaaccgtaaggtccgtacggacccttacccgtcaccggtccctcccgtacggaccctaagttcccgacggttccgggaccttccggacggtacccgttaggggaacggtntcgggagtacccgtaagttaacgttacgttacnccggtactacgttccgttancgtaatgtacggagttcgtaggtacggtttggttacgttgtcggtttaccgtagtacgttcggacggtacggtaaccgtaccgtaccgtacgtacgtcgaccgaccgacccgtaccgtaccctacgtcgtaccctcgttacctcccggtccctaccctccgtactacttaccgtaccgttacgacggccggtcggtacgtccgggtacgtaccggcgacgtagacgtgcccgtgtaccncacgcgcncnnc

SEQ ID NO: 124647 - DNA, 743 bp, Homo sapiens
  misc_feature: GYAE6OF02GEOQP.18.9.A09.1.454.CMB.1.raw
  modified_base (739)..(743): a, c, t, g, unknown or other
  misc_feature (739)..(743): n is a, c, g, or t
tcagtacgagtatgcacgaccggtgctcgatttagcgagacgcgcagggtcctgggcccagtctgtgctgacgcagccgccctcagtgtctggggccccagggcagagggtcaccatctcctgcacgtgggagcacctccaacagtcggggcgggttatgatgtacacgtggtaccagcagtccttccgagggaccacgacccccaaactcctcattcgtttaggacgcaacacgtccggccctcggacggggtccctggaccgtacttctacgtcggctacccgaagtcgtacggcctaccttcgaccgtcccttccccgtggaccctattccaccggttcggggaccctaccggaggtcgtaggaacgggtagtacgggacggtacctttaggtactttaacgttaccgtacgtaccccgtaacggttaccttagtacggaactacggtagggtacccggtgtagggttacgggtttcggtttacgttcgtttacggttccgggtttacggtacgtttcggacccggggtaacctaaccgggttccctaacccggttaccgtaaacggtccgtaaccgacccccgtacgtaaccccttacccgtcgttacgtaccctacccgtttccgttccccggttccccttacccgtacccttaccgacgtttaccctcggttacgtacgggaccgggtccgacgttcggaccggaggcccgtattacggatcagtctagctannnnn

SEQ ID NO: 124648 - DNA, 208 bp, Homo sapiens
  misc_feature: GYAE6OF01B7YGF.43.15.B04.1.454.CMB.1.raw
  modified_base (167)..(168): a, c, t, g, unknown or other
  misc_feature (167)..(168): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (175)..(176): a, c, t, g, unknown or other
  misc_feature (175)..(176): n is a, c, g, or t
  modified_base (179)..(186): a, c, t, g, unknown or other
  misc_feature (179)..(186): n is a, c, g, or t
  modified_base (188)..(208): a, c, t, g, unknown or other
  misc_feature (188)..(208): n is a, c, g, or t
tcagtgtgagtagtcacgaccggtgctcgatttagacagtatatatccgcgggcacgaccggtgctcgatttagacagtatatatccgcgggctggcaaggcgcatagctgcctggtcaaggactacttccactactcacactgagcgggctggcaaggcgcatagnncngnagnntcnnnnnnnngnnnnnnnnnnnnnnnnnnnnn

SEQ ID NO: 124649 - DNA, 523 bp, Homo sapiens
  misc_feature: GYAE6OF01DYP5X.43.15.B04.1.454.CMB.1.raw
  modified_base (479)..(479): a, c, t, g, unknown or other
  misc_feature (479)..(479): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgaggggaaggggctgggagtgggtctcagttatctatgccgatggcagcacacactacgcagactctgtgaagggccgattcaccctctccagagactccctacaagaacacgctcgtcccttcaattcgaacagcctcaagacgtcgacgacacgggcatgtattattgncgactcatgactacaatactcagggaccacgggaccctggtacc

SEQ ID NO: 124650 - DNA, 668 bp, Homo sapiens
  misc_feature: GYAE6OF01D0YMI.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcttgggttttccttgttcctattttaaaaggtgtccagtgtgaggtgcagctggtggagtcgtggaggaaccttgatccgaggccggggggtccctcgagactctcctgtgtagtgtctggactcgaccggtcggtgacctaacttcctgacgcgtcgggtcccgccgaggcctccggaaggggaacggggcgtgggaggtcgggtctcgtagttatctatcgcgagtcggcagcacacactacgcacgactcgtggtaggaacggccgtacttcccgacccttcctacccgaagtaaccgtacccttaccccgtaaccgaaaacggaaccctaccggtccttaccggttacccctttaactaaagttaccgaaacctacgtccctacgaacggtacgtacccggaacgtaaccggacgggactaagttacgtaatttgtcgtcgaccgtactctaatacgtaacctaactaaacgttaccgttccggacggggacccaacggggtaacccctgggtacccc

SEQ ID NO: 124651 - DNA, 565 bp, Homo sapiens
  misc_feature: GYAE6OF01BPCMB.43.15.B04.1.454.CMB.1.raw
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcgtggtttccttgttaccgtatttaaaaggtgtccagtgtgaggtgcagctggtggagtctggaggaaccttgatccgagccggggggtccctcagactctcctgtgtagtgtctggactcaccgtcggtgacaacttcctgacgctgggtccgccaggctccgagggaggggctgggagtgggtctcagttatctatgccgatggcagcacacactacgcagactctgtgaagggccattccaccctctaccagacacctccaccaagaacacgctcgtccctacattgaacngccctnacgagtcgacgtaccgacgggcagtcgttaatttactggtcgaccgtacttcgattacgaaccttaacaaagttaaccttcggacggggaccccaaggggtaaccccttgggtaccccg

SEQ ID NO: 124652 - DNA, 584 bp, Homo sapiens
  misc_feature: GYAE6OF01C1ZPG.43.15.B04.1.454.CMB.1.raw
  modified_base (298)..(298): a, c, t, g, unknown or other
  misc_feature (298)..(298): n is a, c, g, or t
  modified_base (426)..(426): a, c, t, g, unknown or other
  misc_feature (426)..(426): n is a, c, g, or t
  modified_base (497)..(497): a, c, t, g, unknown or other
  misc_feature (497)..(497): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagtttggctgagctgggttttccttgttcctattttaaaaggtgtccagtgtgaggtgcagctggtggagtctggaggaaccttgatccgagccggggggtccctcagactctcctgtgtagtgtctggactcaccgtcggtgacaacttcctgagctgggtccnccaggctccgaggggagggctggagtgggtctcagtttatctatgccgatggcagcacacactacgcagactctgtaggaaggccgattccacccttctaccgagagaccctcctaccaaagaaaccnccgactcgttcccctagaattcggaaaccacggccctacaaggacgtaccgaacgacgaccgggctaagtnttacttagtgtgactacgtcaattacgaaacctaactaaacttaacgtttcggaggggccctaaacggggaccccttgggtaacccc

SEQ ID NO: 124653 - DNA, 557 bp, Homo sapiens
  misc_feature: GYAE6OF01C54SG.43.15.B04.1.454.CMB.1.raw
  modified_base (289)..(289): a, c, t, g, unknown or other
  misc_feature (289)..(289): n is a, c, g, or t
  modified_base (469)..(469): a, c, t, g, unknown or other
  misc_feature (469)..(469): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaaggtgtccagtgtgaggtgcagctggtggagtctggaggaaccttgatccaggccgggggggtccctcagactctcctgtgtagtgtctggactcaccgtcggtgacaacttccngagctgggtccgccaggctccgagggaggggctgggagtggggtctcgagtttatctatcgccgatggcagcacacactacgcacgactcgtgtcggaagggccgattccaccctctccagacgacctccctaccgaagaaccaccgtcctcgtccccttacaattacgaaccacgcctnaacgagtccgacgacgacgggcctagtgttattattgngcacgtcatnactaacaatacgttcgagggccaacgggtacctggtaccc

SEQ ID NO: 124654 - DNA, 581 bp, Homo sapiens
  misc_feature: GYAE6OF01CW48N.43.15.B04.1.454.CMB.1.raw
  modified_base (449)..(449): a, c, t, g, unknown or other
  misc_feature (449)..(449): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagtttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggcctccgaggggaggggctggagtgggtctcagttatctatgccgatcggcagcacacactacgcagactctgtacgaaggccgattcaaccctctccagacacctcctacaagaaccacgcctacgtcccttacaatttcgaaacncgaccctacgaaggagtaccggaacgaccgacgggactagtcgtaatttagttagcgtacgtactcgattcggaactaaacaaattaccgttacgtacggggacccgaacggggtaaccccttgggtaaccc

SEQ ID NO: 124655 - DNA, 636 bp, Homo sapiens
  misc_feature: GYAE6OF01ETCQ4.43.15.B04.1.454.CMB.1.raw
  modified_base (497)..(497): a, c, t, g, unknown or other
  misc_feature (497)..(497): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcttgggttttccttgttcctattttaaaggtgtccagtgtgaggtgcagcgtggtggagtcgtggaggtaaccttgactccgacgggcccggggggtccctcgacgactcctcctgtgtagtgtcgtggactcaccgtcggtgacctaacttcctgacgcgtcgggtcccgccgacggccgtccggaggggagggggctaggggaggtgggtctcgtagttatctagtcgcgagtgcagacacacactacgacacgactcgtaggtaggaacgggtcctacgttcccacccctctaccgaggacgtaccctccctaaccgaaacgaaccaccgtcttaccgtaccccttanaacgttcgaacctacgccctacgaagacgtaccgaccgaacgcgggactagtgttattgttcgtgacgtacgtcagtacgaactaactaacttaaccgttcgggaccgggtacccaccgggtaaccctcgggtaacccg

SEQ ID NO: 124656 - DNA, 533 bp, Homo sapiens
  misc_feature: GYAE6OF01B3UEV.43.15.B04.1.454.CMB.1.raw
  modified_base (449)..(449): a, c, t, g, unknown or other
  misc_feature (449)..(449): n is a, c, g, or t
  modified_base (480)..(480): a, c, t, g, unknown or other
  misc_feature (480)..(480): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccggggggtccctcagactctcctgtgtagtgtctggactcaccgtcggtgacaacttcctgagctggtccgccaggctccgagggaggggctggagtgggtctcagttatctatgccgatggcagcacacactacgcagactctgtgaagggccgattccgaccctctcccagagacctcctaccaagaaccacgctcgtccccttcaattcgaacagccctnagagtcgacgacacgggcatgtattagttgngcgactcatgactacaattaacttctacgggacccagggaaccctgggtaccc

SEQ ID NO: 124657 - DNA, 550 bp, Homo sapiens
  misc_feature: GYAE6OF01B80BN.43.15.B04.1.454.CMB.1.raw
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
tcagtgtgagtagtcacgaccggtgctcgatttagacagtatatacccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccggggggtcctcagactctcctgtgtagtgtctggactcaccgtcggtgacaacttcctgagctgggtccgccaggctccgaggggaaggggctgggagtgggtctcgagttatctagtgccgtatggcagcacacactacgcagactctgtagaaggccgattccaccctctccaagacgtacctccctaccaaagaacacgcctcgtacccttanaattcgaacacgccctanagacgtcgaccgacgacgggcagttcgttattagtgtgcgactcatgactacaatacttcgacgggaccagggtaccctggcctacccg

SEQ ID NO: 124658 - DNA, 579 bp, Homo sapiens
  misc_feature: GYAE6OF01BNNR9.43.15.B04.1.454.CMB.1.raw
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
tcagtgtgagtagtcacgaccggtgctcgatttagacagtatatatccgcggggctaggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccgaggccggggggtccctcgagactctcctgtgtagtgtctggactcaccgtcggtgacaacttcctgacgcgtgggtccgccgaggcctccgaggggaaggggcgtgggagtgggtctcgagttatctagtcgccgatggcagcacacactacgcagactcgtgtaggaacgggcctattccacccttctaccagacgtacctccctaaccgaacgaaccncgtcctcgttccctanaacttcgaactcgcctagagacgtccgacgacgacgggtcagtgtattagtgtgaccgtactcatcgaactaacaaacttacgttcggacggggacccaacgggtaaccctggtacccg

SEQ ID NO: 124659 - DNA, 685 bp, Homo sapiens
  misc_feature: GYAE6OF01BC19G.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaagtgtccagtgtgaggtgcagctggtggagtctggaggaaccttgatccgaggccgggggggtccctcgagactcctcctgtgtagtgtctggactcaccgtcggtgacaacttcctgacgcgtgggtccgccgaggcctccgaggggaaggggcgtgggaggtgggtctcgagttagtctagtgccgatggcacgcacacactacgcagactcgtgtaggaacgggccgacttccaccctctaccagacgtacctccctaccgaacgaaccaccgaccttcgtacccctttacaaacgtttacgaaaccgtacgtaccctacgaacggtacggtacccggaaccggaacgaccggggactaaggttacggttaagtttacgttcgggtacgtccgtaacccgttcgtaagttacggtaaaccttaaacctaaaactttaaccccggtttacgggtaccgggggtaaccccggtaaacccgggggttaacccccgttcggggttaaccccccg

SEQ ID NO: 124660 - DNA, 571 bp, Homo sapiens
  misc_feature: GYAE6OF01DPX5E.43.15.B04.1.454.CMB.1.raw
  modified_base (444)..(444): a, c, t, g, unknown or other
  misc_feature (444)..(444): n is a, c, g, or t
  modified_base (455)..(455): a, c, t, g, unknown or other
  misc_feature (455)..(455): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccaggccgggggggtccctcagactctcctgtgtagtgtctggactcaccgtcggtgacaacttcctgagcgtgggtccgccaggctccgaggggaaggggctgggagtgggtctcagttatctatgccgatggcagcacacactacgcagactctgtgaacgggccgattccaccctctccagacgacctccctaccaagaaccaccgctcgttccccttanaacttcgaacngccctagagacgtccgaacgacgaccgggcagttgtattagttgtgccgtactctatcgaacttaacaaattaaccgttcgtacggggaccctaacggggtacccctgggtacccc

SEQ ID NO: 124661 - DNA, 571 bp, Homo sapiens
  misc_feature: GYAE6OF01AZSCJ.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagtttttgctgagctgggttttccttgttcctattttaaaaggtgtccagtgtgaggtgcagctggtggagtctggaggaaccttgatccgaggccggggggtcctcagactctcctgtgtagtgtctggactcaccgtcggtgacaacttcctgagcgtcgggtccgccgaggctccgaggggagggctggagtgggtctcgagttatctatgcgatggcagcacacactacgcagactctgtgaaggccgtattccaccctctccagtacgacctccctaccaagacaccgtctcgtcccttacaattcgaacacgacctcgaacgacgtaccgaacgacgacgggctagtacgttattagtgtcgacgtacctcaatcgaacttacgaaattaccgttacggtacggggacccacggggtaaccctgggtacccc

SEQ ID NO: 124662 - DNA, 832 bp, Homo sapiens
  misc_feature: GYAE6OF01BZ6UL.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcttgggttttccttgttcctattttaaaaggtgtccagtgtgaggtgcagcgtgggtggagtcgtagggacggtaaccttgactccgagggtccggggggtccctcgagtacctcgtcgtgtggtagtgtcgtggtactccgaccggtcggtacgtaacctaaccgttccgtacggacgtccggttcggggtccccgaccggtaacgggccgtaccggaagggggtaacgggggtccgtaggggtaggttcggggttcctacgtaaggtttactacgttaacgtcggtacccggtagtccgggaccaacggaccaaaccaaccgtaaccgtaacggaccgacggtaaccttccggtaagggtacgggtaaacgggccgtaacgtttaccccaaccccttccgtaaccgaacggtaaccgaaccctttacccgaaccgtaaaacggtaacccgtacggtacccgttacccgttaccctttaacgaacgtttaccgaaaccgtacgtaccctaacggtacggtacccggtaccggaacggtaaccgaccgggtacaacggtttaggtaacttaaggttcgacggtacgtaccctaagtacgtaacgtaaaccgtaacgttaaaccgttaaccggttcggggaacccggggtaaccctaaccgggttaacccggttccgtaacccccgg

SEQ ID NO: 124663 - DNA, 748 bp, Homo sapiens
  misc_feature: GYAE6OF01BMBFL.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatgggagttttggctgagctgggttttccttgttcctattttaaaaggtgtccagtgtgaggtgcagctggtggagtcgtggaggaaccttgactccgagggcccggggggtcctcgagactcctccgtgtagtgtgtcgtggactcgtaccggtcggtagaactacgttccagagtcgtcgggtccgcgacggcctaccggaaggggacgggtcgtggacggtgggtcctagtagttatcgtagtcggaccgtagtcgggacaggactaacaccgaacgtacggacaacgtactcgtggtaacggaacgggtcccgtaattcccgaccccgttacgtaaccgaacggtaccgtaaccccttacccgaaaacccgaaagaaccccctggtaccctttccgttacccctttaacaaaggttttacccgaaaccttacggtccccctaaggtaaacccggttacgggaaccccgggtaaaccgacccggtaagggccttaaagtttacgttaagttgtttacggaccggtacctacgtactaagtacgtaaacccttaaagtaaacgtttaccgtcggggaccggggaaaccctaccgggtaaacccgttcggtaaccccc

SEQ ID NO: 124664 - DNA, 803 bp, Homo sapiens
  misc_feature: GYAE6OF01DJR7K.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagagactcacatggtagttttgctgagtcgttgggttttccttgttaccttaagttttaaaaggtgtccagtgtgaggtgcagtcgtgggtggagtcgtggacggtaaccttgactccgacgggtcccggggggtccctcgacgtacctcctccgtggttgtaggtcgttcgtacggtacctccgtaccggtcggtacgaacctaacctttccgtaggacgtccgttcgggtccccgccggacggtccgtaccgggaagggggaacggggtccggtaggggtaggttcgggtcttacgtagtttacgtacgtacgtcggaccgtagtcggacacgaccaacgaaccgtacgtaccgacaacgtacctcgtacggtacggtaaccgggtacccgttacttacccgaccccttccgtacgaacggtacccgtaccctaccccgtaaacgaaaccgtaaccgccgttacccgttccgttaccccttaagtaaacgttaccgaaacccgtacgtcccgtaacgaacggttaccgtaaccggaaccgtaacccggacggtattaacgttagttaactttggtcgtaccgtaaccgttactacgtattaccggtaaacctaacgttaaacgttaaccggttccgggaaccgggtaccccggtaaccggttaacccgttcggtaaaccccccg

SEQ ID NO: 124665 - DNA, 653 bp, Homo sapiens
  misc_feature: GYAE6OF01D9QQZ.43.15.B04.1.454.CMB.1.raw
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (474)..(474): a, c, t, g, unknown or other
  misc_feature (474)..(474): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccgaggccggggggtccctcgagacctctcctgtgtagtgtctggactcaccgtcggtnacaactcctggagcgtcgggtccnccgaggcctccgaggggaaggggctgggagtggggtctcgtagttacgtctaatcggacccgtagtcggcagtcaacacacgtacgcagacctcgtgtaggacggctattaccaccctctacgacgacgtacctaccctacgaaacgaccaccgcttccggtacccttanaattcgaaacgtacgccctagacgtacgtaccggaacgtaaccggacgggtactaagttggttaaacttttagttcggttcggtaaccggttaaccttcgtagtaacggtaacctaacgtaaacttaaccggtacggttaccggggaacccaaccggggtaaccccgttggtacccccg

SEQ ID NO: 124666 - DNA, 589 bp, Homo sapiens
  misc_feature: GYAE6OF01ES99Q.43.15.B04.1.454.CMB.1.raw
  modified_base (495)..(495): a, c, t, g, unknown or other
  misc_feature (495)..(495): n is a, c, g, or t
tcagtgtgagtagtcacgaccggtgctcgatttagacagtatatatccgcgggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccgaggccggggggtccctcagactctcctgtgtagtgtctggactcaccgtcggtgacaacttcctgagctgggtccgccaggctccgaggggaaggggcgtgggaggtgggtctcgagttatctatgccgatggcagcacacactacgcagactctgtggaacggccgtacttccaccctctaccagacgaccctcctaccaaagaaccaccgcctacgttcccttactaacttcgaacacgacctacgagacgtcgaacgacgaccgggnagtgtaattgttggtcgaccggtacttcaagtcgaactaactaattaaaccgttcggtacggggacccaacggggtaacccctgggtaaccccg

SEQ ID NO: 124667 - DNA, 712 bp, Homo sapiens
  misc_feature: GYAE6OF01E00ZN.43.15.B04.1.454.CMB.1.raw
  modified_base (347)..(347): a, c, t, g, unknown or other
  misc_feature (347)..(347): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaactgatccagccggggggtcctcagactctcctgtgtagtgtctggactctaccgtcggtgacaacttcctgagcgtggtccgccaggctccgaggagggctggagtgggtctctagttatcgtatgccgttanggcagcacacgactacgcagtactcgtggtcgaacgggtccacgtttccacccctcgtaccacgtaacgtaccctaccctaaccgaaccggaactacccggtaccttacggtaccccctttactaaacgtttacggaaaccgtaccgtacccgtacgtaaccgggtaacgtacccgggaacccgggtaaaccgacccggggactaactttacggttagtttaaacttcgggttacgacccgggtaacttacctaaagttaccggtaaaccttaaaccgtaaaccgtttaaacccgtttaccgggttaccggggggaacccctaaaccgggggggttaaaccccccttcggggttaacccccccgg

SEQ ID NO: 124668 - DNA, 758 bp, Homo sapiens
  misc_feature: GYAE6OF01A208R.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcttgggttttccttgttcctattttaaaaggtgtccagtgtgaggtgcagctggtggagtctggaggaaccttgactccgacgggcccgggggggtccctcgacgactctcctgtgtagtgtcgtggactcgaccgttcggtcgacctaacttcctgacgtcgtcggggtcccgccgaggcctccggaggggaacggggcgtgggaggtcggggtctcgtagttatctagtcgccgatcggcacgcacacactacgcacgtactcgtggtacggaacgggccgtacttccgaccccttctacccgaaggtaccgacccttccccgaaaccgaaacgaacccgaccggtcccttaccggttcccctttaacaacgtttaccgaaaccctacggtcccctaacggaacggtaaccggtacccgggaaccgaacccggggtaccggggtacctaagggttttacgttaaacggtttacggtttcggtaaccggtaccggtaccttacggtaacgttaacggtaacccttaaacgtaaacccgttttacggtttacccggggtaccggggggaacccctaaaccgggggttacccccgtttcggggtaaccccccg

SEQ ID NO: 124669 - DNA, 978 bp, Homo sapiens
  misc_feature: GYAE6OF01CLCVC.43.15.B04.1.454.CMB.1.raw
  modified_base (188)..(188): a, c, t, g, unknown or other
  misc_feature (188)..(188): n is a, c, g, or t
tcagtgtgagtagtcacgaccggtgctcgatttagacagtatatatccgcggggctgggagaggacgcccagcactgggattccgaggtgtttccattcggtgatcagcactgaacacagaggactcaccatggtagttttggctgagtcgttgggtttttccttgttaccttaagttttaaaaggtntccgagtgtgaggtgcagtcgtggtggagtcgtaggaacggtaaccttgaacgtccggaccggggtcccggggggttccctacgacgtaccgttccgttccgttggttaggttacggttcgttcggtcggtacccgttaccggtacccggttacgggtacgtaaacccgtaaccgtttaccggtagtaccggtccgttcccgggggtcccgccggtaccggtacccgttaaccggggaagggggaaccggggtcggttacggggtacgggtttccgggttaccgttacggtttaacgtttaacgttaccgttacgtccgggttaccggagttccgggaccaacgtaccgaaacccgaacgtaacccggttaaccgaaccgtacggttaacccgttaggttaacgggtaaccgggtaacccgggtaccgtttaacccgtttaccccgtacccccgtttaaccgacccggtaacgttaaccccggtcccttaaccccgtaaaccgaaaaccggttacccgacccggttacccgttaacccgtttcccccttaaagtaaaccgttaacctaaacccgcgttaacccccgtaggaaaccggtaccggtaaccgacggtaacccggacggtacgttacgttagtaaacgtttcgttacggtacgtaccccgttaacttacttaccggtaaacgtttaaccctaaaccgtttaaaacgtttccccgggttaaaccgggggacccggggtaaaacccctaacccggggtttaccccggttcccgtttaacccccccg

SEQ ID NO: 124670 - DNA, 749 bp, Homo sapiens
  misc_feature: GYAE6OF01E02EB.43.15.B04.1.454.CMB.1.raw
tcagtgtgagtagtcacgaccggtgctcgatttagacagtatatacccgcggggctgggagaggagcccagcactgggattccgaggtgtttccattcggtgatcagcactgaacacagaggactcaccatggagttttggctgagcttgggttttccttgttcctattttaaaaggtgtccagtgtgaggtgcagctggtggagtctggaggtaccttgatccgacggggtcccggggggtccctcgacgtactcctccgtgtgtacgtgtctggtacctccgaccggtcggtgaacctaacttccgtgacgtcgtcgggtccgcacggctccggaggggacgggcgtggacggtcgggtctcgtagttactcgttagtcggccgtaagtcggacgtacgaccaacacaccgtacggaccaggtactcgtagtaggaaccggtaccgtactaccctaccccttccgtcccgaaggtacccgaccttacccgtaacccgaaacgaaccgacccgtccttaccggttacccccttaagtaaaccttaccggaacctaccgtaccccggtaccaacggtaccgtaacccgggtacgaacccggttaccgggacttaacgttacgttaacttaaggttcggttaacgaccgttaacctacgtaacgtacttaaaccgtaacgtaaacttaacccggttgggaacccgggggtcctaaaaccgggttccccgtaggtccccgttaacccccgg

SEQ ID NO: 124671 - DNA, 655 bp, Homo sapiens
  misc_feature: GYAE6OF01DAENB.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttgctgagctgggttttcctgttcctattttaaaaggtgtcagtgtgaggtgcagctgggtggagtctggaggaaccttgatccgacggccgggggggtccctcgacgactcctcctgttgtagtgtctggactcaccggtcgtgaccaacttcctagacgcgtcggtccgccgaggtccgtccgaaggggaaggggtcgtggaggtcggtctacgtagtttatcgtagtacggtcgagtggcacgacacaacacgtacacacgtacctgtaggtacggaagggcccgtacttaccgtaccctacgtaccgaacgacgtacctaccctaccaaacgaaccgtaccgtacctcggttacccttaacgtaattacgaacgacgtcctacgaacgtagtacccgaacgacgtacggactattagtactttagtcgacgctaccgtagtacttaacgaaccttaacgaaacttacgttaccgggtacgggacccggttaaccggcccgttacggtaccccgg

SEQ ID NO: 124672 - DNA, 639 bp, Homo sapiens
  misc_feature: GYAE6OF01BTWLT.43.15.B04.1.454.CMB.1.raw
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (459)..(459): a, c, t, g, unknown or other
  misc_feature (459)..(459): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagcgtggtggagtctgggaggaaccttgactccgaggcccggggggtccctcgagctctcctgtgtagtgtctggactcaccgtcgtgacaacttccngngcgtgggtccgccgaggctccgagggaggggcgtgggaggtgggtctcgtagtttactcgttagtcgccgtagtggcagaccaccacactacgcagactcgtgtacggaacgggtccgtacttccgacccctctaccgacgacgtacctacccgtaccaacgaacncccgtctccgttcccttaactaacgttcgaaccacgtccctacaaggtaccgtaccgaaccggaccgacgggctaagttcgtttaagtgttcgtcggactaccgtcactacgtaacctaacgtaacgttaaccgttacggtaccggggtaaccgacccggggtaccgtccgggtaccccg

SEQ ID NO: 124673 - DNA, 733 bp, Homo sapiens
  misc_feature: GYAE6OF01ECOND.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcttgggttttccttgttccttaattttaaaaggtgtccagtgtgaggtgcagctggtggagtctggagaccttgactccgagggcccggggggtcctcgagactctcctgtgtagtgtcgtggactcgaccggtcggtcgacctaacttcctgacgcgtcggtcccgccgacggccgtccggaggggaacggggcgtgggaggttgggtctacgtagtttatcgtatcggccgtagtggccagaccacgaacacgtacgcgacgtactcgtaggtacggacgggtcctacgttcccaccccgttcgtacccgaagtaccgtacccttacccgtaaccgaaaccgtaacgacccggttacctttcccggttaccccttaacgaacgtttaccgaaaccgttacgccccgttagaacggttaccgggacccggtaacccggtaccggaaccgggtactaagggttacgtttaactttaggttcggtacgaccggttaactaccgtagttacgtaacctaaaccgttaacttaaaccgtttccggggaacgggttaccccggtaaacgggtaccccgtcgggtacccccg

SEQ ID NO: 124674 - DNA, 248 bp, Homo sapiens
  misc_feature: GYAE6OF01B7S6T.43.15.B04.1.454.CMB.1.raw
  modified_base (198)..(198): a, c, t, g, unknown or other
  misc_feature (198)..(198): n is a, c, g, or t
  modified_base (205)..(248): a, c, t, g, unknown or other
  misc_feature (205)..(248): n is a, c, g, or t
tcagtgtgagtagtcacgaccggtgctcgatttagacagtatatatccgcgggcacgaccggtgctcgatttagacagtatatatccgcgggcacgaccgtgctcgatttagacagtatagtatccgcgggctggcaaggcgcatagctgcctggtcaaggctacttccatactcacactgagcgggctggcaaggcncaagtgnnnnnnnnnnnnnnnnnnnnnnnnnnnnnnnnnnnnnnnnnnnn

SEQ ID NO: 124675 - DNA, 687 bp, Homo sapiens
  misc_feature: GYAE6OF01ASISJ.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccaggccgggggggtccctcacgactctccgtgtgtagtgtcgtggactcaccgtcggtgacaacttcctgagcgtgggtccgccaggcctccgaggggacggggctgggagtcgggtctcgtagttatcgtatcgccgagttggcagccacaccactaacgcagactctaggtgaacgggtcctacgtccacccctcgtaccagaccgtacctcccctaacgaacgtaaccaccgtccgttacccgttacccgtttaccaacgtttaccgaaaccgtacgtccccgtacgaacgggtaccggttaccggaacccgggtaacgaccggggtacctaagtttcgttaaacgtttagtcggttccggaccgtaccgttcgtaatacggtaacttaaaccgtaacgtttaaacccgttccgggtaccgggggaacccgtaaccggggtaaccccgttggggttaccccc

SEQ ID NO: 124676 - DNA, 817 bp, Homo sapiens
  misc_feature: GYAE6OF01E4FOH.43.15.B04.1.454.CMB.1.raw
  modified_base (186)..(186): a, c, t, g, unknown or other
  misc_feature (186)..(186): n is a, c, g, or t
  modified_base (620)..(620): a, c, t, g, unknown or other
  misc_feature (620)..(620): n is a, c, g, or t
tcagtgtgagtagtcacgaccggtgctcgatttagacagtatatatccggcggggctgggagaggagcccagcactgggattccgaggtgtttccattcggtgatcagcactgaacacagaggactcaccatggtagttttggctgagtcgttgggttttccttgttaccttattttaaaacggtntccgagtgtgaggtgcagcgtgggtggagtcgtgggacggaaccttgactccgacgggtcccggggggttcctcgacgtacctctccgtgtgtagtcgtcgtcggtacctccgaccggtcggttacgaccttaacttcccgtaggtcggtaccgttcggggtccccgcctacgggtccctaccggggaacggggaacggggtcgtacgggaggttcggggtacttacgtacgtttataccgttaacgtcggacccgtaaggttcggaccgacgaccaccgtaacccgtaccgtaaacccgctaacggtacctcgtaggtacggaacgtcccgtaacttcccgaccccgttccgtaaccgcgtaacgaccccgtacctaccgaaaccgacgttccgaccttccgtaccccgtttacgaacgtttacgaacccgtntacccgtacgtaacgggtaccctaccgggaacccgaccgggttaccgacgttaaccgttaggtttaaacttcggttcggtaacccgtaaccgtacgtttcgaagtaaccgttaaaccttaccgttaaaacgtttacccgtacggggttaacccgggtaacccggtaacccgggtttaccgtccgggttaccccccgg

SEQ ID NO: 124677 - DNA, 959 bp, Homo sapiens
  misc_feature: GYAE6OF01E0WIP.43.15.B04.1.454.CMB.1.raw
tcagtgtgagtagtcacgaccggtgctcgatttagacagtatatatccgcggggctgggagaggagccccagcactgggattccgaggtgtttccattcggtgatcagcactgaacacagaggactcaccatggtagttttggctgagtctttgggtttttcctttgttccttaagttttaaaaggtgtcctagtgtggaggtgcagctgggtggagtcgtaggaggtaacctgactccgacgggtccccggggggtccctcgacgtaccttcctccgttggtggttaggttcgttcgtcggtacctcgtacccggttcggtacgtaacctaaccttccgtaggtacggtccggttccggggtccccgacccggacgggtccgtacccgggaagggggaacgggggtccgtggggtacgggttcgggtccttacgtagtttactcgttagtcggaccgtagtcggacacgaccgaaccaacctaccgtaaccgaccaacgtaccgttcgtacggggtaacggaaccgggtcccgttaaccgttcccctaaccccgttaccgtacccgaaggtaacccgtaacccttaacccccgtaaaccggaaaacccgttccgaacccggttcccgtttaccccgttaacccctttaaccgaaacgtttacccgaaacccgttacccgtacccgttaacggaacgggttaacccggtaacccggaacccggtaaccgggtaacccggggttacttaaaggtttagttttaacgtttaacgggttttacggtaccggtaaaccccggtttaccgttaacggttaacgttaaacccccgggttaaaaccttaaacccggtttaaaaaacccgttttaccccggggtttacccgggggtaaaccccgggggaaaccccccggggtttaaacccggggttaacccccggttacccccgggtaaccccccgg

SEQ ID NO: 124678 - DNA, 701 bp, Homo sapiens
  misc_feature: GYAE6OF01AXQ4S.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggtttccttgttcctattttaaaggtgtcagtgtgaggtgcagctggtggagtcgtggaggaaccttgatccgagggccggggggtccctcacgactctccgtgtcgtagtgtcgtggactcgaccggtcggtagacctaaccttcctgacgtcgtcgggtccgccgacggtcctaccggaggggtaacggggcgtaggggacggttcgggtctacgtaggttactccgttagtcggaccggtagtcggcgtacgacaaccgacaaccgtacgacgaacgtaccgtagtacgtacggaacgggccgtacttcccgacccttctaccgaggactaccctaccctaaccgaaagaaccaccgtccgttacggttacccttataacttcgaaaccactcccgtaagacgtacggtaacggacctaaccgggccggtataacttacgttaagttacgtcgtcgaacccgtacgtacgtattaccggaaacttaaaccgttaataccggtttaccggcggggaaacccctacgggtaaaccccgtcgggtaaccccg

SEQ ID NO: 124679 - DNA, 925 bp, Homo sapiens
  misc_feature: GYAE6OF01CGJFG.43.15.B04.1.454.CMB.1.raw
tcagtgtgagtagtcacgaccggtgctcgatttagacagtatatatccggcggggctgggagaggagcccagcactgggattccgaggtgttccattcggtgatcagcactgaacacagaggactcaccagtggtagttttggctgagtcgtttgggtttttccttgtttaccttaagttttaaaaaggttcgttaccgtaggttggtaggtaggttgaccgtaggtcgttgggtcggtaacggttcggttaggaacgggtaacccgtttgaacgttcccggaacgggggtccccgggggggttaccctacgtacgtaccttccgttcccgttaggttggttaggttcgttccgtacgggtacctccgtaaccggttccggtaacgtaacctaaccgtttccgtcggtacggcccgggttacgggtccccggaccggtacgggtaccgaccggggtaagggggtaacgggggccggttagggtagggttcggggtaccttaggtaacgtttagttacgttacgtacgggaccgtagtacggccaacgtccgaaacacccgtaaccgtaccgacgtaaccggtctacgtagggtaacggtaaccgggtacctacccgtttaccgacccttaccacgaacgtacctaccgtaccccgaacgaacgaaccctagtacccgtacctttcccgttaactaacgttaacgacctaaccggtacgttacggaacgtaaccggttaccccgaacggggtaccgaccgggttaaaccgtcggttttacgtaaagttttcgttaaccggtagtaccgggttaccctaacggttaaattaaccgttaaaacgtaaccgtaaaccgttttacgggtaaccggggttaaccggtacccggttaaacccggtaacccggtcccgggttaaacccccggg

SEQ ID NO: 124680 - DNA, 803 bp, Homo sapiens
  misc_feature: GYAE6OF01E2OW4.43.15.B04.1.454.CMB.1.raw
  modified_base (168)..(168): a, c, t, g, unknown or other
  misc_feature (168)..(168): n is a, c, g, or t
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (240)..(240): a, c, t, g, unknown or other
  misc_feature (240)..(240): n is a, c, g, or t
  modified_base (431)..(431): a, c, t, g, unknown or other
  misc_feature (431)..(431): n is a, c, g, or t
  modified_base (483)..(483): a, c, t, g, unknown or other
  misc_feature (483)..(483): n is a, c, g, or t
  modified_base (675)..(675): a, c, t, g, unknown or other
  misc_feature (675)..(675): n is a, c, g, or t
tcagtgtgagtagtcacgaccggtgctcgatttagacagtatatatccggcggggctgggagaggagcccagcactgggattccgaggtgtttccattcggtgatcagcactgaacacagagactcaccatggagtttgctgagcttggtttctgtctagtttaaagngtccagtgngaggtgnaggctggtgagtcgtggtacggtacctagacgtccgacgggtccccgggggttccncgtacgacctccttaccgtgttagtagtcgttacgtcggtaacctccgtaccggtcggtacgtaacctaccgttccgtagcgtccggttcggcccgtaccgacggtcgtaccggaggagggtcgagggtcggttacgggtctaccgtagttactctaggtccgacgtacgtgacgtacgactacccgaacncgttacggactaacgtctcgtaggtacgaccggttacctacctccgtacccncctacccgtacggtaccctacccgtacccttaaccggaacgaaccgttccgtcccgtttaccgtaacccgttactaaccgttaccggactttacccggaccgttacggaacgtacgtacccgggaaccgtacccggtaacccggtagtacgttaacgttacggttaccgttaggtaccgtaccggttaaccnccggtttaataacccggtaaacctttaacccggttaaaaccggttacccggtttaaccccgggggttaccggtaaccccggggaacccggttttaaacccccggggcccccgtttaaaccccccgggg

SEQ ID NO: 124681 - DNA, 790 bp, Homo sapiens
  misc_feature: GYAE6OF01CPYTL.43.15.B04.1.454.CMB.1.raw
  modified_base (185)..(185): a, c, t, g, unknown or other
  misc_feature (185)..(185): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggtagttttggctgagtcgttgggtttttccttgttaccttattttaaaaggtntccagtgtgagtgcagctggtggagtctggagaaccttgactcgaggccggggggtccctcgagtactctcctagtcgtagtcgtcgtggacctccgtaccgtcggtacgaacctacttaccgtggacgtccgtcggtaccggacccgtaacgggccgtacggaacggggagggtacgtggtacggtgggtacctcgtaacgtttaagctaacgtcggaccgaagttcggacacggaaccacgaaccgtaactaaccgacgaacggtaaccgttccgtagggtaacgggtaaccgggtaccgtaaccgtttacccacccttacccgtaccgtaaggtaaccgtaacccgttaccctaacccgaaaccggttaacaaccccggttctaccggtttaccccttaacgtaaccgtttacgaacccgtacggtaccctacgaaaccgttacggaaccggaaccgacggtaaccgggtaccttaagttacgttaacgttagttacggtacgtaccgtaccgttaacgtaagttactaaaccttaacgtaaaaccgtttacggtaccgttaacgggacccgtaaaacccggtaccgttccggtaaaccccg

SEQ ID NO: 124682 - DNA, 770 bp, Homo sapiens
  misc_feature: GYAE6OF01EGJY4.43.15.B04.1.454.CMB.1.raw
  modified_base (248)..(248): a, c, t, g, unknown or other
  misc_feature (248)..(248): n is a, c, g, or t
  modified_base (540)..(540): a, c, t, g, unknown or other
  misc_feature (540)..(540): n is a, c, g, or t
  modified_base (567)..(567): a, c, t, g, unknown or other
  misc_feature (567)..(567): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagtcttgggtttttccttgtttccttaattttaaaaggtgtccagtgtgagtgcagcgtggtggagtcgtggaggaaccttgactccgagggccgggggtcccncacgactccgtcctgcgttagtgtctggactccgaccgtcggtcaacctaccgttctgacgcgttcgggcccgcgagggcctccggaagggggacggggtcgtaggggtcggtcgggttcgtacgtagtttactacgtagtcggcccggaagtccggggtcaacggccctaaccgaaccgtaaactacggactaacggtaccgtcgtagggacggaaccgggtaccttaactccccgtacccctcgtaccgaaacggtacctaacccgtcccgtaaacgaaaccggtaaccncccgtacttacccgttaacccgtttanaaacggtttaccaacgtcctaccacgtaaggtaccggtacccgaacggaaccggtacacttagttacgttaacgttgtttaaggcccgtaagtaccttacgtaagttaccaaaacgtttcctaaaaaccggttttcccggttacggggtaaccgggaacccccgggtttaacccgggtaaaccccggtttccggtaacccccg

SEQ ID NO: 124683 - DNA, 719 bp, Homo sapiens
  misc_feature: GYAE6OF01DPOG3.43.15.B04.1.454.CMB.1.raw
  modified_base (610)..(610): a, c, t, g, unknown or other
  misc_feature (610)..(610): n is a, c, g, or t
  modified_base (644)..(644): a, c, t, g, unknown or other
  misc_feature (644)..(644): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggtagtttggctgagtcgttgggttttccttgttaccttaagttttaaaaggtgtccagtgtgaggtgcgagcgtggtggagtcgtaggaggtaaccttgacgtccgacgggtccgggggtccctcgagtacctccgtcctggtgtagtgtcgtggtactccgacggtcggtgaacctaaccttccgtgacggtccgtcgggtcccgccgtacggccgtccggaagggggtaacggggtcgtaggggtacggtcgggttctacgtagtttacgtcgtaagtcgccgtagtcggacgacgtacaccaaccgaccgtaccgacgacgtacgttcgtacggtacggaaccggtcccgtacttacccgccccgttaccaccgaacgaaccgtacccttacccgaaccgaaaacgtaccgaccgtccttaccgtcccttaagaacttaccgaaactcggtacctaggacgtacgaccgaaccgngtaccggattagtcgttaagttcgttggtaccgngtaccgtactactaacggtacctaaacgaagttaaccgttcgggacggtaacgacccggtaccgtccggtacccg

SEQ ID NO: 124684 - DNA, 605 bp, Homo sapiens
  misc_feature: GYAE6OF02I6SPL.43.15.B04.1.454.CMB.1.raw
tcagtgtgagtagtcacgaccggtgctcgatttagacagtatatagtccgcggggctgggagaggagcccagcactgggattccgaggtgtttccagttccggtgatcagcacgtgaacacagaggactcaccatggagttttggctgagctgggttttccttgttcctattttaaaaggtcgtccagtgtgaggttcgcagctggtggagtctgggaggaaccttgatccagccgggggggtccctcagactccgtcctgtgtagtgtctggacttctaaccgtcggtgacaacttcctagagctcgggtccgccacggctccagggaggggctggagtgggtctcagttatcgtagtcgccgatggcagcacacactacgcagactctgtgaagggtccgattccaacccttctaccagacacctccctaccaaagtaacctacggccttcgttacccttacaaatttcgaaacctagccctacgaacgtacgtccgacgtacgaccggggtcaagttcgtaattagttggtgacgtaactctaattcggaactacgaaattaccttcgtaggggccctaacggggtaccccttgggtacccc

SEQ ID NO: 124685 - DNA, 184 bp, Homo sapiens
  misc_feature: GYAE6OF02HU9ZW.43.15.B04.1.454.CMB.1.raw
  modified_base (167)..(184): a, c, t, g, unknown or other
  misc_feature (167)..(184): n is a, c, g, or t
tcagtgtgagtagtcacgaccggtgctcgatttagacagtatatatccgcgggcacgaccggtgctcgatttagacagtatatatccgcgggctggcaaggcgcatagctgcctggtcaaggactacttccactactcacactgagcgggctggcaaggcgcatagnnnnnnnnnnnnnnnnnn

SEQ ID NO: 124686 - DNA, 522 bp, Homo sapiens
  misc_feature: GYAE6OF02GRIZK.43.15.B04.1.454.CMB.1.raw
  modified_base (485)..(485): a, c, t, g, unknown or other
  misc_feature (485)..(485): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgagggaaggggctgggagtgggtctcagttatctatgccgatggcagcacacactacgcagactctgtgaagggccgattcaccctctccagagacctcctccaagaaccacgctcgttcccttcaattcgaacacgcctcagagtcgacgacacgggcatgtattatgtgcgactnatgactacaatacttcgcgggccaggaccctggtacc

SEQ ID NO: 124687 - DNA, 213 bp, Homo sapiens
  misc_feature: GYAE6OF02IAWBL.43.15.B04.1.454.CMB.1.raw
  modified_base (206)..(213): a, c, t, g, unknown or other
  misc_feature (206)..(213): n is a, c, g, or t
tcagtgtgagtagtcacgaccggtgctcgatttagacagtatatatccgcgggcacgaccggtgctcgatttagacagtatatatccgcgggcacgaccggtgctcgatttagacagtatatatccgcgggctggcaaggcgcatagctgcctggtcaaggactacttccactactcacactgagcgggctggcaaggcgcatagnnnnnnnn

SEQ ID NO: 124688 - DNA, 612 bp, Homo sapiens
  misc_feature: GYAE6OF02JP4ZS.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttgctgagctgggttttccttgttcctattttaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgagggagggctggagtgggtctcagttatctatgccgatggcagcacacactacgcagactctgtgaagggccattccaccctctccagacgacctcctaccaagaaccaccgcttcgtaccccttacaaacttcgaaacctacgtccctacaggtacgtccgaaccgaccgaaccggggctaagttacggttaactttagtttcggacgtccgtaccttccgaattacggaaccttaacaaacgtttaaccgtttccggtacgggggtaccccaacgggggttaacccccttgggttaacccccg

SEQ ID NO: 124689 - DNA, 545 bp, Homo sapiens
  misc_feature: GYAE6OF02F2QZK.43.15.B04.1.454.CMB.1.raw
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (484)..(484): a, c, t, g, unknown or other
  misc_feature (484)..(484): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgagggaaggggctggagtgggtctcagttatctatgccgatggcagcacacactacgcagactctgtgaagggccgattccaccctctccagacgactcctaccaagaaccacgctgtcccttnaacttcgaacagcctanagacgtcgacgacgacgggcagtgtaattagttgngcgactcaatcgaacttacaattaacgttcgtacggggccaacggggtaccctggtacccg

SEQ ID NO: 124690 - DNA, 535 bp, Homo sapiens
  misc_feature: GYAE6OF02IP06X.43.15.B04.1.454.CMB.1.raw
  modified_base (376)..(376): a, c, t, g, unknown or other
  misc_feature (376)..(376): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatgggagttttggctgagctgggttttccttgttcctattttaaaaggtgtccagtgtgaggtgcagctggtggagtctggaggaaccttgatccaggccgggggggtccctcagactctcctgtgtagtgtctggactcaccgtcggtgacaacttcctgagctgggtccgccaggctccgaggggaggggctgggagtgggtctcagttatctatgccgatggcagcacacactacgcagactcngtagaagggccatccaccctctccagacgactcctaccaaagaaccaccgctcgtcccttacaattacgaacacgcctcagacgtacgacgacgacgggnatgtatattgngcactcatgactacaatacttcgngggaccacgggtaccctggtaccg

SEQ ID NO: 124691 - DNA, 536 bp, Homo sapiens
  misc_feature: GYAE6OF02I5OLY.43.15.B04.1.454.CMB.1.raw
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
  modified_base (492)..(492): a, c, t, g, unknown or other
  misc_feature (492)..(492): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgagggaagggctgggagtgggtctcgagttatctatgccgatggcagcacacactacgcagactctggtgaacgggccattccaccctntccaagacgacctcctcaaagacacgctcgtcccttanaattgaaccagccctacagactccgacgacacgggcaatgtaattgtcgtgcgactnatgaactacaattacctgtacgggccacgggtaccctggtaccc

SEQ ID NO: 124692 - DNA, 236 bp, Homo sapiens
  misc_feature: GYAE6OF02F026P.43.15.B04.1.454.CMB.1.raw
  modified_base (210)..(214): a, c, t, g, unknown or other
  misc_feature (210)..(214): n is a, c, g, or t
  modified_base (216)..(236): a, c, t, g, unknown or other
  misc_feature (216)..(236): n is a, c, g, or t
tcagtgtgagtagtcacgaccggtgctcgatttagacagtatatatccgcgggcacgaccggtgctcgatttagacagtatatatccgcgggcacgaccggtgctcgatttagacagtatagtataccggcgggctggcaaggcgcatagctggcctggtcaaggactacttccactactcacactgagcgggctggcaaggcgcatagnnnnnannnnnnnnnnnnnnnnnnnnn

SEQ ID NO: 124693 - DNA, 716 bp, Homo sapiens
  misc_feature: GYAE6OF02J1G2V.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtgagtctggaggaaccttgatccagccggggggtccctcagactatcctgtgtagtgtctggactcaccgtcggtgacaacttcctgagctgggtccgccaggctccgagggaagggctggagtgggtctcgagttatctatgccgatggcagcacacactacgcagactctgtagaagggccgattccaccctctcccagacgacctccctaccaaaggaaccaccgtccgtcgttaccccttacgtaaacgtttcgaaacctacgtaccccgttacgaaccggtaacggttacccggaaaccggtaacccgaaccgggggtactaacgtttacggttaaacttttacgttacgggtttaccgacccggttaaccgttaaccgtaaaccggtttggtaaaacccccgttttaaaacgtaaaccgttttaaaccccgggtttttaccggtaacccgggggggttaaccccgttaaacccgggggtaaccccccggtttaccggggtttaaccccccg

SEQ ID NO: 124694 - DNA, 522 bp, Homo sapiens
  misc_feature: GYAE6OF02FIL4M.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccagggaaggggctggagtgggtctcagttatctatgccgatggcagcacacactacgcagactctgtgaagggccgattcaccctctccagagacctcctaccaagaacacgctgtcccttcaattcgaacagcctcagacgtcgacgacacgggcatgtattattgtgcgactcatgactacaatacttcgtagggaccagggaccctggtacc

SEQ ID NO: 124695 - DNA, 192 bp, Homo sapiens
  misc_feature: GYAE6OF02IGXT7.43.15.B04.1.454.CMB.1.raw
  modified_base (160)..(160): a, c, t, g, unknown or other
  misc_feature (160)..(160): n is a, c, g, or t
  modified_base (166)..(192): a, c, t, g, unknown or other
  misc_feature (166)..(192): n is a, c, g, or t
tcagtgtgagtagtcacgaccggtgctcgatttagacagtatatatccgcgggcacgaccggtgctcgatttagacagtatatatccgcgggctggcaaggcgcatagctgcctggtcaaggactacttccactactcacactgagcggctggcaaggcncatagnnnnnnnnnnnnnnnnnnnnnnnnnnn

SEQ ID NO: 124696 - DNA, 666 bp, Homo sapiens
  misc_feature: GYAE6OF02G4OFL.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtcgtggaggaaccttgatccaggcccggggggtccctcgagactcctcctgtgtagtgtctggactcgaccgtcggtgacaacttcctgagcgtcgggtccgccaggctccgaggggagggcgtgggaggtgggtctcagttatctatcgcgagtggcagcacacactacgcagactcgtgtaggaacgggtccgacttccacccttctaccgagaacgtcctccctaaccaaagaaccaccggccttaccggttcccctttaacgaaacgtttcggaaacctacggtcccttagaacggtacggttaccgaaaccggaaccggaacggggcctaaagtcgtttaaacttagttcggtacgccgtaacgtcgtaacttacggtaaacccttaactaaaacgtttaacccgtttcgggtaccggggaacccggttaaccggggtaaccccttgggtaaccccg

SEQ ID NO: 124697 - DNA, 826 bp, Homo sapiens
  misc_feature: GYAE6OF02H2007.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcgttggttttcttgttccttattttaaaggtgtccagtgtggaggtgcagtcgtggtggacgttcgtagggacggtaccttgactaccgacgggtccccgggggggttccctacgacgtacttccgtccgtggttaggtagtgtcgtaggacctccgtaccggttcggtacgaacctaaccttccgtacgacgtcggttccgggtcccgacccgacggtcccgttaccggaacggggggtaacgggggtccgtaggggtacggttcggggttccgttacgtaagtttacttacgttagtaccggtccggtagtcgggacacgtaccgaccaaccgtaccgtaacgaccgaacgtacgttcgttacggtacgggaaccggtccgttacttcccgaccctacgtaccgaaggactacccgtacctaacgaaaccgaccgtaccggtcttacccggtttacccttacgttaacgttaccgaaacgtaccggttacccagtaacggtaccggtaccggaacccgtaaccgggtacggtacttaaaggtcgtttaaacgtttcgtttacggacggtacccgtacttacggacgttaaccggtaacttaaaccgttaaacgtttaaccgtttccgggtaaccggggaacccggttaaccggttacccccggtagttaccccccggg

SEQ ID NO: 124698 - DNA, 548 bp, Homo sapiens
  misc_feature: GYAE6OF02HFXWL.43.15.B04.1.454.CMB.1.raw
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgaggggaaggggctgggagtgggtctcgagttatctatgccgatggcagcacacactacgcagactctgtgaacgggccgattccaccctctccagacgacctccctaccaaagaaccacgctcgttccccttanaacttgaacngccctcgagacgtcgacgacgacgggcagtgtaattagttgngcactcatcgaactacaattacttcgngggacccaacgggtaccctggtaccc

SEQ ID NO: 124699 - DNA, 573 bp, Homo sapiens
  misc_feature: GYAE6OF02I49DZ.43.15.B04.1.454.CMB.1.raw
  modified_base (445)..(445): a, c, t, g, unknown or other
  misc_feature (445)..(445): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccggggggtccctcagactctcctgtgtagtgtctggactcaccgtcggtgacaacttcctgagctgggtccgccaggctccgaggggaaggggctgggaggtgggtctcgagttatctatgccgatggcagcacacactacgcagactctgtggaacgggccgtattccaccctctccagacgacctcctaccaaagaaccacgccttcgtccccttanaacttcgaacacgcctcagacgtccgaacgacgacgggctaatcgtaattagttgtgcgtactcagttcgaaccttacaactttaacgttccggagggggacccaacggggtaacccctggtaacccg

SEQ ID NO: 124700 - DNA, 537 bp, Homo sapiens
  misc_feature: GYAE6OF02HV5EN.43.15.B04.1.454.CMB.1.raw
  modified_base (442)..(442): a, c, t, g, unknown or other
  misc_feature (442)..(442): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgaggggaaggggctgggagtgggtctcagttatctatgccgatggcagcacacactacgcagactctgtgaggccgattcaccctctcccagacgactcctacaaacgaacacgctcgtcccttcaattgaacncgcctcagacgtcgacgacacgggcagtcgtattattgtgcgactcatcgaactacgaattacgttcgacgggaccagggtacccgtggtacccg

SEQ ID NO: 124701 - DNA, 531 bp, Homo sapiens
  misc_feature: GYAE6OF02FP4EW.43.15.B04.1.454.CMB.1.raw
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (479)..(479): a, c, t, g, unknown or other
  misc_feature (479)..(479): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccagggaagggctggagtgggtctcagttatctatgccgatggcagcacacactacgcagactctgtgaagggccgattccaccctctccagagactcctccaagaaccacgctcgtcccttnaattcgaacngcctnacgacgtcgacgacacgggcacgtgtaattatgtncgactcattgaactacaatacttcgtcgggaccacgggtaccctggtacccg

SEQ ID NO: 124702 - DNA, 712 bp, Homo sapiens
  misc_feature: GYAE6OF02GL4H4.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaggtgtccagtgtgaggtgcagctggtggagtctggaggaaccttgatccaggcccgggggggtccctcgagactctcctgtgtagtgtctggactcaccgtcggtgaccaacttcctgacgcgtgggtcccgccaggcctccgaggggaaggggctgggaggtgggtctcgtagttatcttagtcgaccgtagtcggacacgccaacacaactacgacaacgactcgtaggtacggaacggggcctactttcccaccccgttctacccgaaggaccgtacccttaccctacccgaaaacggaaccctaccggtacccttccggtttaccccctttagtaaacgtttcgaaaccgtccgtcccttaagaacgggtaccgttcccggaaccgaaccgacccggggacttaagttggtttaaactttggttcggtcgaccgtaccttacgaattaccggtaaacccttaactaaccgtttaacccgtttcgggtaccgggggacccctaaccgggggttacccccgtgggttaaccccccgg

SEQ ID NO: 124703 - DNA, 665 bp, Homo sapiens
  misc_feature: GYAE6OF02HMDPM.43.15.B04.1.454.CMB.1.raw
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (479)..(479): a, c, t, g, unknown or other
  misc_feature (479)..(479): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccaggccgggggggtccctcgagactctcctgtgtagtgtctggactcacgtcggtnacaacttcngagctgggtccgccgaggctccgaggggaacggggctgggaggtgggtctacgtagttatctagtcgccgatggcagcacacactacgcagtctcgtgtaggaacgggccgtacttccaacccgtctaccaacgtacgtacctccctacaaacgtaaccacgtccttacgttcccttacaaagttcgaaacngtccctagaggtaccgtcggaaacccgtaacgaccgggtactacgtttagttaacgttttagttcggtacgtaccgtaccgttacgtacgttaaccgtaaaccgttaaacctaaacgtttaacccgtcgggttaaccgggggaaccccggtaaaccgggggttaacccccttggggttaacccccg

SEQ ID NO: 124704 - DNA, 752 bp, Homo sapiens
  misc_feature: GYAE6OF02I6XT4.43.15.B04.1.454.CMB.1.raw
  modified_base (191)..(191): a, c, t, g, unknown or other
  misc_feature (191)..(191): n is a, c, g, or t
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
tcagtgtgagtagtcacgaccggtgctcgatttagacagtatatatccgcggggctgggagaggagcccagcactgggattccgaggtgtttccattcggtgatcagcactgaactacagaggactcaccatggagtttggctgagctgggtttcctgttcctattttaaaggtgtcctagtcgtgaggtncagctggtgagtctgagaaccttgactcacggccgggggtcctacgagacctctacgtgtgtagtntcgtagactcgaccgttcggtacgactaacttccgagaggtccgtagggtacccgngtaaccggtccgtaccggtagggtaacgggcttaggaacggttcgggtcctacgtacgttactcgtacgtacggtccgtagttcggacctacgggactacgaacctacgtaccgacgtaacgtaactcgtacggtacggaacgggtacctacggttcccaaccgttaccggttaccaaggtacccgtaccgttacccgttacgaaccgtaaacgtccgtaccgtttaccgtaacccgtttagaacgttaccgaaaccgtactacccgtcgtaacgttaccgaccgtttaccgaacggttaacccgggtcttagttaaccgttacgttacgttacgacggttaacccgtacttaacggaccgttagaaacccgtttaacttaagggttacccggttaacgttccggggaaccctaaccggtaaccgtttcggaaccccgg

SEQ ID NO: 124705 - DNA, 671 bp, Homo sapiens
  misc_feature: GYAE6OF02GLT7I.43.15.B04.1.454.CMB.1.raw
  modified_base (430)..(430): a, c, t, g, unknown or other
  misc_feature (430)..(430): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccgaggcccgggggggtccctcgacgactctcctgtgtagtgtctggactcaccgtcggtgacaacttcctgagcgtgggtccgccgaggcctccgaggggaacggggtcgtggaggtgggtctcgtaggttatctatggccgtagtggcagcaacaccactacgacacgactcgtagtacggaacgggtccgtacttccgacccttcnccaacggaacgtaccctaccctaccgaaaacgaaccaccgaccttccgttcccctacgtaaacttccggaaacaccgtccctagaacgtacggtaccgaaccggaaccggtaccggggtactaacgttacggttaactttaagttcgtacgaccgtacgttacacgtacgtaaaccttaacctaaagttaacgtttcgggtaccggggtaacccgaacggggttaacccctgggtaccccg

SEQ ID NO: 124706 - DNA, 662 bp, Homo sapiens
  misc_feature: GYAE6OF02FI0Q8.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtcctcagactctcctgtgtagtgtctggactcaccgtcggtgacacttcctgagctgggtccgccaggctccgaggaagggctggagtgggtctcgagttatctatgccgatggcagcacacactacgacacgactctagtacggaacgggtcctacgtccacccctctacccgagacgtacctcccgtaccaaaggtaacccaccgtcttccggttaccccttacgaaactttccgaaacctcggaccccttacgaacggtaccggttaccgaaaccggtaaccgaaccgggggtcaacgttcggttaaatttaacgttgttacggacccgtaactccgtaactacggtaacctaacccgtaaacgttaacctttaccggtaccggggggaccctaaccgggggttaaccccttggggtaacccccg

SEQ ID NO: 124707 - DNA, 561 bp, Homo sapiens
  misc_feature: GYAE6OF02I3GJ8.43.15.B04.1.454.CMB.1.raw
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttcctgttcctattttaaaaggtgtccagtgtgaggtgcagctggtggagtctggaggaaccttgatcagccggggggtccctcagactctcctgtgtagtgtctggactcaccgtcggtgaccaacttcctgacgctgggtcccgccagggctccgaggggaaggggcgtgggaggtggggtctcgagttatctatgccgatggcagcacacactacgcagactcngtgaaggccgattcaccctctccagacnctcctaccgaaagaccacgccttgttcccttacgacttcgaactcgcctacaggtacgtcgacgaccgacgggcaagtgtaatttcgttgtcgctacctcaatcgaactacaaatttaccttcggtggggacctacgggtaccctgggtaccc

SEQ ID NO: 124708 - DNA, 585 bp, Homo sapiens
  misc_feature: GYAE6OF02IUZGT.43.15.B04.1.454.CMB.1.raw
  modified_base (410)..(410): a, c, t, g, unknown or other
  misc_feature (410)..(410): n is a, c, g, or t
  modified_base (447)..(447): a, c, t, g, unknown or other
  misc_feature (447)..(447): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccaggccgggggggtccctcagactctcctgtgtagtgtctggactcaccgtcggtgactaacttcctgagctgggtccgccgaggctccgaggggaaggggctgggaggtcggggtctcgagttatctatggccgatggcagcacacactacgcagtactctggtggaacgggcctattccacccttnccagacgacctcctacaaagaccacgctcgttccctnaacttgaacctgaccttcgaagtacgtacgaaccgaccgacgggacagtagtattacgttgcgtacgtactctatacggaaccttacgtaattacccgttcggtacggggaccctaacgggtaccccgtggtaccccg

SEQ ID NO: 124709 - DNA, 572 bp, Homo sapiens
  misc_feature: GYAE6OF02HKFAQ.43.15.B04.1.454.CMB.1.raw
  modified_base (345)..(345): a, c, t, g, unknown or other
  misc_feature (345)..(345): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccaggcccggggggtccctcagactctcctgtgtagtgtctggactcaccgtcggtgaccaacttcctgagcgtcgggtccgccaggctccgagggagggctggagtggtctcgagttatctangccgagtggcagcacacactacgcagactcgtgtgaggcctattccacccttcncgagacgactcctacaacgaacncgctcgtccctanacttgaacncgcctnacggctcgaccgacgacggactagtgtattagtgcgtacgtacctgacgttgtaaacctacgtaaactttaaccgttcgggaccgggtaaccggtaaccgggtacccttcgggtaacccccg

SEQ ID NO: 124710 - DNA, 633 bp, Homo sapiens
  misc_feature: GYAE6OF02JJCT8.43.15.B04.1.454.CMB.1.raw
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
tcagtgtgagtagtcacgaccggtgctcgatttagacagtatatatccgcgggctgggagaggagcccagcactgggattccgaggtgtttccattcggtgatcagcactgaacacagaggactcaccatggagttttggctgagctgggttttccttgttcctattttaaaggtgtccagtgtgaggtgcagctggtggagtctggaggaaccttgatccagccggggggtccctcgagactctcctgtgtagtgtcgtggactcaccgtcggtgacacttcctgngactgggtccgccaggctccgagggagggctggagtggtcncgagttnctangtccgatggcagcacactactacgcacgactcgtgaggacggaccgtnttcccgaccttccgtaccagacgacccttcccgaacgaacgaaccgactccgttaccgttccccttataaagttccggaaacctcggtccctagacggttagcccggaacaacggcggactagttacgttacgttaattccgggatacccgggtcctaacgtacgttacgtaacccgttaactaacgttaacccggtttcggtaccgggggaacctacccgggggtaaccctttccggtaacccgg

SEQ ID NO: 124711 - DNA, 664 bp, Homo sapiens
  misc_feature: GYAE6OF02H7YAD.43.15.B04.1.454.CMB.1.raw
  modified_base (233)..(233): a, c, t, g, unknown or other
  misc_feature (233)..(233): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (511)..(511): a, c, t, g, unknown or other
  misc_feature (511)..(511): n is a, c, g, or t
  modified_base (653)..(653): a, c, t, g, unknown or other
  misc_feature (653)..(653): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcacatggagttttggctgagctgggttttccttgttcctattttaaagtgtccagtgtgaggtgcagctggtggagtctggagaaccttgatcagccggggggtcctnagactctcctagtgtagtgtcctggactccaccgtcggtcgtaccaacttcctagagcgtcgggtccgctaggctccgaggggtaacggggcgtagggtaggtgggtcngtagttatctatcgcggtatggcagccganactacgtacgcagtacgtctgtacggaacggccgtacgttaccncccttcgtacccaaggtacgtaacctccctaaccaaaggaaaccacgtccgttacgtaccccgttataaaggtttcaaaccgtcgaccccgttanacggtacgtacccgaacgtaaccggccggggtaactaaggttacgttaatttaagtttcggagttacccggacttacgaacgtacgtaacgaacttaaacgtttaccgtcggtaaacggggtcccgaaaccgggtttacccnggtaacccccg

SEQ ID NO: 124712 - DNA, 693 bp, Homo sapiens
  misc_feature: GYAE6OF02H8XZF.43.15.B04.1.454.CMB.1.raw
  modified_base (461)..(461): a, c, t, g, unknown or other
  misc_feature (461)..(461): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccgagggccgggggggtccctcacgactctcctgtgtagtgtctggctcaccgtcggtgacaacttcctgagcgtcgggtccgccaggctccgaggggagggcgtggaggtgggtctcgtagttatcttagtcggccgagtggacagacacacactacgcaacgctcgtggtacggaacgggacctacgttcccaccctcgtacccgaaggtacaccccttcctaaccgaaagtaacccnccgtcttacccgttcccctttaataaacgttccggaaactacgtcccttacgaacgggtaacgttcccgggaaaccgtaccggaaccggggtctaagtttacggttaaatttttacgggtggttaccgtaccggtaaccttctaagttaccgaaccttaaactaaacgtttaccgtttccggggaccgggggtaaccccttaaccggggttaaccccgttggtaaccccccg

SEQ ID NO: 124713 - DNA, 629 bp, Homo sapiens
  misc_feature: GYAE6OF02GDDM8.43.15.B04.1.454.CMB.1.raw
  modified_base (487)..(487): a, c, t, g, unknown or other
  misc_feature (487)..(487): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccgaggccgggggggtccctcagactctcctgtgtagtgtctggactcgaccgtcggtgacaacttcctgagcgtgggtccgccaggcctccgaggggaagggcgtggaggtcgggtctcgtagttatcgtagtcgccgagtggcagcaacacacctacgcacgtactcgtgtagggacggccgtattccgaacccctcgtaccagacgtacctcccgtaccaaacggacctacgtccttcgttacccttacgtaattacgaaacncgtcctacgagacgtacgaaccgacggacggctaagtcgttaattacgttggtcgaccgtacgtactaagtcgaaaccttaacgtaaagttaaccgtttcgggtaacggggcccgtaacggggtacccttcgggtaaccccg

SEQ ID NO: 124714 - DNA, 714 bp, Homo sapiens
  misc_feature: GYAE6OF02GW8CL.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagtttggctgagctgggttttccttgttcctattttaaaaggtgtccagtgtgaggtgcagctggtggagtctggaggaaccttgatccaggccggggggtccctcagactctcctgtgtagtgtctggactcaccggtcggtgacaacttcctgagcgtcgggtccgccgaggcctccgagggggaacggggccgtgggaggtcggggtctctaggttactcgtatcggccgtagtcgggcaggcaacgaccaacgtacgccaagtacctacgtggtacggaacggggtcccgtactttaccgaccccttcgtacccgaaaggaccgtacccttccctaaaccggaaacgtaaaccgtcccggacctttaccggttacccctttacgaaacgtttacgaaaaccgtcggtaccctaccgaaggaccgttcccggaaaccgaccggaacgggccttaaggttacggttaactttagggtttacgcggtaccgttaacgtctaagtcggtaaacctaacgttaaatttacccggttggacccgggggttaacctaacggggtaaccccgttggtaaccccgg

SEQ ID NO: 124715 - DNA, 644 bp, Homo sapiens
  misc_feature: GYAE6OF02FXNVX.43.15.B04.1.454.CMB.1.raw
  modified_base (470)..(470): a, c, t, g, unknown or other
  misc_feature (470)..(470): n is a, c, g, or t
  modified_base (494)..(494): a, c, t, g, unknown or other
  misc_feature (494)..(494): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagtttggctgagctgggttttccttgttcctattttaaaggtgtccagtgtgaggtgcagctggtggagtcgtggaggaaccttgatccgaggccggggggtccctcagactctcctgtgtagtgtctggactcaccgtcggtgacaaccttcctgacgcgtcgggtcccgccgacggcctccggagggggaacggggcgtagggaggtgggtctcgtagttatcgtagtcggaccgtagtcggacacgcacaccgaccgtacgcagtactcgtgtaggaacggcctacttccaccccttcaccgagtacgtacccttccctaaccgaaacgaaccnccgtccgttaccgttaccccttanaaacgttcgaaacctccgtaccctacgaacggtacgtaccggaaccgaccggtcggactagttcgtaatttagtggtacgcctatcgattacaaccgttaactaacttaaccgttcggacggggtaccaccggggtaccctggtaccccg

SEQ ID NO: 124716 - DNA, 772 bp, Homo sapiens
  misc_feature: GYAE6OF02HPU6H.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggctcaccatggtagttttggctgagcttggttttcttgttcctattttaaaggtgtccagtgtgaggtgcagtcgtaggtggagtcgtggaggaaccttgactccgagggcccgggggtccctacgagtcctctcctgtgtagtgtgtcggactcgaccggtggtcgactaaccttcctggacgtcgtcgggtccgccgaggtcctaccgggaaggggtacggggtctaggggtaggttcggggttctacgttagttattaccgtagttccgccggtaagtcggctacgcctaacgaccgtaccgtaacgacgtacggtaacttcgtaggtacgggaaccggttaccgtacgtttacccacccgttcccgtaaccgtacggaacctaccccgtaacccttaacgaaaaccgtaccgtaaccgtcccttacggttaccccttaacgtaacgttaaccgaaaccgtacgtcccgttaagaaccggttcgacccggaacgtaacggaccggtagttacgttaacgtttagtttacgttcgtacgtaccgttaacgtcgtaacgttactaacccgttaaacctaacggtttaccggttaccggggtaccgggtaacccggttaacccgggttcccgttaaccggggttacccccc

SEQ ID NO: 124717 - DNA, 712 bp, Homo sapiens
  misc_feature: GYAE6OF02JYQ56.43.15.B04.1.454.CMB.1.raw
  modified_base (363)..(363): a, c, t, g, unknown or other
  misc_feature (363)..(363): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggtttccttgtcctatttaaagtgtcagtgtgaggtgcagctggtggagtctggagaaccttgatccgaggccggggggtccctgagactctctgtgtagtgtactggactcgaccgtggtgaactacttccgtgacgcgtcgggtccgcgacggccgtcggagggacgggctgggaggtgggtctcgagttagtctagtcgtcgtaagtcggngagctacgactacgtacgactaagtaccttcggtaggtacggaaacggggtcctaacctttccaccccgtactacccgtaagtaaccggtacccttacccgaaccgaaacggtaacctaccggtccttaccggttacccttactaaacgttaccgaaaccgtaccggtaccctacgtaacgggtactaacccgggaacccgaaacgggacccggtagttaaacgttacggttaactttaggtcgggttaccgcgttaacccgtgttaccgtaaagtaacccttaacgttaaccgttaacggttccggaccggggtaacccggacgggttaaccccgtcggttaaccccg

SEQ ID NO: 124718 - DNA, 915 bp, Homo sapiens
  misc_feature: GYAE6OF02HYDFL.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcacatggagttttggctgagctgggttttccttgttccttattttaaaggtgtccagtgtgaggtgcagctgggtggagtcgtggacggtaaccttgactccgagggcccgggggggtccctcgacgactctccgtgtgtaggttcgtcgtggacctccgaccggtcggtagaacctaacttccgtgagtccgtcgggtcccgtaccgacggcccgttaccgggaagggggtacgggggtcgtaggggacggttggggttcctacggtaaggttttactaccgttagtccggaccgtaggtcgggactacgaccaaccgaacctaccgtacgaccgaagtaccgtacgttggtaacgggaacgggtacctacgttaccctaccccgttaccgtaccgaaccggtaacgtaccctacccgtaaccgaaaccgaacctacccggtccttacccgttaccccttttagtaaaccgtttaccgaaccgtaccggtaaccctacgtaaacgggtaacccggtttaacccgggaaacccggtaacccgggaacccggggttacgttaaaccggttttaacggttaaacgggtttttacgtttacggggtttaccggtaacccggttaacccttaaaccgggttaacgttaaaccggttaaaaccccgttttaaaaaccgttaaaaccccggttttaacccgggttttaacccggggtttaaccccggggggaaaacccccggttaaaacccggggggtttaaccccccggtttacccggggtttaaccccccccgg

SEQ ID NO: 124719 - DNA, 699 bp, Homo sapiens
  misc_feature: GYAE6OF02GKOHI.43.15.B04.1.454.CMB.1.raw
tcagtgtgagtagtcacgaccggtgctcgatttagacagtatatatccgcgggggctgggagaggagcccagcactaggattccgaggtgtttccattcggtgatcagcactgaacacagaggactcaccatggagttttggctgagctgggttttccttgttcctattttaaaaggtgtccagtgtgaggtgcagctggtggagtctgggaggaccttgatccgaggcccggggggtccctcgacgacctcctccgtgtgtaggtgtctggacctcgaccgtcggtgacaaccttcctgagcgtcgggtcccgccgtaggcctccggaggggtaacggggcgtaggggtacggtcggggtctcgtagttactcgtatcggtaccgagtcggacagccaaccacctaacgtacgacacgaccgttcgtaggtagggacgggtccgtattacccgtcccctactacccgacgaaccggtaccctcccgtaacccaaacggtaaccaccgtcccttaccggttacccttacgtaacgttacgaacctacgaccttacgagtaccgtcgaaccgacgacgggtactaagttattaagtttacgtgttacggcctaccgtaactagtaccgtaactaaccttaaacgttaaccttccgggtaccggggaaccgtaacccggggtacccgtcggttaaccccgg

SEQ ID NO: 124720 - DNA, 817 bp, Homo sapiens
  misc_feature: GYAE6OF02HYZZ6.43.15.B04.1.454.CMB.1.raw
  modified_base (750)..(750): a, c, t, g, unknown or other
  misc_feature (750)..(750): n is a, c, g, or t
tcagtgtgagtagtcacgaccggtgctcgatttagacagtatatatccgcggggctgggagaggagcccagcactgggattccgaggtgtttccattcggtgatcagcactagaacacagaggactcacatggtagttttggctgagcgttgggtttttcctttgttacctttaagtttttaaaagggtcgtcctaggttgtggtagggttcgcgagtcgtgggttaggtacggttccggtaggggtaacgggtaacccgtttaggtaaccgttaccggaaccggggggttcccccggggggggggttaccccttacggaacggtaaccgttcccgttaccgttggttcggtaggttcggtcgtcggtaccttacccggtaccggttcggtacgaaccttaaaccgtttccgtaggtaccggtccggttccggggtacccggccggtacggtccccgtaccgggaaggggggtacggggtccgttagggggtacgggttacgggttccgtacgttaaggtttactacgttagtacggaccggtaagtcggcgaaccgactaaccgaccacgtacgacgacgtactcgtagtacggaccggtactactcctaccctctaccgaagtacgacccttacaccgaacgtacaccgtctttaccgtacccttaataccgtagtacccacgttcaacggtacgacgaccgtacgacggtaccgattacgtgttaaactgttacgacgtactaccgntaacctattaactaactaacgttacggttaccggccgggtaaccgtacggtaccccgttggaccccg

SEQ ID NO: 124721 - DNA, 665 bp, Homo sapiens
  misc_feature: GYAE6OF02IWMED.43.15.B04.1.454.CMB.1.raw
  modified_base (276)..(276): a, c, t, g, unknown or other
  misc_feature (276)..(276): n is a, c, g, or t
  modified_base (458)..(458): a, c, t, g, unknown or other
  misc_feature (458)..(458): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccaggccgggggggtccctcagactctcctgtgtagtgtctggactcaccgtggngacacttcctgagcgtgggtccgcaggctccgagggaggggctgggaggtggggtctcgtagttactcgtatcggccgtagtcggcaggccaacgaccaactacgacagacttctaggtacgggaacgggcccgtattcccaccccttcaccgaaggacgtacctccctaccaaacgaaccnccgtacctccggttcccttacaacgtttacgaacctaccggtacctacgaacggtacgtacccggtaaccgaaccggaaccgggtactaagttacggttaactttagtttcggtagtaccggtacgtactagttacgtaaccttaactaaacgttaaccgtttccggtagggggaaccctaacggggtaaccccctgggtaaccccg

SEQ ID NO: 124722 - DNA, 791 bp, Homo sapiens
  misc_feature: GYAE6OF02FOXBR.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagctgggttttccttgttcctattttaaaaggtgtccagtgtgaggtgcagctgggtggagtctggaggtaaccttgatccgagggccggggggtcctcgagactctcctgtgtagtgtctggtactccgaccggttcggtacgaacctaacctttccgtagacggtcgttcggggtccccggtaccgacgggccgttacccggaagggggaacgggggtccgtggggaggtcggggttccgttaccgtaggtttactcttacgtacggacccgtagtcggacacggtaccaaccaactacctaacggcaacggtactcgtaggtacggtaaacgggccgtacgtttccacccccttcgtacccgaagtaccgtaccctttaccccgaaaccgaaacggaaaccctaccggtccctttacccgggttacccctttaacgtaaagttacccgaaacctacggtcccttaacgacggtaacgtccgaacgttaaccggacgggacctaagttcgtttaacgtttagtttacggtacggtaccgtacgtccggtagttaaccggtaactaaacccgttaagtttaaacccggtttccgggtaaaccgggggtcccggaaacccggggttaccccttcgggggtaaccccc

SEQ ID NO: 124723 - DNA, 870 bp, Homo sapiens
  misc_feature: GYAE6OF02HNQDC.43.15.B04.1.454.CMB.1.raw
tcagtgtgagtagtcacgaccggtgctcgatttagacagtatatatccggcggggctgggagaggagcccagcactgggattccgaggtgtttccattcggtgatcagcactgaacacagaggactcaccatggagtttggctgagctgggtttccttgttcctatttaaaaggtgtccagtgtgaggtgcagctggtggagtctggaggaaccttgagtccaggccggggggtcctcgagactctcctgtcgtagtgtcgtgctcacgtcggtagaacgtaacttcctagacgtcgtagggtccgccaggcctccgaggggaacggggtcctaggggtagtacggggtcttaccgtaaggttaacgtcgtaacgtacggtacccggtaacgttcgggaccgtaacgggtaccctaaaccggaaacctaaaccgttaaacccggtaccgtaaaaccgggtaccccttaaccggttaaccggttaaccggggtaaacccggggtaaccccgggttaactttacccccgtaacccccgttaacccgtttacccccgaaagggttaaccccggtaaaccctttacccccggtaacccgttaaaaccgggaaaacccgtacccggttaacccgttaccgggttaacccctttaacgaaacggttttaaccgggaaactaaccggtaccctaacggtaacggaaaccggtttaccggaaaccgaccggtaaccgggggttaactaaccggtaagtttaaccggttagttaacgggtaccgtaacgggtacctaacggtacgtaaccggtaacttaacggtaaacttaaccgttcggtaaccggggtacctaaaccgggacccttacgggtaaccc

SEQ ID NO: 124724 - DNA, 720 bp, Homo sapiens
  misc_feature: GYAE6OF02IGK3Q.43.15.B04.1.454.CMB.1.raw
  modified_base (362)..(362): a, c, t, g, unknown or other
  misc_feature (362)..(362): n is a, c, g, or t
  modified_base (518)..(518): a, c, t, g, unknown or other
  misc_feature (518)..(518): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggtagttttggctgagcttgggtttttccttgttcctattttaaaaggtgtccagtgtgaggtgcagcgtggtggagtcgtgggaggtaaccttgactccgagggcccgggggggtccctcgagactctcctgtgtagtgtcgtggactccacggtcggtgactaacgttcctggagtcgtacgggtcccgccgaggtccgtaccggagggggaacgggggtcgtaggggngggttcgggtctcgttaggttacgttactagtcggtaccgaggtcggacacggcctaaccaccgaccgtacgacctacgacctgtcggtaggaacgggtaccgtacttcccgtacccgtctaccgacgaactcccgtacctaccgaaagtaacccnccggtcttaccggttaccccttagaacgtttaccgaacgtacgtaccctaggtacgaacggtacccgggaacgaccgaccggggtacctaagttcgttaactttgtacggtaccgtcgtactaacgtagtacgtaaaccgttataaacgtttccgtaccggggcgggtaaccccggtacgggtaccccgttcggtacccccg

SEQ ID NO: 124725 - DNA, 674 bp, Homo sapiens
  misc_feature: GYAE6OF02HE0GJ.43.15.B04.1.454.CMB.1.raw
tcagtgtgagtagtcacgaccggtgctcgatttagacagtatatatccggcggggctgggagaggagcccagcactgggattccgaggtgtttccattcggtgatcagcactgaacacagaggactcaccatggagtttggctgagctgggttttccttgttcctattttaaaaggtgtccagtgtgaggtgcagctggtggagtctggaggaaccttgatccgaggccggggggtcctacgagactctccgtgtgtagtgtctggactcaccgtcggtgactaacttcgtagagctcgggtccgcgaggctcgaggggacgggctgggagtcgggtctcgtagttatcgtagtcgacgtagtggacgaagcctaacgacactacgcgaagtactctaggtacggaaacgggtcctagttccaacccttcgtacccgaaaggtaccgtaccctcccgtaaaccgaaaaacggtaccctaccggtccttaccgggttacccctttaagtaaacgttacgaaaccgtccgtaacccgttaggaaacggtacggttaccggaaaccaacggtacgggaccttagttagtaactttagtacgggtcacggtacctgaactagaccttaagaaagtttacgtccgggtgggaaccctacggggtaccttccgggtaccc

SEQ ID NO: 124726 - DNA, 683 bp, Homo sapiens
  misc_feature: GYAE6OF02GNCW7.43.15.B04.1.454.CMB.1.raw
  modified_base (293)..(293): a, c, t, g, unknown or other
  misc_feature (293)..(293): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagttttggctgagcgtggttttccttgttcctattttaaaggtgtccagtgtgaggtgcagcgtggtggagtcgtggaggaaccttgatccgaggccgggggtccctcgacgactctcctgtgtagtgtcgtgactcgaccgtcggtacgactaccttcngacgcgtcgggtccgccgacggccgtaccggaggggaagggcgtagggaggtgggtctcgtagttatctagtcgacgagtcggcgacgcacaccgtacacgacgacgactcgtaggtacgggacgggtaccgtacgttcccgaccccgttcaccgtagaccgtacccttaccccgtaaaccaaagtaacccacgtaccttccgttaacccttaagtaacttaccgtaaccacgttacccacacgggtaacgtacccggaacgacccggtaaggtcctaagttagttaacgtttacgtgtacggactaccgtcgaaattccgaaaccttaacgtaaactttaccggttcgggaaccggggaccctaaccggggtaccctgggtaacccccc

SEQ ID NO: 124727 - DNA, 624 bp, Homo sapiens
  misc_feature: GYAE6OF02JJHWX.43.15.B04.1.454.CMB.1.raw
  modified_base (297)..(297): a, c, t, g, unknown or other
  misc_feature (297)..(297): n is a, c, g, or t
  modified_base (386)..(386): a, c, t, g, unknown or other
  misc_feature (386)..(386): n is a, c, g, or t
  modified_base (462)..(462): a, c, t, g, unknown or other
  misc_feature (462)..(462): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggagtttggctgagctgggttttccttgttccttattttaaaaggtgtccagtgtgaggtgcagctggtggagtctggaggaaccttgatccgacggccggggggtccctcagtacctcctccgtgtgtagtgtcgtggactcaccggtcggtagactaacttccngagcgtcgggtccgcgaggcctccggaaggggacgggctgggtagtcgggtctgtagttacgtctagtcgccggattcggcacgccaanacctaccgtacgactaggcctagtacgtagggaacgcgtactccaccctctccagacacctcctacgaacgaaccnccgtacctcgttacccttactaagttacgactactaccaccgtaacgacgaccgaccgaaccacgggactagttagtaatttcgtcgtgccgtactacgtactcgtaactaactaacgtaccgttacggtaccggaccggtaccggtacccgttacgtcccg

SEQ ID NO: 124728 - DNA, 760 bp, Homo sapiens
  misc_feature: GYAE6OF02GSVVX.43.15.B04.1.454.CMB.1.raw
  modified_base (304)..(304): a, c, t, g, unknown or other
  misc_feature (304)..(304): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatgggtagttttggctgagcgttggttttccttgttccttagttttaaaaggtgtccagtgtgaggtgcagcgtggtggagtcgtggaggaacttgatccgacggcccgggggtccctcgacgacgtcgtcctgtgtagtcgtctcggactccgccggtcgtcgtacaacttccngcgtcgtcgggtccgccgtacggccgtaccggagggaacgggtcgtagggtacgggtcggtcgtcgttagttactcgttacgtacgtacgtgtacggcgaacgccaacgaccaccgtacgactaccgtactcgtacggtacggtaacggtacctaaccgttccgtaccccgttaccgttccgaacggtaaccgacccgttaccccgtaaaccgaaacggtaacccgtaccgtccgtttacccgttacccttaacgtaaccttagtaaccgtaccgtacccgtacgtaacggtacccggtacccgaacggtaaccggtacggtacttacggttagttaacgttttaccgtcggtaccggtacctcggtaacgttaacgtccggtaaaccttaccgttaaagttcccgttacgggttaaccgggaacccgttacgggtaaccccgtcgggttaacccc

SEQ ID NO: 124729 - DNA, 755 bp, Homo sapiens
  misc_feature: GYAE6OF02IQYJJ.43.15.B04.1.454.CMB.1.raw
  modified_base (329)..(329): a, c, t, g, unknown or other
  misc_feature (329)..(329): n is a, c, g, or t
  modified_base (624)..(624): a, c, t, g, unknown or other
  misc_feature (624)..(624): n is a, c, g, or t
tcagtgtgagtagtcacgaccggtgctcgatttagacagtatatatccgcggggctgggagaggagccccagcactgggattccgaggtgtttccattcggtgatcagcactgaacacagaggactcaccatggagttttggctgagcttgggtttttccttgttccttattttaaaaggtgtccagtgtgaggtgcagctggtggagtcgtggacggaaccttgatccgaggccggggggtccctcgagactcctctgtgtagtgtctggactcgaccggtcggtgaacctaacttccgtagaggcgtcgggtcccgccgacggcccnccggaggggaacgggggcgtacggggtaggttgggtcgtcgtaagttactcgttagtcggaccgtagtcggacacggacaaccaacctaaccttaaccggaccgtagtaccgttacgtggtacgggaaccggggtccgttaacttcccgtacccccttcgtaacccgaacggtacctacccttacctaaccgaaacgtaaccgaccgttcccgtaccggttacccttaaccgtaaagttaccgaaacgtaccgacctccgaaggttaccgcccggaaacgtaccggaccgggtanaactttaggttaacgttggttacgtacgcccggttaactacgtagttacctaacgttaaaccgtaaccgtttaacgttaccgggttaccggggacccgttaaccggggtaccccgtttcgggtaacccccg

SEQ ID NO: 124730 - DNA, 704 bp, Homo sapiens
  misc_feature: GYAE6OF02FVFC3.43.15.B04.1.454.CMB.1.raw
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
tcagtgtgagtagtcacgaccggtgctcgatttagacagtatatatccgcggggctgggagaggagcccagcactgggattccgaggtgtttccattcggtgatcagcactgaacacagaggactcaccatggtagttttggctgagcttgggttttccttgttccttattttaaaaggtgtccagtgtgaggtgcagcgtggtggagtcgtgggaggaccttgatccgaggccggggggtcccncgacgcctctccgtggtagtagtgtctggctcgaccgtggtagacaacttccngacgcgtggccgcgngtcctaccggagggacgggcgtaggnggtacggtctcgtagttatactagtcgacgngtggacagccacacctacgtacgacgacgtctacgtggtacggaacgggtcccgtacttaccgacccccgtctacccgagaccggtaaccttaccccgtaacccaaagtaccctaacgtacccttaccgttacccgtttaactaacgttacgaacccgccgttaccgaccgtaacggaaccgttaccggaaccgaaccgggacggtaccgtaacggtttagtaagtttccgtaggttccgaacgtaccttggacgttaaccaaccgttaagttaaccgtaccggttacggttacccgggacccgggaaccggttaaccccgtcgggtacccccg

SEQ ID NO: 124731 - DNA, 756 bp, Homo sapiens
  misc_feature: GYAE6OF02F2Q11.43.15.B04.1.454.CMB.1.raw
  modified_base (172)..(172): a, c, t, g, unknown or other
  misc_feature (172)..(172): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (577)..(577): a, c, t, g, unknown or other
  misc_feature (577)..(577): n is a, c, g, or t
tcagtgtgagtagtcacgaccggtgctcgatttagacagtatatatccggcggggctgggagaggagcccagcactgggattccgaggtgttccattcggtgatcagcactgaacacagacggactcaccatggagttttgctgagctggtttccttgtcctatttaaagtntccagtgtgaggtgtcagcgtggtggagtctggacggtaaccttggactcgacggtcccggggggtcctacgacgactcctccgtgtgtacgtgtctggactcaccgtcggtanactaacttccnggacgtcgtcgggtccgccacggtctacccgggaggggtaacggggtcgtacgggtacgggttcgggtactccgtacggtttacttcgttaacgtccgtacggtcgttacggacgtaacgaccttaacgaccgtaacgtacgacgtacgtaaccgttcgtaggtacggtaccgggccgtaacgttacccgaccccgttagtacccggtaaacgtaacccggttccttaaccccgaccgtaaaacgtaccccggtacgtacccgttaggttaccccgttanaaaccggtttacaacccgtcgtaaccctacggaaggtaccgtacggaccggaacgtaccggtctacggttaaagtccgttacggttcgtacgtaccgtaacgtcgtaaccgttacgtaaccttacgtaaccgtacgtttccggaagggttacccgacgggttaccccttaggtaccccg

SEQ ID NO: 124732 - DNA, 956 bp, Homo sapiens
  misc_feature: GYAE6OF02JMUMN.43.15.B04.1.454.CMB.1.raw
tcagtgtgagtagtcacgaccggtgctcgatttagacagtatatatccgcggggctgggagaggagcccagcactgggattccgaggtgtttccattcggtgatcagcactgaacacagaggactcaccagtggtagttttggctggagcttgggtttttccttgttccttaatttttaaaaaggtgttccagttgtggaggtgcgagcgttgggtggtaacgtcgttagggaacggtaaccgtttacggacgtccgaacgggtcccggggggggttcccctaccgtaacggtaccgttccgttcccgttggttacggttaggttcgttccgttacgggtaccgttacccgtaccgggttccgggtacggtaacccgttaaacctttcccgttaggtaccggtcggttccggggttacccccgtaccggtaccggggttacccgtacccggggaacggggggtaaccgggggtaccggtacgggggttaacgggtttcggggttcccgtttacggttaacggttttaacgtccgttacggttaccggtacccggtaggtcggtaacgaccggtaccgaaacccgtacgtaaccgttaccgtaaccggacgtaacgttccggttacggtaacggggtaaaccgggtcccgtttaccgttaccccgtaccccggtttaccaaccggtaaccgaacccgttacccccttacccgaacgtaaacccgtaacccgtacccggttcctttacccggttacccctttaacgtaacgttaaacgaaacccgttcggtaccccgttgaaaccgggtaccgtaccggaaacccggtacgtaccggtattaacgttaacgttactttacggttggtaccgacgtacgttaccaagttacccggtaataaccgttaacgttaccggtggtacccgggtaaccgtacccggtacccgttcggtaccccg
